United States Patent 12,371,699 (NUCLEIC ACIDS ENCODING CRISPR-ASSOCIATED PROTEINS AND USES THEREOF) - sequence listing, part 4

SEQ ID NO: 2932 - RNA, 3960 nt, synthetic construct
  misc_feature 1..3960: note = Cas9 variant
  source 1..3960: mol_type = other RNA
atgggctacaacatcgggctggacattggaaccggtagcgtgggctgggccgctctcacagatgaggggaaacttgcaagagccaaaggaaagaatctgataggcgtcaggttgttcgactccgcgcagtctgctgcccaacggcgctcatatcgaactacgcgtagaaggttaagtcggcgcaaatggagactgaggctactcgaaaacatctttagcgatgagatgggtatgattgacgaaaatttctttgcacggctgaagtactcctatgttcaccccaaagatgaggtgaacaatgcccattactatgggggataccttttccctacccagcaggaaacacacgactttcatgagaagttccagactatctatcatctgcgcttgaagctcatgattgaggattgcaaatttgacctgcgagaaatctacctggctatgcaccacatagtaaagtacagaggccacttcctcaactctcaatcgaaaatgaccatcggcgattcatataatccaagggactttcagcaggcaattcagaactacgccgaggctaaggggttaatctggagcctgaatgatgcccaagaaatgacagacgtgcttgtcggacaggcgggtttcggcttgagtaaaaaggcaaaggccgagcggctgctatccgctttttctttcgataccaaagaggacaagaaagccattcaggcaatcctcgctgggatagtgggaaacactacagactttaccaagattttcaatcgtgaacgcagcggcgatgagctgaaaaagtggaaacttaagctggactccgaagccttcgatgagcagtcacaagcgatcgttgacgaattggatgacgatgagatggagctctttaacgccattagacaggcattcgacggttttacgctgatggatttactgggggaccagaccagtatcagcgctgccatggtgaagaggtatcaacagcatcacgatgacctcaaaatggtcaaggaaatcgctaaaaagcagggactttctcatcaggacttctccaaaatttacactgcctttctgaaggatgacacagataagggcatgaaagcattgctagacaaggccgatctggctgacgatgtgctcgtagagatacaacagcggatcgaatcacacgacttcctgccgaaacagcgaactaaggcgaatagcgttattccctatcagcttcacctggcagagttggagaaaatcatagaaaaccaaggcaagtactatccttttctcctggataccttcacaaataaggccggggagaccattaacaaattagtggaactggtcaagtttcgcgtgccatactacgtgggacccatggtcacggctgccgacgttgagaaagccggtggcgatgcaactaaccattgggtgaagagaaatgaagggtatgagaaaagtcctgtaacaccatggaacttcgaccaggtgtttaatagggatcaggctgcccaggacttcatcgaccggctaaccggaactgatacatacctcatcggcgaacccaccctgcttaagaactctttgaagtatcaactgtttacggtcctcaatgagctgaacaatgtgaaaattaacggtcacaagatcgacgagaaaaccaagcatgttcttattcaggatctgttcaaatccaagaaaacagtgagcgaaaaggcaataaaggactactatttgtcgcaggggatgggcgagatccagattgtcggactcgcggataaaactaagttcaattctaacctgtcctcatacatcgacttaagtaaaacctttgatgctgaatttatggagaatcctgccaaccaagagctgctagaaaatatcattcagatacagacagtgtttgaggacgtaaagatcgcagaacgcgagctccaaaaactggcccttccagatgaacaggttcagcagttggctaagactcactataccggctgggggaacctgagcgacaagctcctgtccacaccgattatccaagagggatctcagaaagtgagcattttaaataagctgcagaccacttcaaagaacttcatgagtatcataacggataacaagtttggtgtccagcaatggatccaggagcagaatacagccgaaaccgcagactccattcaggatagaatcgacgagcttactaccgctcccgccaacaaaaggggcattaagcaagcgttcaatgtgttgtttgacatccagaaggccatgggggaggaacctaaccgtgtctacctcgagttcgctaaagaaacacagaatagcgtgcggaccaactctcgatacaatagactgaaggatctatataaatcaaagactctgagtgacgatgttaaagcactcaaggaggaactggagagccaaaagtcctctcttcagtcggaaaggataggagaccgcttgtacctgtatttcttacagcagggcaaagatatgtacacaggtcaaccaattaacatcgacaagctcagcacggattatgacattgatcatatcataccccaggcctacaccaaagacgattccatcgacaatcgggtgctggtatcaagacctgagaacgctaggaagagtgactctgccacttatacaaccgaagtccagcagagcgcagggggcctttggaaatccctgaagaatgcgggattcatttcacagaaaaagtacgatcgcttgacaaagggcggggactacagcaaaggacaaaagactggttttatcgcccgacagctcgtggagacccggcagattatcaaaaacgttgcttctctgatagagtccgagttcagtcaaacgaaggccgtggcaattcgtagcgaaatcaccgctgatatgagaaggctagtcgccatcaaaaagcaccgcgaaattaattcttttcaccatgcattcgacgccctgctcatcacagctgcgggccagtatatgcaggcccggtacccagatagagacggggcaaacgtgtataatgagttcgattactatactaacacctacctgaaggagcttaggcagtcctcaagtagctcgcaagtacgacgcttgaaaccctttggattcgtggttggcacaatggctaagggtaacgaaaattggtccgaggacgatactcagtatctgcggcacgtcatgaactttaaaaatattttaaccacgagaaggaacgacaaggataatggggccctcaacaaagaaacaatatacgccgtggacccgaaggctaagctgatcggcaccaataaaaagcgtcaggatgtgtctctttacggaggctatatttacccttatagcgcatacatgactctggtccgcgccaacgggaaaaatctactcgttaaggtgacaatctcagcggctgagaaaattaagagtggacaaatcgaactgtccgagtatgtgcagcagcggcccgaggtaaagaaattcgaaaagatattgatcaacaaactggccattggccagttagtcaataacgacggtaatctcatctacctgacctcttatgagttttaccataacgcaaagcaactttggctgccaactgaagaggccgacttgattagccagctcaataaagattcctcagacgaagatctgatcaaggggttcgacatactaaccagccctgctattctgaagagatttcccttctacgagcttgatctcaaaaagctggtgaacatcagggacaaatttatcgcagttgagaacaagttcgatattttgatggtgatactgaaagccttacagctcgacgcggctcagcaaaagccagtcaaaatgatcgataagaagagtgccgactggaaagattatcgacagcggggaggcattaagctgtctgacacatccgaaatcatttaccagagcacgaccggtatctttgagaaacgcgtgaagatatcgaatcttctgtga

SEQ ID NO: 2933 - RNA, 3963 nt, synthetic construct
  misc_feature 1..3963: note = Cas9 variant
  source 1..3963: mol_type = other RNA
atgaccgagcagcaaagaccctacaacatcggcctggacattgggacaagctccataggatgggccgtgactgatcagaatgacaagctccttcacatcaggggtcataacggcattggggtccggctgttcaaagaaggagagtctgctgcagaacgccgaggctttcgtacgaccagaaggcggttgtcacgcagaaggtggcggttacgcttcctggatcgaatctttgacgccgagctagcgaaggttgatcctaatttcctcgctagactgaaacagagtaacattagcccacttgacccgaataagcagatgtttggtaacatcctgttcgatgacgcccaatttgatgaccagaaattccaccagcagtatcccacaatataccatttgaggtccgcactcgcccaacctgatgctccacaggcagacgtgcggctgatctatctggccctccaccatatgattaagtttcgtgggcacttcttaaatggagctgccgtagaaaagtttcacggcggccagctgcatcttgaggcggagttccaggaattgaaccaaatcttttctaatcagcagcgcgatcacgtgcaactgcagacttcgtcactagacgaggtcgcaaccattctcaaagacaaccagagaacacccagcgataggcagcgggaactgagtgcccgacttttcgtgcctgttgacaagaccatcgataaagagaataagaaactggctactgagttgctcaaggccgtgctggggttaaaggcaaaattcgacgtcatactgggagtggaagctacagatccacaagcctttaagctccagttctcctctgacgattttgacgataaaattgcggagcttgccagcgaactgaccgacgaggcaaacgaaatcttgacggtactacagcgcctgtacttctccctcaatctggctgatattcttactaacagacagaccaagcaagttgccgactcaatcagtacagctatgatcaataggtatgacgatcataaacaccacctgaagatgttgaaagagctcgagactcaggtgacccaggaacagcgggacggtctgaagaaggcctacgatgagtatattgacggcgataaacccacaatagacaccttttacacgaacgtcaagaaaaacttagatgacagcgaactggcaaatcaaatcaagtctctaattgatctccaggccttcatgcctaaacagcgctccaaggagaacgggtcaatcccacatcagctgcaccaaagagaacttgaccagttgatagaggtgcagggaaagtactatccgtggctgctcgctgcgaaagataagctggacgcacttattgcctttagggtgccctactatgtcggccctatgatcgatccaaatgagagcgacgacccccaaaacactaaattcgcttggatggttcgtaaggaagccggtgagatcacaccttggaattttgaagagaaagtggataagaccgggagtgcaactaacttcattaagcggatgacaaccacggacacctacctgttgggagaaccagtactccccaaaaattctctgttatatcagcagtttacagtgctgaacgagctaaataagctcaaagtcgatggcaaggccctgactgtggaccagaaaaagtacctttatgagcatgtttgcaagaaacaacgaagagtgaccttgaagaaactgtccgattgtctcatggctaggggcgacttcccgatgggggccatctttacaggaactaccgatcagaagaacatgaataacacactgaaaacctaccaggacttccaggaaattttcggtgatgagatagacaatcctgatcgccaagtcgactttgaaaagatgatcgagtggagcactattttcgaggatcgggaaatctttaaattaaagctggcagagcttaactggttgacgtcggaacagctcgagagagtgtctaagaaaaggtaccagggctgggggcgcctgtcccagaagctactgacacacatcgtaaatgaaaacggagagcgaattatagaccaactctggaacaccaatcagaacttcatggagatcatgggccaggacggtgttaaacaagcgattcaggaacataatggggctaacgtggcccagactggcatcaatgagaccattgatgaactgtatacatcaccccagaacaagaaagcaatccggcaaatacttttggtcgtggacgatatcaagaaggccgtcggatacgctccagccaatattatgatggagtttgcacgtgaagacagagatgaccacaggctgatcgctagtcgcgcccggcagttagagaaaacctatcaggagattagcaagaactggttcgataatgaatccgtgactcaggagctcaaagaccaaatcaagaacaaaacaaagtttacggatagactgtacctttatttcatacagggcgggattgacctgtacaccggacaccctttgaatatcgatcagctctctagctatgacattgaccatatcctgccccagtcatttctactggataacagtctcaataacagggttctgacttcccaaagcgaaaatcgagtgcacaaggaggaccgccttccaggtgaaacagtagcgaacaaaatgcggcccacctggaagatgatgagagagcagggcttgatgacacagaggaaatacaacaatctgactttaaagcctgatcagatatctaaattcaacaatcgtgggcaatttatcaaccgccagctcgtcgagaccagacaggtgattaagctggccgctgacatcatgaatcaaaagtaccaggcagatcagacgaaagttgtgaccgtcaaggccaaccttacacatcacatgcgggaaaaattcaatttttataagtcaaggaacgtgaatgactaccaccatgctttcgatgcctatctgactgtattcgtgggaaactggctactcaaagagtacccaaagctgcagccgtattttgtttacggcgacttcgcaaaaaccggtacaaataacttgaagagttttaatttcctgtatcgatttgaacgggatcacaagttaaacgacaaaggggcgattgatactgacaaggatcaacagctcggctacatgaaacgcatctacagattcaagaaaatgctggtcaccaagcagcttgagacgaatgagggagccctgtataagcagacaatatacaaagctcccgccaacgaaaagaacaccaaaaagaataggagcttgattaacactaaaaagaatcggccttccgacatctatggcgggtactctcaatcggtgacagcatatatgagcctcgtgtttttcaagaacacctttaaactgatcaagatgcccctagtcgctgccaatgcaattaaaaactccctgtcaagttaccatgacactatccttaagattctcggatctaatgagttcaaagttctgataccaaaggtgaagatgaaccagttgatcaaagaaggtgatagcctgtataccgtggtaggcgtctacaagcacaatgcccagcagttaattctctccgacaactcaatggggatcattacaaaacctatccgagagatatgcgatagcgacctggattctgtgtttaatgaacttgttgacaacatcgataagtacctgaatttgtataaaattgaggacaagctcacgatcaaggagaaattctacgctctgaagaacaaagaatccaagttcaaatgtattagtgatatcctagtgggaacccattgcaatgcgggcagaagcaacctgaagataattggtctttcttcctattgggggatgttttcaggcaataacgacggactcaaaatcaacgagaatagtcaactgatctaccagagcccaactggcttgttcgaacaccgcgtcaaggtgtcggatttatga

SEQ ID NO: 2934 - RNA, 3972 nt, synthetic construct
  misc_feature 1..3972: note = Cas9 variant
  source 1..3972: mol_type = other RNA
atgaaggacttctacatcggcctggatatggggaccgacagcgtgggatgggccgtcgctgatgaggactataacctctgcaaatttaagggtaaagcaatgtggggcgttagacttttcgatgaatccgccacagcggctgagaggcgggggtttcgcactgcccgacgtagagcacagaggaagcggcaacgcattctgtggttgcagatgttattcaatgaagagatatctaaaaaggacatcgcctttttccagagactgaacgaatcaaagctatacctcgaggataaaagtacgaatgtgccctatgctgtatttgcagacgagagcttcaccgatgtggactaccacaagctgtatcctacaatttaccatcttaggaaagaactggtccagtccgatgagccacacgacgtgcggttggtttatctcgccctgcatcacctgatcaagaaccgcggacattttctcttcgaaaatgtgggctctgattttgagaaagagtcgtcattcgaagtcttatttaagaacctgcaaaattacattcttggtgagtacgaattggctctggagtgtatcagcccgctacagatagccgacatcctcaaggacaaaagtaagcgaaaaactaccaagtcctctgaaatttgcaaactgcttgggatcagcaagaaaggacagcccagactgaacgcgattgtgttgctcatgtgtggccagtccgtaaagctggcagatttatatggcgacgagaattacaacaaggaggaaaaatcaagtatcagcttcgagaaggggtatgaagataatgaggaaacatacagggagctgctccttgagcggttcgaactgatagagaaaattaaggccttgtatgactgggctatcctagccgatattctgaaaggagaaacctacatctcttttgcaaaggttaagacttatgacgagcaccgtcacgatctccaacagctgaaggctttcgtgaaagaacgctgcagatccgactacaacgagatctttagggagacatcagataaacttaataactacaccgcctattgtggtaagttcaaagaaaatggccggaacggggtcattctgcatagcgcgaaccagacggacttttgcaagtacttgaagagtaaattcgataagctcgacaaatctggatatgaggacatgtttgaaaagatagagaatggctccttcatgcctaaaatcgtggtgaaggataacggtgtcattccaatgcaggttaatgagagcgaagtgcgagccatcctgaagaacgcatcggggtacttagactttctgaataaccaagataaagacggaataactgtagctgataagattctacagatcttcgagtttcgcatcccctattacgtgggccctctcaatgtccactctgacaactcctggctggtgagaaaagatggcaagatttatccatggaatttcaacaaaatcgttgacgtggataagtcagccgaagagtttattaataaacttaccgctaagtgtacatacttgcccgacagggatgtcatacctaagaacagtatcctgtacagccggtatatggtgctcaatgaactgaacaatcttaaactggacgggaagaaaccagatgtatccttcaagcaggccgttttcaacgacttgtttatgcatcgcagaaaagtgactcaaaaggcactcagggagtacattaaggcccagaccggaacagagccggaaatcaccggtatcgacggcgatttcaaagctaacatgcgtcccgcgattgagctggcagggtataatttatctgaacctgacaaggaggaaataatcaaagccattacgatctttggagatgacaagaaactgctaaagcggcgaattaaggataaatacagcgagatgctctcagaggacgaaatcaagaaaatatgcaagctgaaatataaggattggggcagacttagtagggagttcttgactgaaatctttgacgtcgatacagctaccggtgagtgtaaggacaacattatcaatactctgtggaacacaaatgataacctcatggaactgttaggggccaaatacaatttcacccagtccattgagcaggcaatcagcaagtctacgcacaaagcctcaatagagaagatggtggaagacatgtatgtcagtccaaaagtgaagcgcaccgtttttcaaagcctgaaaattatgaaggagatcgtgaagattaaaggccacgctcccaagaaagtattcgtcgaaatgacacggcatgatggaactaagggcgacaacgggagaaccaaatccaggaagaagcagcttgaggagttgtacaaaaagtgcaaagaagactctacagagctctgggatgaactggagaagactgacgatgacgaatttcgccaggataaactattcctgtactatacccagatgggacgatgtatgtactcgggtgagcggatcgagctccgtgacctgtttaataagaacctttatgatatagaccacatcttccctagaagcaaggtgaaagatgactccattgataatagggttttggtgaagaaacaaatcaactcacataaggacaatgactacccactggatagtacagtccgcgagaaaatgcggggccactggcagtatttactcagacatgggtttatttctaagaagaaatacgacaggctgacccgagtgactccccttacggatgacgaactggccgatttcatcgcacgccagttggtagaaacaagccagtccaccaaggcggtggctactctcctgaaaaccctatatccgacaaccgagatagtttacgtcaaggccgaactggtgtcacggttcagaactgagtacaaatttattaagtgcagggaggtgaacgacctccaccacgcaaaggatgcctatctgaatatcgtcgttggaaacgtgtacaacgtgcgttatacacatagcaaagctatcttcattaagggccttcaaacgaaaaagtactctttgaatcgcatgtttgccttcgacacccctggtgcatggaacatcgaaaatgagaaatccctgagtattgtaaagaaaactgtcatgaagaacaatatattatatacacggtacagctatatgaagaaagggggcctctttaagatccagcccctgaaaaagggaaacggccaggctccacttaaaaaggatctgcctctatctgacattgggaagtacggaggttacgataaacccaccgcctcctatttctcatacatcaagtatgaaggcaaaaaggggaaagagtgcagacagctcgtggcgattgacaattacctgaagaagtattacgaagagaacccaatcgagtatttgacaaataggctgggactcaaaaaccccgccgttttaatacctgtgatcaagtacaatagttgtattgaaatcgatggctttcgaatgaacattagctcgaaatccaatgagggtaagactatcgtctacaaaccagctgtgcaactggttcttggggcagaaaaggaggcctatgtgaagaaaatatctaaggtactgagcaaaccggaggaacagaagattacctcatacgacggcgtcagtgctgaggaaaacatcgagttgttcgacgccctcacggcaaaaatgaccaatacaatctttaagattaaactggaagatataggaaacaagatcaagtccggccgggacaaattcgtgactctagatgtgaagaaacagtgctatgtcattaacgagatcctgaagattatgcactgtaatgttgtgaccggggacctttctctcatcggagcggccaaaaaggctggcatagtaagcacaaactccgccctgtcagagatcaagaaagtgagcagtattatgttgatcaatcaatctgtcactggtctgtttgaaaccaagattgatttactcaacatctga

SEQ ID NO: 2935 - RNA, 3975 nt, synthetic construct
  misc_feature 1..3975: note = Cas9 variant
  source 1..3975: mol_type = other RNA
atgagagccaagggcaaaaccctgatcgggacaagcctcttcagggagggaaacactgctgcagaacggcgcggttaccgaacgacccagcgtagacttaagaggcggaaacgcagactgaagttgttagaggcctttttcgacccctatatttttgaagtggatgagaatttcctggcgaggctacacgaagctgacatatcccctaaagatgagaacaagcggttttggggctctctcctgttcccaaatgagaaggacgccaacttttaccgcaaatatccgacaatctaccatcttcgaaaggcactgatggaagaggatagaaaattcgacgtcagggccattttcttggctatccaccatattatgaagtatcgggggaatttcctctcacccctgagtgttgatagctttaaacaagaaggactggagctcaaggagcagttagaccgtcagctgaagcgcgtggcagaactttacaacgagttgaatactgatgtaaaaatcaacgtgtccgacgtcgaaaccatacaggatatcattatcgacaagaataaatctagaagggataaggccggcgctctgaaaaagctactcgccgtgtcgtcagaccggaaagagattaacaagctgaatgcgagccttgcaaaggaactgagtaacgccatcttgggtatgaaagctcaattcgccaatctcctgttagcagacgatctggagatagacaagaacaaaaagaatttttccctccttgatacaaacgctgaggaaaacgtttctgggctgttggagctagtgaatgaaaaacaggccgagctgttcgacgcgattaagaccatccacgatcagattatcctcaacgaaatcgtccctgacggaaagagcatttcccagtcaatggtggataaatatgaggcccatcgagagcaactgcaggtacttaaggcactgtacgagaaaatggacgctaagcagataaaagccatcaagaaggcttacagtttgtatattgatggcaaagacccaaaggccaaaaaggttgataaacgcgcacaccagaatagagccgacttctacaaggaagtgaagaaagtcctcgtggaactggacgatagcagggctgagaagttactgggcctaatcgaaatggggcaatttctccccaaacagcggactgcgatgaacggagtgatacctaatcagctgcaccaagtcgagcttgacaagattatcgagatgcagtctaaatattacccatggttggcagaaaagaaccccgttaaatcccatcagaagcgcgccccttataagctggatgagctcctgacattcagagtgccatactatgtaggtccgatggtgaccagtaaaaagcagcaacagacgagcaatagtaactttgcttggatggtcaggaaacaggaaggcgagatcactccctggaatttcgaggaaaaggtggacaccattgcctctgcaaacgattttatcaaacgtatgacagccaaggacacttaccttgttggggaggatgtgctgcctgctaattccttgctctaccagcggtataaggtcctgaacgaattaaataacattaaagtgaatggacgaagactgccagtagagctaaagagggaagcctacgttgcactcttcgagaacggcgacagcaaaaccgtgtcggcgaagtgctttaaaaactggctgaatgtcaagttgaagaaccttaattctctgaaactcgagggtctgtccacagggaccaagttcgataacaatttatcaacgtatcacgacctgaaaaagatatttggaaaagctgtggatgacgccggccgccaaaaggatttcgaacagatcattgagtggcttactatctttgaagacaagaaaatcttgcggattaagctcaaagagatagaatggctgacagaggagaacatcacccagctaactagactgaattacaacggctgggggaggctcagtcgccgactgcttacaggaatttgtgacagcaatggtcagcggatcatggattggttgtgggacaccacgaacaatttcatgcaaattcagtcccagcccgattttcagaaggcaatcgtcgaatataactctgacaaactggagcaaggcgatatagaacagatcttaggggaggcctacaccagccctcagaataagaaagctattcgtaaggtgatcaaggttgtgcaagacgtagaaaaagccatgggagcaaagccaacatcaattagtatcgagttcactagatccgatggcaggagcgagctcaccaactctcgcatgacacagctgcagaaaactcttatgtcactgagtgaagagatgaccgaccaggctttgctcgccgaatttaaggattttcaagcgagcaaaaagaagctgacaaataaatattacctatacttcacccagctgggtcgggacatgtatactggggagcccctcaacatagatcagctgtccctttactctgacggcgatcatattttgccgagatcgtttatcaaggacgacagcctggataacagggtcttaacgaaacgagccgtgaataacgagaagtccgacacagttcctgtgtgcgaatatggagctaaaatgaaggatttctggaatgacctctacgataacggcctgatttcaaagcagaaacttgcaaatctgctaaccgaccccgatgagatcgggccatataaggccaacggatttatacgccggcaactcgtcgaaacttcacaggtgatcaaactgtctgctgagattttgcagaccctgtaccaggacacaaagatcattgaagtaagacaaaaatatacccacgagttaagggagcacttcaattttgtgaagatccgtcagctcaacgattaccatcacgccttcgacgcatacctgactgcgtttagcggtcgctatctttaccagcggtatcctaagctgagaggctacttcgtttatggggattacaataaatttgacgccaagaaagacaggaactatttgaagtcctacaatttcctctacgatctggaagagggaaaaacagaccaaatagtcgataacgtggaacataaggtgtttatgaatcgacaggacgctattaaccagctaaagaaagcctatgagtacaagtatatgctggtctcacaggaaacgtacaccaatagcggcgcaatgttcaaagagactatctatcccgttaacccaaagcaaaaacttatccagaagaaaaacgataagcccgtggacatttacggtgggtattctaataactacgatgcttacctctccatcgtgcggctggaggacaagaaaggcattaagttccgcgtagtcggaatacctatgagaaataaagccgaattggataacctggcaaaggaggaccacaatggctatatgcagaggttaaacgaaatcgtggatgagcagattaatagtagcgggaaaaagaagacatttcggatcattctcccaaaagttcatttcaagcaactggtggaagacgattctggaaaatttatgcttggttccgccgcttacccgtataacgcgaagcagctggtcttgtcagtgaaaagtatcgagagcctcgccaataaggacgcatcggaccgagagctggttgctgtgtacgaagagatactaaacgtagtcaatgataagttcaccctgtatgacgccagacagtttcgcaacaaacttacatcctctaaggataaattcgtggaactcaatactgccgacaaggtgaccgagctgttggatatcttagacggcctgcacgctaaccccgtcgttaaaaagctcaagattatcagcgggtcaccttttggattcctgcagaggccaagtggcattgtgcttacggagaatgcaaaactgatctaccaatcccccaccggtatatttgaacgtgtagtgtatttgcgggatctatga

SEQ ID NO: 2936 - RNA, 3984 nt, synthetic construct
  misc_feature 1..3984: note = Cas9 variant
  source 1..3984: mol_type = other RNA
atggagggccagatgaagaacaatgggaacaatctgcaacagggaaactactatctcggtcttgacgtgggcaccagctccgtcgggtgggccgttacagatactgactacaatgtgctgaaattcagaggaaagtctatgtggggcgctaggttgtttgatgaagcatcaacggccgaggaacggcgcacccaccgaggtaaccgtagaaggttagcgcggcgcaaatatagactgctactcctggagcagcttttcgaaaaggagatcaggaaaattgacgataatttcttcgtacggctgcatgagagtaacttgtgggctgacgataagagcaagccctccaaatttctcctgttcaatgacacaaactttactgataaggactacctgaaaaagtatcctaccatataccacctccgctctgatttaatccataattcgacagaacacgacattcgactggtgttccttgccttgcatcacctgatcaaatatagagggcactttatttacgataactcagcaaatggagacgtcaagaccctagacgaggccgtgagcgatttcgaagagtacctcaacgagaatgacatcgaatttaacatagagaacaagaaagaatttatcaatgttctgagtgataagcatcttactaaaaaggagaaaaagatttccctgaaaaagttgtatggcgacatcacagattctgaaaacattaatatcagcgtgctcatagagatgctgtccggctcaagtattagcttatctaacctgtttaaggacatcgagttcgatgggaaacagaatctctcccttgactcagatattgaagagaccctgaacgacgtcgtggatatcttgggagacaatatcgacctactgattcacgctaaggaagtatacgatatagcagttctcacgagcagtctgggtaaacataagtatctttgcgacgccaaagtggagctgttcgaaaagaacaagaaagatttgatgatcctcaagaaatacattaagaaaaatcacccagaggactataagaagatcttttcttccccgactgagaaaaagaactacgctgcctatagccaaaccaattcgaaaaacgtctgttctcaggaagagttctgcctgtttataaagccctacattagggatatggtgaaatccgaaaatgaggacgaagtgcggatcgcgaaggaggtcgaggataagtcattcttaacaaaactgaagggcactaacaatagtgttgtgccttaccagatccacgaacgtgagctaaaccagattctcaaaaacatcgtagcatatctgccatttatgaatgacgaacaagaggatattagcgtggtcgacaagataaaacttatcttcaagtttaaaattccctactatgtggggcctttgaacaccaagtccacacgctcttgggtttacagaagcgatgagaagatctatccatggaatttctcaaacgtgatcgacctggataaaaccgcccatgaatttatgaataggctcattggacggtgtacgtacactaacgaccccgtcctgcctatggacagtcttctgtattccaagtacaatgtgttgaacgagataaatccaatcaaagtaaacggcaaggctattccggttgaagtgaaacaggccatctacacagatctcttcgagaatagcaagaagaaagtcacccgaaagtctatttatatctacctgctgaaaaacggttatatagaaaaggaggacatcgtgtcagggattgatatcgagattaaaagtaagttaaagagccaccatgactttactcagatcgtccaggaaaataaatgcacacccgaggaaatagagcgcattatcaagggcattctagtgtactccgatgacaaatctatgctcagaaggtggctgaagaacaatatcaaaggactttcggaaaacgatgttaagtatttggcaaagctgaactacaaagagtggggccggctcagcaagaccctgttaacggacatatataccatcaatcctgaggatggggaggcttgttccattctggacatcatgtggaacacaaatgccactcttatggaaattttgtcaaacgaaaaataccaattcaagcagaatatcgagaactacaaagcggaaaattatgatgagaagcagaacctccacgaggaactggacgatatgtacataagtccagccgcacgcagatctatttggcaagctctaaggatcgtggacgagatcgtagacattaaaaagagcgcccccaagaaaatctttattgaaatggctcgtgagaagaaatccgccatgaagaaaaagcggaccgagtcacgaaaggatacactgctcgaactgtataaaagctgcaagtctcaggcagacggattctacgatgaggaacttttcgagaaattgtccaatgaaagtaacagcagactgaggcgcgaccagttatatctctactatactcagatgggtcggtctatgtacaccggcaagagaatagattttgacaaactgatcaatgataagaacacatacgacattgatcatatctatcctaggtccaagattaaagacgattcaatcaccaatcgcgtccttgtggagaaggacataaacggggagaaaactgacatctacccaattagtgaagatatccgacaaaagatgcagcccttctggaaaattctgaaggagaagggattgatcaatgaagagaaatataagcggctcacgcgtaactacgaactgacagacgaggagctaagctcgtttgttgccagacagctggtggaaacccagcaatccactaaagctctcgcgaccctgcttaagaaagagtatccgtctgcaaagatagtctacagcaaggccggcaacgtgtcagagttcaggaatcgcaaagataaggaattgcctaaatttcgggaaattaacgacctgcaccacgctaaggatgcctatttaaatatcgtagtgggtaacgtttacgacacaaaattcaccgagaagtttttcaataacatcagaaatgagaactacagtctcaaaagggtctttgatttctccgtgcccggggcatgggacgccaagggctctacttttaatacaattaagaaatatatggctaagaacaatccaataatcgccttcgcaccttacgaagtgaaaggagagctgtttgatcagcagattgtccccaagggcaaagggcagttcccaatcaagcaaggaaaggacattgaaaaatatggtggctacaacaaacttagctccgcgttcctgtttgctgttgagtataaggggaagaaagcccgagagcgctcactagaaacggtgtacatcaaggatgtggagctctatctgcaggaccccataaagtactgtgaaagcgtattgggactgaaagagcctcagatcattaagccaaaaatcttaatgggcagtctcttctctattaataacaagaaactggtcgtgaccggtcggtccgggaagcagtacgtttgccatcacatctatcaacttagcataaatgatgaagactcgcagtacctgaagaacattgcaaaatatttgcaggaggagccggacggcaatatcgaaagacaaaacatcctcaacattacttcagtgaataacatcaagctgtttgatgtcctatgtacaaaattcaattctaacacctacgagataattctgaatagtcttaagaacgacgtgaatgaaggaagggagaaattttccgaactcgatatcctggagcagtgcaacattttgctgcagttactcaaggccttcaaatgtaatcgtgagagctctaacctggaaaaacttaataacaagaagcaggctggcgttatcgtgataccccatctgtttacaaagtgcagcgtattcaaagtcattcaccaatccatcactgggttgtttgagaaggaaatggacctcctgaaatga

SEQ ID NO: 2937 - RNA, 3984 nt, synthetic construct
  misc_feature 1..3984: note = Cas9 variant
  source 1..3984: mol_type = other RNA
atgaagaactacagcatcggcctggacattgggaccggatccgtgggttgggtctgcatagatgagaattatcagatcctcagatacaacaatagggccgctttcggcgttcacgaatttgagacagcacatgtggccgaggagcggcgcattaaacgaggggcgcgtagaaggtataaccggcgcaagaaaagaatccaacttctgcagtctttgttcgtaccccacatgcagcagaaggcgtttttcgcccctactattacggaacattactggaaaaatgacaaccaatttgagaataggaccttatcagaggtgctgatgagtctaggaatgaacccaaatacatatccgactatcttccacctccggcatgaactgatagagagctccgtcaagaaggatgcacgccttatctacctggccttgcacaacctcgtgaaatttcgaggccacttcctgcaggaaggttctacctggaatgctaacatgtcggacgcaaatctgtcagagcagtttgagcagctcttacatatttatacagaaatggaggaactgccccaagttagccttaccgcccagcagagtactgatgtggagcacatcttgctgaacaatcatatttccaaggctgaaagagccaggcagctaacagctctcttcgagcggacctacgagccatttttcaaactgatcgtcgggcttgacatagcagccgctcaactgtttaagcagtctgaacagcaattgctctacaaagagagcaagacgaaggtgaacctgactgccgaaaccttacctgaggtactgcagacaatgctcgaacccgaggttgcattcattgaggctgtgcagcctttctatcagcaaactgtcctttttgatctgttgaaaggacagtcctacgtggccgcggccaaggtggaagcattcaaccagtatgagcgtgacctagctctgctcaaatcagtcatcaatgaagttggcagtgagaagcagtaccgcgcctttttcattaccagcaaacaaaagaaaagacagtttgaacagaagccaaacatggagctgctttgtcacctggataggttcaatcgggagaagaaatatgaagagacattttacaaggaagtgtctaaattgctcaccgctctgatcaaggaggccacgggcgaggtaaaagaacacatcgagcagattatacaagcaatggaatcccagtcattcttagtgaagcagaaggggatccagaacgccagcattccctatcaaaatagtctgtacgaggctgaaatgatcctacgaaaccagcaggcgtactatccttggataactgacgagtttattgagaaagtcaagcaactcatcgcattccgcatcccatactatattggaccgctggtgcagggtgatgaacagccctttggctggcttcagagacaagccgacgggaatatcacaccttggaacttcgatgagaaagttaataaggctgcctctgcagaatcctttattaccaggatgactaaaaactgcacatacttgaaggaggaaaaggtgctgccaaaacagagcctcatgtatgagaagttcaccctgcttaatgagctgaactcggtccagatacggtcttccttggaacagccccataaaaagcaccgcctctgtgaggacatgaaacaatggatcattgaacatgtgttcaagaagacgaaaaccgtaacacacaagactctgatccaggccctgaaaaagtcaccttacaaagacgagttatatgatgaaagtaccggaaattggaaggacgtttacggcacacagaaagaggatagatttgctagctccctatctacttacatcagcctcaaggagattgtgggtgacatagtcgataacgccttcatggaagagatcatttattggctgaccgtgtttacagacagggatatcattacccttaagatgaatgacaaatacccattcatcactgaacagcaaatacagcgtttgctgtcactcaacatcagtgggtggggacagctgtcccaacggttactgcagagcattcccgtcgatgacatgaaccgatctgtgatcgagtatatggagaagcatgcagttaattttatggaacttttgtcaccgagacagagtgatctcgcgtacaaaattgaacaggtgaacaagcaacacagcaaaaagatccacaagataaggtatgaagacattgagcagctgacgggctcccctgctctaaaacgcggcatctggcggtctgtaaagattatcgaggaactgacagccatattcggggagcccaaaaatatcatgattgaagtcgcaagagaggaccaggcctcgcataggaccaagagccgcaaagaacagtgggagtccatcggaaagtcactcgctaaggaagagaaagagctgaaggcctttttcaaagaaatggcacaatacccaaagcagcagtttgatcgaactcggttctggctttatgtgacccagcaaggtaaatgcttgtacacaggcaagaccctgcgtttagaggacctcagttcttacgaaattgatcacatcctgcctagaaactttgttaaggacgatagcatagacaatcttgctctggtgtatcccatggccaaccaggagaaaaataaggcggggaacaataaaatgccattggaaattatcgatgccaagcagcagcccgctatgatggcacattggaaaaggctcaaccaactgaagctaatctccgactcaaaactgcacaagctcatgaagcctagcttcaatgatgtcgacaaagagaactttattgcccgccagctggtggagactcggcagatcattaagcacgtaagagatcttttgcaagaaaggttcgagcatacagacatacacgtggttaaagctaagatggtctctcagttccgaaaattttcccgcatcccaaagattcgggattacaataacaagcatcacgccatggacgcactgttcacgaccgtgttaatccagtttattctccagaaatatggaaagaatttcctgcaatttgaccttcagcataaagatatcagtaagaaatggagcaagatagcgcagtctactaagcacttctttctgttccagcaatttgccgaacagcagatcaaatccccggtgacaaaggagctagtctcaggcgttcagtacttcgagcacatcttttatgaacaaagttggcagaccacaaaaatgactcagaccattgacagcaacttctacaaggagacgattttctcgcccaaactcaagaccgctaagtatacatccgccaaagcagaaaagtttgtgcatgatgctatcgtgaaatacgccgtatgtggtatacaatacacttctctgaagaaaaacaaggagcagcaccatgtcttgctgaccgacattaatgtgatcgaacactatcagttaaaggaggcaagcctcaacgagctggcccttcatctggctaaaagagaatcaaaggatgacgttatcgatgcgcagatgttggtggtcattcctaaatacaagaaaataatgctcaatgggagtccatattactgcatctcctctgacgagaggcacattgccacacaattcgtgctgcgtaaggatctactggaagcagttcttcacgtgaacgacgagactagcgtagatgaactccgcaccctgtttcggtccatcgtcgaggagatgatgacgcagtataaagtgtacaataaggacacaattagaaacaagatcgatgctttcatagaaaccgagttgatcgacgtggaaacttttcaggtcggcttcacagagattaaaaagatggttgccgccaatgctcagaggtcagacaaatttggaggccgactgcggcaagtgatgaaggtagaagatatctatattatcgacgagagcataaccgggttacgctacagaaaacccaggaagctcgtgaagtga

SEQ ID NO: 2938 - RNA, 3984 nt, synthetic construct
  misc_feature 1..3984: note = Cas9 variant
  source 1..3984: mol_type = other RNA
atgaagaaaaactacaccatcggcctggacattgggacagccagcgtgggatgggctgtcctcactgaggattatgaacttataaagagaaaaatgaagatctccggtaatacgcagaaaaaggcagttaagaaaaacttctggggcgtgaggctgtttgagcaaggggaaaccgccgagggacggcgcttgaagcgaacaactcgtagaaggattgcgcggcgcagacagaggatccagtacttacggaccattttcgacgaaggcatgaatcaggtagatgctaactttttcgcccgcctggacgagtctttttcaatcatagatgagaaagaaaatgagcgacaccccatcttcggtaacgtggcagaagaggccgcttatcatgagcaatttcctacaatttaccacctaagagaacatctcgcaaatagtagcgagcaggccgacctgaggcttgtctatctggctttggcccacatcattaagttccgggggcattttctcatcgaaggagagctgaacaccgaaaattcctctgtgtcgggcactttcgagcagtttataaaagtttacaacgagacattcaatgtggaaaaggcgctggatctcaccgtcgacttagatggcattgcagagcagaagatctcacgtatgaaacgcgccgaactgattcttagcttgtttccagaggaaaagagtacgggggacttcgctcaattcatcaaaatgatcgtgggaaaccagggtaatgtaaagaaaactttttccctgaacgaggatgccaagattcagttctctaaagaggaatatgaggaaaatctagagaccctcctggcagaaataggcgaggactttagaagcgttttcgatgctgccaagtccgtgtacgacgcgatctcacttgccaacattctgaaggtcacagacgcaactaccagggctaaattgagtagctctatggtggtgcggtttacagatcacaaggaggacctcaaaaccctgaagcgattcgtccgcgaaaacttaccggatgagtacgacgatctgtttaaaaataagaaggttgccgggtatgctggatacatcgacggcaacgaaacgcaggaggccttctataaatacctcaagaaaactcttgcaaaggccacaggtgctgaggggtttctggcgaaaatggaacaagaggatttcttgagaaagcagaggacctttgacaatggagtgataccctatcagctacacctggaagaactcaaggcaattatcaaaaaccaaaagtcctactattcattcctggatgaagagaaaatcagccagcttatgacttttcggattccttactacgtaggcccactggccaaggagaaaggccagttcgcttggttgacacgcaaggaaatggggaagatcaccccctggaatctcaacgagaaagtggacattgaaaagagtgccacggatttcgtcgagagaatgaccaataacgactcttatctgcctatggaaaaagtgttaccaaagcattccctgctatacgagacatttactgtttataatgagctcaccaaagtgaggtacatagacgataacggacgtgcacagaatttcagctcgaaggaaaaacggcaaatcattaacgagctgtttaagcagcagcgaaaggtcaaaaaggaaatgcttgaggccttcttgaaaaatgaatatggtatcgagaaccccaaggtggagggcatcgaaaaatcttttaatgcttgcctggggacataccacgacctcattaagctgggaataagacctgagcttttcgaacagccagagcatgagcaacagtttgaacagatcgtaaagattctgactgttttcgaggataggaaaatgcgccggaagcagttggaaaaattttccaacatcctcaccgaggaggagcaaaagcagctggagagaaaacactataagggctggggtaggttatcagccaagctgattcacgggatcgtggaccagaaaacacagaagaccatactagattacctcatcgacgatgacgatctgccgaaaaaccgcaatcgaaacttcatgcaacttattaatgacgaaaacttgagttttaaggaggaaatcgagaaaattgcattcgataatgacaagagcactgaagagatcgtccaggagctggcgggctcccccgctataaagaaaggcattctccagtctctgaagatcgtggaagagattatcgatataatgggagaattacctacgaacatcgtcgtggagatggcccgggaaaatcaaacaaccgcacaggggaaccgtgccagcaaagctagaatgaagtacctggaggagtcaattaaaaagctgggaagttccatcttggaagacgagccaattagcaaagacgccaatctcctgaggaacgatcgcctatttctgtattacctccagaatggtcgggacatgtatactggcaacgaactggatatcaataacctttcttcatacgacatagatcatattgttccccagagtttcgtgaaggacgatagcatcgacaatagagtattgaccacatcctctatgaacagggggaagtcgaacaccgtccctgcagagagcgtggttaaaaagatgcgaccaacttgggagcgcctgttagcttccggactcatctcaaagaagaaattcagttatctgacaaaggccacgaatggcggtcttaccgaagaggataaggcgcactttattcaacggcagctggtggaaactagacagatcaccaaaaacgtcgcccagattttgcatcaaaagtacaataacgagcagctctctgaaaaacccgtgagggtaataacacttaagagcgctctagcatcccagttccgtaaagacttttcactgtataagatccgcgagctcaatgattaccaccatgcccaggacgcttacctgaacggggtgattgcccaagcacttttgaaggtttatccgaaactggagcctgagttcgtctacggcgaatatcagaaggtgagcatccgggcgttaaataaagccacagctaagaaagaattttactctaacattatgaatttctttacttccgatgagatggtggccaacgaagagaccggagaggtcctctggaatagacagagggacatcaagacgataaagaaagttatgaactatcaccaaatgaatatcgtgaagaaagtggaaattcagaccggcgcattcacaaaggagagtatcctgcccaaagggccaagcaagaaacttattgctcggaaaaacaattgggcccctgtaaactacggaggtgtcgactctcccactgtggcatattccgttatcataacccacgaaaagggcaaagccgctaaggtggtccagcagctggtggggattaaaatcctagagcgacaagcgtttgaacaggatgaggttgccttcctcgaggaaaagggatttatccatccaaaagtgcagctgaagttgcccaagtactcactgtaccagttcgcagacggccgcagaaggttactcgctagtgccgaggaaagccaaaaaggtaaccagatggtactgcctgtccaccttattgagctgttgtatcatgccaagcacgtgtcggattcctctgggaaaagcctcgagtacctgaatgaacaccggcatgagttcgctgaactactggaggcaatacttcagtttacagaacagtatatcgacgccggcaagaaccagaaaaaggtgcgagatctctacgagaagaatcaagacgcggatatgagagagctggcttcaagtttcattcagttgctgcagttaaacaaacaaggagccccagcagactttaagttctttggcgaaactatcccgcgcaggcgttataaaaataccgccgagattgtcgatgctacgttcatcaaccagtccataacagggctctacgaaacccagaagcggctggtttga

SEQ ID NO: 2939 - RNA, 3984 nt, synthetic construct
  misc_feature 1..3984: note = Cas9 variant
  source 1..3984: mol_type = other RNA
atgaccgagcagcaacagccctacaacatcggcctggacattgggacaagctccataggatgggccgtgactgatcagaatgacaagctccttcacatcagaggtcataacggcattggggtcaggctgttcaaagaaggagagtctgctgcagaacggcgcggctttcgaacgacccgtagaaggttgtcacggcgcagatggaggttacggttcctggatcgcatctttgacgccgagctagcgaaggttgatcctaatttcctcgctcgactgaaacagagtaacattagcccacttgacccgaataagcaaatgtttggtaacatcctgttcgatgacccccagtttgatgaccagaaattccaccagcaatatcctacaatataccatttgagatccgccctcgcacagccagatgctccccaggccgacgtgaggctgatctatctggcactccaccatatgattaagtttcgggggcacttcttaaatggagccgctgtagaaaagtttcacggcggccagctgcatcttgagtctgagttccaagaattgaaccagatcttttcgaatcagcaacgtgatcacgtgcagctgcagacttcaagcctagacgaggtcgccaccattctcaaagacaaccagcgcacacctagtgatagacaaagggaactgtccgcgcggcttttcgtgccagttgacaagaccatcgataaagagaataagaaactggcaactgagttgctcaaggccgtgctggggttaaaggctaaattcgacgtcatactgggagtggaagccacagatccccaggcatttaagctccagttctctagcgacgattttgacgataaaattgctgagcttgcctccgaactgaccgacgaggcgaacgaaatcttgacggtactacagcgactgtacttctcactcaatctggccgatattcttactaaccgccaaaccaagcaggttgcagacagtatcagcacagctatgatcaatagatatgacgatcataaacaccacctgaagatgttgaaagagctcgaggcccaggtgactcaggaacaaagggacggtctgaagaaggcttacaacgagtatattgatggcgacaaacctaccatagatacattttacaccaacgtcaagaaaaatttagacgattctgaactggccaaccagatcaagtccctaattgacctccaggcattcatgccaaaacagcggtcaaaggagaatgggagcatcccgcatcaactgcaccagcgcgaacttgatcagttgatagaggtgcaaggaaagtactatccctggctgctcgccgctaaagacaagctggatgcgcttattgcatttagagtgccttactatgtcggcccaatgatcgaccccaaccagagtgatgaccctcagaatacgaaattcgcctggatggttaggaaggaggctggtgaaatcactccatggaactttgaggaaaaagtggacaagacatcttccgccaccaatttcattaagcgtatgactacaaccgatacgtacctgttgggggagcccgtactcccgaaaaacagcctgttatatcagcaatttaccgtgctgaatgaactaaacaagctcaaagtcaatggaaaggcactgacagtggaccagaaaaagtacctttatgatcatgtttgcaagaaacagcggcgagtgactttgaagaaactgtcggactgtctcgtcgccagaggcgatttccctatgggcgctatctttaccgggacaactgaccagaagaacatgaataacaccctgaaaacataccaagatttccaggagattttcggagacgagatagataatcccgaccgccaggtggattttgaaaagatgatcgagtggtctaccattttcgaagacagggagatctttaaattaaagctggccgagcttaactggttgacttccgaacagctcgagcgggtatcaaagaaaagataccaaggttggggcaggctgagtcagaagctactgacgcacatcgttaacgaaaatggggagcgcattatagatcagctctggaacacaaatcaaaacttcatggaaatcatgggacaggacagcgtgaaacaggcaattcaggagcataatggcgcgaacgtcgctcaaaccggtatcaatgagactattgacgaactgtatacctccccacagaacaagaaagccatccgacagatacttttggtggtcgatgacatcaagaaggcagtggggtacgcccctgctaatattatgatggagtttgcccgggaagatcgtgacgatcacagactgatcgcatctagggctcgccagttagagaaaacatatcaagaaattagcaagaactggttcgacaatgagtcagttacccaggagctcaaagatcagatcaagaacaaaactaagtttacagaccggctgtacctttatttcatacagggcggaattgatctgtacacgggccaccccttgaatatcgaccaactcagttcctatgatattgaccatatcctgccacagagctttctactggacaactctctcaataacagagtgctgacctcacaggccgaaaacagggtacacaaggaggatcgacttcccggggaaactgtcgcgaataaaatgcgccctacatggaagatgatgcgggagcagggattgatgacccaaagaaaatacaacaatctgacattaaagccagaccagataagtaaattcaacaataggggtcagtttatcaaccgtcaactcgtggaaactcgccaggttattaagctggccgctgatatcatgagccagaagtaccaggcagaccaaaccaaagtggtcacggtgaaggccaatcttacccatcacatgcgggagaaattcaacttttataagtccagaaatgtaaacgattaccaccatgctttcgacgcctatctgacactattcgtgggcaattggctcctgaaagagtacccgaagttgcagccctattttgtttacggggatttcgcaaaaactggaaccaacaatctgaagtcttttaacttcttatataggtttgaacgagaccacaagctcaatgataaaggcgcgattgacacagataaggaccagcagctgggttacatgaaacggatctaccgcttcaagaaaatgcttgtcactaagcaactggagaccaacgaaggggccttgtatggccagacgctctaccctgctccaaagaacgataaaaagacaagaaatctgataaactcgaaaaagaataggcccagcgacatttatggaggctactccaacgagaatgggtcatttctaaccctggtgaaacttaagaagggaagtaaatatgactaccggctcgtggccgtccctgtttctaagatcagcgagatcaaagaatccgagctggcaactattgaaaaggctatcgccccacagttcttgaaatcaagcggtaagtatcgagattttcaggtggtgctgtctaagattttaataaaccaaaaagtaatcgacgatggcatgattttcacaatcgggtccaagagttacaaacataatgcaaagcaggtcgtgctcagcgacaactctattcagatcgtttccaccctgtcaagaataagtgataaagagaaacttatcactgtgtttgacgaaattgtcgatatcaccagcaagtacctgccctggtataaggtgaatgacgttgagaagacaaaaatgttgttccgccaaatgcaggatattgacgagatgaagaaaatcatagataactcgctcattggactgcactgcaatgcctccatcacggacctaggcaaggtgggtctgtctaaatactgggggaggttcgtacttaccgctggcatcagcctcactgtcgatgcgcagctgatttatcagtcaccgacaggattgtttgaacatcgtgtgaaggtgagtgacttatga

SEQ ID NO: 2940 - RNA, 3990 nt, synthetic construct
  misc_feature 1..3990: note = Cas9 variant
  source 1..3990: mol_type = other RNA
atgaacaagcagccctacaatatcggcctggacattgggaccagctccgtgggatggtctgccacagagctcgataacagacttctgcacataaaaggtcataatggcatcggggtcaggttgttcaaggaaggagagtcagctgcagaccggcgcggctttcgaactacgcgtagaaggttagcccggcgcaaatggagactgaggctactcaacgaaattttcgcgaccgagatcgctaaggttgatcctagctttttcgcccggctgaaacaaagtaatgtgtccccaaaggacccgaacaagacaatgtttggtaatattcttttcgatgacgaaaacctggatgaccagaaatttcaccatgattataagactatctaccacttgcgccaggcaataatcaatcatcccgagcagaaattcgacattcgactcatctatctggccatgcaccacattatcaagtacagagggcattttctgaaccaagctaatgtacaggatttcaaaggaggcaagatagacctcgagaagtcttttaaagcattaaacgatattttcgaaaatcagggcagggacctgcggcttgtgaccgacgaggccaaccagtatgtcaaggtgttgtcggataatgctaaaacacgttcagaccgcaagaaagaactgagcaagctactctacgttcctatcgataaagacaccgataagaacagtaagaaagtgactggggagattctgaaggccatccttggaaacaaagcgaagtttgacgtcatcttcggtattgaggtggaaaatccaaaagagtgggtactgacattcaactccgatgactttgatgacaagatagaaggcttgtctagccaaatgaccgatgaggactccgaaatcctcctgattttaaaggagctgtatttcgcactcaatctttcagacatcctgaacaatagtgttacggataaaaacgccaagactttgagcgaggctatgataaatagatacgacgatcacaaaaaccagctagccatgctgaagaaagtgattgactcttccgataagaagcatgcaaaagaactcaaggaggcttactcagcctatatcgacggggaaaataacaaaaagatcagctttgaggatctgaaaaagaggattcagaagaatcttgtcgacagtgaactgtctcagaaaatcaacgatttgctcgaccacgattacttcctgcccaagcaacggtccaaagagaatggagcgattcctcaccagttacagcaacaggagctggaccagataatcgaaagccagaagcaatattacccatttctagccgagctcaaccccaatgaaaaacgatcgcgccaggcaaagtataaactggatgagcttgtggctttcagagtgtcttactatgtcggccctatggttgaagtgaccgactccaaccaggagaacaatggtaagtttgcctggatgattaggaaggagcagggggaaatcacaccatggaacttcgacgagaaagtagatcggactgaaaccgctacaaagtttatcacccgcatgacgactacagacacctacttgattggagagccggtgctgcccaaaaattcactcctgtaccaaaagttcgtcgtgcttaacgagctgaataacttgaaaataaatcaggaaactatcacacctggccagaagcagtatctctacgagcatgttatgaagaaaaacaagagagtgaccctgaaaaagattgccgatgcattagtcatcaaaggcgactatccatacgcccccgaagtgaaggggacgaccgatcaaaagaatctgaacaatggactaacaacttatattgacctcgctaaaatctttggtaacgagctggatgacgtagatagggaagcggacttcgagaagataatcgagtggagtaccatttttgaagatcagcacatcttcgttcttaaattgcaggagctgaagtggctcacagaaaaacagcgtaatcaagtggtcaagctgcggtaccagggctgggggaagttaagcaaagagctgcttgcaggattggtggacgataacggccagcgaattatcgacctcctgtggtccgacaatcaaaacttcatgcagatagtcaaccagaagtcttttaaagaaagcattgccgatcataatggtgctcacctagaggagaagaacctgaaagacgtgatcaatgatctctatacttcacctcagaacaagaaagccattagacaagttatcctggtggtagacgatataatcaatgcagtcgggtacgaaccagccaacattatgatggagttcgctagggaagacagtaatgatcatcgccttaccaactcccggagcagacagttggagaatgtgtacaaggacatcacaaactcttggtttgataatgactcagttaaggatgaactggaggacaaaattaagaacaaagacaagttcaccgataggttatatctctactttactcagggcggaaaagacctgtatacgggcgagccccttaatatcgatgacctgagtagctacgatatagaccacattttgccgcagtccttcatcctcgataactctctggacaatcgcgtgctaacatcgcaacgaaacaaccgggtcagcaaggaagatcagctgcctggggagctctttggaaccaagatgcacgccttctggaaacgtctgaaggcagcgcatcttatctccaataaaaagtattacaacttgactctgacccccaattcaattagtaaatttaacaatcagggtagattcatcaacaggcagttagtggaaacacgccaagtaattaagctcgctgccgagatactgcacaatcggtattctgaggaaaagggcaccaacatcgtgactattaaagcaaatcttacacatcacatgagagagaagtttaacttctacaaaaataggaacgttaatgactaccaccatgcctttgatgcttatctgacggccttcgtcgggaactggctactccagcagtacccaaagctgaaaccttatttcgtgtacggagactttgcaaagaccgaaatcaataacctaaagagcttcaatatgctgtataaatttgagcaagctcaccagttaaacgaaaaggatggcaaaattgccaaggacactgacgcgctcctgggttacatgaaaaacgtgtatcatttcaagaagatgcttgtcacaaaagagctggagaccaatcacggggccttgtttaaccagacactctacccctccccagctcatgatatcaagaaacgacagctgataaagcccaaagacaatcgccctactgatatctacggcggatatacccacgaggaacggaagtacatgtcattggttaaagtgattggcaagaaggacaacgaatatagaatggcaaatgtgccactgcttaaaatcaacaagaataacgatattaaagagatcctcaagagccaattctctaataaaaagtttgaaatagtactgccgaaggtcttgaaaaaccagctgttctccgagaatggggccttatttgtgattggaagtaagggttacaaatataacgctaatcagctcgttctgagcgaccttgatatgaagctgttgaacgacctctctaataacaaatccatcgatgaggtgacgatcaaccagctgttcaagaatattgtcgactcaaccaacaagtacatgcccctatatgaaatcaaaaatctgaacgaggtggttgaaaagtttaataaccttgagttcaatgataaaaagaaaacaataactgacttcctcctggccacccacgcaaaccctacaatgagtaatttgaagaacattggcttaccatactttgggaggttcatccgtaatactggaattaagctgagcgaaaacgcgaatgtgatctaccaatcgcccaccggcctcttttcccgcaaaataaagatctctgatttctga

SEQ ID NO: 2941 - RNA, 3993 nt, synthetic construct
  misc_feature 1..3993: note = Cas9 variant
  source 1..3993: mol_type = other RNA
atgaagaacgactacaccatcggcctggatattgggacaaatagcgtgggatattccgtcgttactgacgattacaaagtgatatctaagaaaatgaacgtattcggtaatacggagaagaaatcaatcaagaagaacttttggggcgtgagactcttcgaaagtgggcagaccgcccaagaggctaggatgaaacggacaagccgccgacgtattgcaagaaggaagaatcggatctgctatcttcaggaaatttttcagcccgagatgaaccacctggacaataacttcttttaccgcttgaatgaatccttcttagtcgccgatgacgcgaaatatgataagcatcctatctttggaactctggacgaggagatacacttccatgaacagtttccaaccatctaccacctaagaaaatatctcgctgatggcgacgagaaggccgatctgaggcttgtgtacctggcaattgcccatatcattaagttccggggtaactttttgatcgaaggggagctcaatacagagaacaattctgttatagaactgtcgaaagtgttcgtccaactgtacaaccagaccctctcagagttagaaggatttcagttcattgacgagagcatcgatttcagtgaagtgctgactcagcaactttccaagtctgagcgcgctgacaatgtattgaaactgtttccggacgagaagggcacaggcattttcgcacagtttatcaaactaatcgttgggaaccagggaaacttcaagaaagtgtttcagctcgaagaggatcaaaagctgcagcttagcaccgacgattatgaagagaatattgaaaacctgttggccataatcggtgacgagtacggcgatattttcgtcgctgcccagaatctctatcaagcgatcctgttagcagggatactgacgtccactgagaagacccgagccaaactctcagctagtatgattcagagatacgaagaacacgccaaggaccttaaactgttgaagaggtttgtgaaagaacacatccccgataagtatgcagagatcttcaacgacgctacaaagaatggatacgccggctatattgatggtaaaactaaggaagaggagttttacaaatacctaaagaccacactggtgcagaaaagcgggtatcagtacttcatcgaaaagattgagcaagaaaactttctccggaagcagcgtatatatgacaatggagtcatccctcatcaggttcacgcggaggagctgcgcgccattcttagaaaacaggaaaagtactattctttcctgaaagagaaccatgaaaagatcgagcaaatctttaaagtgaggattccatactatgtaggccccttggcaaagcacaatgaacagtcccggttcgcttggaacatacgaaagtcagatgagcctatccgcccatggaatatgaacgacgtggtcgacgagaatgccagcgctgtggccttcattgaaagaatgaccatcaaagatatttacctcaacgagaatgttctgcccaggcacagtttaatctacgaaaagtttacggtgttcaacgagctgactaaagtcctatatgcagacgatcggggcgtgtttcagcgcttctctgccgaagagaaggaggacatatttgaaaaactcttcaagtccgagagaaaagtaacaaagaagaaactggaaaactaccttaggatcgagttgagcatttcgtctccttccgttaaggggatcgaggagcagtttaatgctaacttcggaacctatctggatctcaaaaagtttgacgagctgcatccataccttgatgacgaaaaatatcaagatactctggaggaagtgattaaggtcttgacagtgttcgaggaccgttcaatgatccagaatcagctcgagcagctgccgttaaacctgagtaccaagacgataaaagcgctaagccggcgaaagtacaccggttggggcagactctccgcaaggctgattgatgggatccacgacaaaaattctggaaagacaattcttgattatttgatcgaagacgagagcgactcatacatagtcaaccgcaattttatgcaactgatcaacgatgaccatctcagtttcaaaaagattatcgaagattcccagccctacaaggagcagcaaagcgccgaagagattgtgtctgagctgtcaggcagtcctgctatcaaaaagggtatattacagagcctgaaaattgttgacgaacttgtggccatcatggggtataagcccaaaaatatcgtagtcgagatggcacgggaaaaccagactaccggcagaggaaagcaaaattccaagccaaggttgaaaggcattgagaacgggctcaaggaattttctgattcggtgctgaaaggaagctccatcgacaataagcagctacagaacgatcgcctgtacctctattacctgcagaatggtaaagacatgtatacaggccacgagcttgatattgaccatttgtcaacttacgatatagaccacatcattcctcagagtttcctgaccgataactctatcgacaaccgagttttaacaaccagcaagtccaatcgggggaaatcagacaacgtgccaagcgaggaagtcgtgcgtaagatggatagattctggaggaagctcctgaatgccaaacttatttctgagcgcaagtatactaacctgacgaaaaaggaattgacagagtccgacaaagctggatttctcaagcggcaactggtagaaaccagacagatcactaagcacgtggccaccatactagatagtaaattcaatgaggacagcaacaatagggatgttcagatcattacactgaagtctgcactcgtctccgagtttcgaaaaaccttcaacctgtacaaggtgcgcgaaatcaatgaccttcatcacgcgcatgatgcttacttgaacgccgtggtcgcactgtcattactccgggtttatccccagctgaaaccggagtttgtgtacggcgaatatggtaagaatagtattcacgaccaaaacaaggccactatcaaaaagcagttctacagcaatataacaagatattttgcttcgaaagattacattatcaacgacgatggggagatcctttggaataagcaggagacgattgcccaagtgataaaaaccctgggcatgcaccaggtaaacgtcgtgaagaaggttgaaatccagaaaggaggcttctccaaggagtctattcagcctaaaggggaaagccaaaagctaatcaggcgtaaacagcagtggaacactaagaagtatggaggttttgactcacccgtggtcgcatacgctattctcctgagtttcgacaaaggcaagcgcaaagcccggtcctttaagatcgtggggataacaatccaggatagagagtctttcgaaggaaatccaattttgtacctgagcaaaaaggactatcataaccctaaagttgaggcgatcttacccaagtactccctcttcgagtttgaaaatggcaggcgacggatggtggcctcagctagcgagacccaaaagggtaaccagctgattatcccagggcaccttatggaactgttgtatcatagtaaaaagataattaatggcaaaaactctgattccgtaagctacatccagaataacaaggagaaattccgcgaaatctttgagtatattgtcgacttctcgtcaaagtacatctctgcagatgccaatctcaacaagatagagaaaatttttgaaaataacttccacaaggctagtgagcaggaaatcgccaaatcctttattaatctgctaacattcactgcaatgggagcgcccgccgactttgagttctttggcgaaaagatccctagaaaaaggtatgtgagcatatctgagattatcgatgctgtgttcatccatcaaagcattaccgggctgtacgagacgcgggtccgacttaccgaagtttga

SEQ ID NO: 2942 - RNA, 3993 nt, synthetic construct
  misc_feature 1..3993: note = Cas9 variant
  source 1..3993: mol_type = other RNA
atggagaaggaatacaccatcggcctggacattgggacaaacagcgtgggatgggccgtcctcactgatgactatagacttgttgctaggaaaatgtccatacagggtgattctaatcggaagaaaatcaagaaaaacttctggggcgcacgcctgtttgaggaagggaagacggcccaattccgacgtattaagagaaccaataggcggcgcatcgcgagaaggcggcagcgcgtgttggctttacaggacatttttgccgaggaaatccacaaaaaggatcccaacttctttgcacgactggaggagggagacagagtagaagccgataaaaggttcgctaagtttcctgtgttcgcaacactatcagaggaaaagaattaccatcggcagtatccaactatataccacctccgtcatgacctggccaacagtaaggagcaagctgatatccgccttgtctatctggccattgcgcactgcttgaagtacagaggccattttctcttcgagggtgaactggacaccgagaatacaagcgtgaccgaaaactatcagcagtttctgcaggcataccaacagttctttccggagcccatcggggatctcgacgatgccgttcctattttaactgaaaggctgtccaaagctaagcgggtggagaaagtccttgcctactatccatctgagaagtcgacaggaaatttcgcacagttcttgaaactgatggtgggcaaccaggctaattttaagaaaaccttcgacctagaagaggaaatgaagctcaactttacgcgagactgttacgaggaagatctgaatgagcttctggagaagacttcagacgattatgccgaattgttcctcaaagcgaagggcgtatacgacgccatcctgttaagccaaatactgagtaaatccgatgacgagaccaaggcaaaactctctgctaacatgaaacttcgctttgaggaacaccagagagatctgaagcagttgaaagagctagttaggcgggacctgcccaagaaatatgatgacttctttaagaatcgcagcaaaaacgggtacgccggatatgtgaagggtaaggctacacaagaagatttctacaaatttctcagaactgagctggccggccttgaagagtcccagtcaattatggaaaagatcgacctggagatttacttgctcaaacagaggaccttcgcaaacggggtcatccctcaccagatccatctggtggagatgcgtgaaattatggaccggcaaaagcgattttatccattcttaaaaggagcccagggcaagatagagaagctgctaacatttagaatcccctactatgtgggtcctctcgctcaggaagggcagagtccattcgcgtggattaaacgcaagagcccgtctcaaatcaccccctggaatttcgcagaggtcgttgataaagaaaactccgccatagagtttattgagaggatgacgaatcaggacacttacctgcctaaggaaaaagtgcttccaaagcagtcattgatctatcagcggttcatgatctttaacgagctgacaaaagtaagctacaccgatgaaagaggaaagagtcactatttctcttccgagcaaaagaggaaaatttttaatgaactcttcaagcagcatccccgcgtgactgagaaacagctgcgaaagtttcttgagctgaacgaacagatcgacagcacagagattaaaggcatagaaacctcgttcaatgcttcttactccacgtaccacgatttgctcaagctgtcagaccaaatggataccttactggacgatcctgacatgacaactatgtttgaggaaatcattaagatcctaaccatcttcgaggatcgggagatgattcgtgaacagctcaaaccatatgagacagtcctgggccttcccgccataaagaaattggcaaagaaacactacactgggtggggaagactgagtgaaaagatgatccagggtatgagggagaagcaaagccgcaaaaccattctcgactatctgatcgatgacgacgattttccgtgcaaccggaatagaaacttcatgcagttaattaatgacgatcatctgtcctttaaggagacaatcgccaacgaacttataatgtctgacagcaatgtgttgctcgatcaggttaaagctatccctggctcacccgccgtgaagaaagggatttggcagagtatcaagattgtcgaggaaatcataggaattatcggcaaggcacccaaaaacattgtgatcgagatggcgagggaaaatcaacgaacctcccgcagccggcctagactgaaggctctagaggaggccctgaaaaacatagactctcccctcctgaaggattacccaactgacaaccaggcacttcagaaagataggttgtatctgtactatttacagaatggtaaggacatgtacacgggggaacccctcgagatccaccgtctgtcagaatacgatattgaccatatcattcctcgcagtttcatcgtagataacagccttgacaataaagttctggtgtcctctaaggtcaaccggggcaagttggacaatgccccagatccgctcgtggtcaaaagaatgaggtcgcactgggagaagctgcatcaagctaaactaataagcgacaagaaactggccaacctcacaaagcagaatctgaccgaagcagataaggctcgattcattcagcggcagcttgtggagactcgccaaatcaccaaacacgttgccaacttgctgcaccagcattttaatttacccgaggaagtgtccgcgacagagaagacctcaatcattactctcaaaagtacactgacgtctcagttcagacaaatgtttgacatctataaggtaagggaaattaaccaccatcaccacgcccatgatgcttaccttaatggagtcgtggcaatgaccctgctcaaaaagtatcctaagctagccccagagttcgtttacggcagctatataaaaggggacatcaaccagattaataaggctactgccaaaaaggaattttactccaacatcatgaaattctttgagtcagaggaaattatctgtgatgagcagggagaagtgatatggaataagaagcgggacctgagcacaatcaaaaagaccattggtgcacaccaggtcaacatcgtgaaaaaggtagagaaacaaaagggcgggttctataaggagacaattaactctaaagcgaatcccgaaaagttgatccctcgaaaagcctccctggatccattaaagtacggaggctacggtagtcccctcgtggcttatactgttatatttattttcgagaaagggaagcagaaaaaggtcaccaagggcatcgaaggaatcacggtgatggagcagctgagatttgaacaggacccgcgcgagttccttaaaaccaagggctacgagggggtgaaacaatggctgattttgcctaagtatatactcttcgaagcccagggaggttacaggcgtatgatcgcaagccatcaggagacacagaaagctaactctctgattctaccagaaaatctggtcactcttctctatcacgcccggcattacgatgagatcaaccacaaggtttcctttgactatgtgaatgcacacaaggaaggcttcaacgacatttttgatttcatctcagactttggggtgagatacatactggccccacaacatttggagaaaatcaaggtagcttacgagaaaaataaggaagtcgatctgaaagagatgattgacgcgatcttaagtctcctgaagttcaccctttttggagccagcgtggagttcaagtttttcgatattaaaatcctgaagaggtataaatcgttgacagacatatgggaagcaactattatctaccagtccgttaccggcctctatgaacgccgagtggaggtcagaaagctgtgggatggtgagcggctatga

SEQ ID NO: 2943 - RNA, 3996 nt, synthetic construct
  misc_feature 1..3996: note = Cas9 variant
  source 1..3996: mol_type = other RNA
atgaacaagcagccctacaatatcggcctggacattgggaccagctccgtgggatggtctgccacagagctcgataacagacttctgcacataaaaggtcataatggcatcggggtcaggttgttcaaggaaggagagtcagctgcagaccggcgcggctttcgaactacgcgtagaaggttagcccggcgcaaatggagactgaggctactcaacgaaattttcgcgaccgagatcgctaaggttgatcctagtttcttcgcccggctgaaacaaagcaatgtgtccccaaaggacccgaacaagacaatgtttgaaaatattcttttcgatgacgagaacctggatgaccagaaatttcaccatgattataagactatctaccacttgcgccaggcaataatcaatcatcccgagcagaaattcgacattcgactcatctatctggccatgcaccacattatcaagtacagaggtcattttctgaaccaagctaatgtacaggatttcaaagggggaaagatagacctcgaaaagtcttttaaagcattaaacgatattttcgagaatcagggcagggacctgcggcttgtgaccgacaaggccaaccagtatgtcaaagtgttgtcggataatgctaagacacgttcagaccgcaaaaaggaactgagcaaactactctacgttcctatcgataaggacaccgataagaacagtaaaaaggtgactggcgagattctgaaagccatccttgggaacaaggcgaaatttgacgtcatcttcggaattgaggtggaaaatccaaaggagtgggtactgacattcaactccgatgactttgatgacaagatagaaggtttgtctagccaaatgaccgatgaggactccgaaatcctcctgattttaaaagagctgtatttcgcactcaatctttcagacatcctgaacaatagtgttacggataagaacgccaaaactttgagcgaggctatgataaatagatacgacgatcacaagaaccagctagccatgctgaaaaaggtgattgactcttccgataagaaacatgcaaaggaactcaaagaggcttactcagcctatatcgacggcgaaaataacaagaaaatcagctttgaggatctgaagaagaggattcagaaaaatcttgtcgacagtgaactgtctcagaagatcaacgatttgctcgaccacgattacttcctgcccaaacaacggtccaaggagaatggggcgattcctcaccagttacagcaacaggagctggaccagataatcgaaagccagaaacaatattacccatttctagccgagctcaaccccaatgaaaagcgatcgcgccaggcaaaatataagctggatgagcttgtggctttcagagtgccttactatgtcggaccaatggttgaagtgaccgactctaaccaggagaacaatggcaagtttgcctggatgattaggaaagagcagggtgaaatcacaccgtggaacttcgacgagaaggtagatcggactgaaaccgctacaaaatttatcacccgcatgacgactacagacacctacttgattggggagcccgtgctgcctaaaaattccctcctgtaccaaaaattcgtcgtgcttaacgagctgaataacttgaagataaatcaggaaatcattactccaggacagaagcagtatctctacgagcatgttatgaaaaagaacaaaagagtgacactgaagaaaatcgccgatgcattagtcattaagggcgactatccctacgcccctgaagtgaagggcaccacggatcagaaaaatctgaacaatgggctaaccacatatatcgacctcgctaagatatttggaaacgagctggatgacgtagatagggaagcggacttcgagaaaatcattgagtggtcaactatctttgaagatcagcacattttcgcacttaagttgcaggagctgaaatggctcaccgaaaagcagcgtaatcaagttgtgaagctgcggtaccagggttggggcaaattaagtaaggagctgcttgccgggttggtcgacgataacggacagcgaatcatagacctcctgtggagcgacaatcaaaacttcatgcagattgtgaaccagaaatcctttaaggaatctatcgctgatcataatggcgcccacctagaggagaaaaacctgaaggacgtcattaatgatctctatacaagcccacagaacaaaaaggcaatcagacaagtgatactggttgtggacgatatcattaatgccgtaggttacgaacccgctaacatcatgatggagttcgccagggaagactcaaatgatcatcgccttactaacagtcggtccagacagttggagaatgtctacaaggacattaccaacagctggtttgataatgactctgtgaaagatgaactggaggacaagatcaaaaacaaggacaaattcacagataggttatatctctactttacccaagggggcaaggacctgtatactggagagccgcttaatatagatgacctgtcaagttacgatattgaccacatcttgcctcagagcttcatcctcgataactccctggacaatcgcgttctaacgtctcaacgaaacaaccgggtgtcgaaggaagatcagctgcccggcgagctctttgggacaaaaatgcacgcattctggaagcgtctgaaagcggctcatcttattagcaataagaaatattacaacttgaccctgactccaaattccatctcaaagtttaacaatcagggaagattcattaacaggcagttagtcgaaacccgccaagtgataaagctcgccgcagagatcctgcacaatcggtatagtgaggaaaaaggtacaaacattgtaaccatcaaggccaatcttactcatcacatgagagagaaatttaacttctacaagaataggaacgtgaatgactaccaccatgcttttgatgcctatctgacagcattcgttggcaactggctactccagcagtaccctaaactgaagccctatttcgtctacggggactttgctaagacggaaattaataacttgaaatctttcaatatgctgtataagtttgagcaagcccaccagttaaacgaaaaagatggaaagatcgcgaaagacgccgacgctctcctgggctacatgaagaacgtgtatcatttcaagaaaatgcttgtgaccaagaaactggagactaatcacggtgcattgtttaagcagacactctacccaagccccgcccatgatataaagaagcgacagctgatcaaacctaaggacaaccgcccaaccgatatttacgggggctatacacacgaggaacggaagtacatgtccctagtcaaagttatcggaaagaaagacaatgagtatagaatggctaacgtgccgctgcttaagattaataaaaacaatgatatcaaggaaatactcaagtcacaattcagcaacaaaaagtttgagattgtgctgcccaaagtattgaagaatcagctgttctctgaaaacggcgccttatttgtcatcgggtccaaaggatacaagtataatgcaaaccagctcgtgctgagtgaccttgatatgaagctgttgaatgacctcagcaacaataaatctatcgatgaggttactattaaccagctgttcaagaacatagtggactccaccaataaatacatgcctctatatgagatcaagaacctgaatgaagtcgtggagaaatttaacaatcttgaatttaacgataagaagaaaacgattaccgacttcctcctggcgacacacgccaatccaactatgtcaaacttgaagaatatcggtttacccagttactttggcaggttcaccagcgggaacgctggaattaaactgtcggagaatgccaacgttatctaccaatcccctacaggcctcttttctcgtaaggtgaaaataagcgatttctga

SEQ ID NO: 2944 - RNA, 3999 nt, synthetic construct
  misc_feature 1..3999: note = Cas9 variant
  source 1..3999: mol_type = other RNA
atgaagaacagagagaatatcaaatactatattggcgtggacatagggaccaacagcgtcggatgggccgttatcgatgaaaatggtaacctgctcaagaaaggcaagcaccatctttgggggtccaggctgttcgaccaggctcaaacagcacagaatcggcgcaactaccgatcttcacgtagaaggtataataaacggcgccagagaattggattgttaaggctgatcatgagtgatatggtgctagaggtagaccccagctttttcattcggctcgaaaagactacgtttctggataaggaggacaaaaaggccatccttaaagataactacaagatgaattataacctgttctgcgacgaagattacaatgacaaaaagtattttaaggattaccctaccatataccacttgcgcaaaaagctctgtgagtccgacgagaaagcggatccacgactgatctatctggctctccatcacattgtgaagtacagaggcaacttcttatatgaaggtcaggagctgcatcttgaaccgtctaataaagaggaggacttgaagatcctgtttgacattctagggaaaaacaatgatacagtctacgacatctcggaagaacaaatacagttcattctcaagactgtggttgaaaacatctcaaagaccgccaaagtggatgagtgcatgagccagctgaaacttaacagtgaagacaaaaagattgtcaaagagtttatgaggggactggtgggcaataagttcaacgtatccaagttgtatatgcacgaggatctccagtttgacgatgaagacctgaaattacaattctctgataagagctacgaggaaaagatcacagagtatgaaaatgttctggaggagaagatggaatttatcgacctcatgcagcggttctactcctggattgagctttcaaaaatagtgggcagtgatagccagcacgcatctatctccggggccatggtcaacatttacgaatcacatcgtgaggacctgcgcaccttgaaggaagtgatgctaaagatcggtaaaaaggagtatgacgagatgttcaaacccactagcaagaatgtggtcaactactataattacgttaaccctgtggcttgtagtggagataaaacagacggcttttataagtacgtaaagaaagcaatagaaaagtctgatgactccagaaaagatgagattctgcagaagatcgccaatgaaacctatatgctcaaacaaacgagcaagaacaatgcttacatcccataccagatgcagaaagacgagctgattaagatccttgatcaccaagagaagtattaccccgtgctgaaagaaaacagggacaagattatatcgatcttggagttccggattccttattactatgggccactcgatggaaataaacagtttggctggctgatcaagaaaaagggtaaggaaaacgagcgaatcttaccctggaatcatcaggaaattgtcgacgtgcaggagactgccgcgcaattcatcaaaaagctgaccaactactgcacatatctacctatagagaaagttatgccacagaagtctctcacttgttccatgtacgaagtgctgtcagaggtcaacaaaattcgcatcgatgggaaacttttgccgattgacaccaagaatagactgatcgaagatctctttttcaaaaggaagacagtgaaagagaaggacctgataaactggcttaaacagaatcagctgaccgtaggagaaatcacgggctaccaaaaggagaaggcatttagtagctccttggccccctggattgacttcaaagagatctttgatgaaattaacgactctaattatgatctcatcgagaagataattgaagacatgactatcttcaacgagggcagcattctgaaagaacggttaaagaaggcttacaatctggatcagaacaaggttaaaaagatcatgaagctaaaatattcagggtggagtcgcctctccaagaaactgataaatggaatcagagccgacaacaagtttggtagctctgtgtcaattcttgatgtcatgaaagagagtcacatggcattgatggagatcattaatgaccaggatctgggcttcaagcagatcatagaaaaggagaactttaaaaatgaaacagggagcttcgagtacgaggacattgaaaacctcgctggatcccctgccctgaagaggggcatctggcaaaccttacaggtgatcgaggaaattaaaaattatatgggtcacgagccaaagaacatctacattgagttcgcgcgtgaggagcaggaaaaagtccggactacaacccgagtgaagaagctgaaatctatatataacgatatcaagaatcagcttgacgttcatgggaaagaggtgtactcgaacttgaataagcaagatgagaaaagctccattgaaaagagactctacctgtattacacgcagctaggcaagtgcatgtattcaggagaaagtctggacatcgacaaactctctaactacgagattgatcacatctttcccaggaccctgacaagcgacgattcccttgacaatttggtactggtcaagaaaaaggagaaccagcgcaaattagatgacctcgtgctgcctcttgaaatacggaataagatggaggttttctggaagaaactgtatgataacggcttgatcactcaaaccaagtactatagactcatgagggacgaatttcgccgagatcagattgacaaattcatcaatcggcagctggtggagacacgtcagattatcaagcatgtcgccaacataattgaaaatcactacgaggatactaaagtgtttaccgtaagagcaaacctatcacatgagttcagggaaaagtacgggatctataaaaatcgcaacgtgaatgactttcaccacgctcatgacgcctacatcgcttgtattataggacggtatatccaaattagattcccaggtctggaggccaagtacgtttatggccagtacatgcagaacgtcaagaaaacaaagaacaatatcgataaagaaaaccacgggtttattatcaatagcatgaagtatgagtgcatagacgaggataccggagaagtgatctggaaccccgagaggattctcgactacatcaaatgtttcaattaccgagatgtgtatattactaagaagctggacacgaacaatcgcgaactttttaacgtcacaatcttgccgaatgataaaaactctgagaagggcaaaaccaaggcaactatacctgttaataaactgcggtccaacgtgagaaagtacggtgggttcagtggcttacagagcgacattgtggccatcgaaggaaagaaaggcaagaaaatcgataggcgtctcattaatctgcccatccttctgcgctatgtatctatagaggaccaatgcaagtacattatggagaacaataaatattccgatgtcaagatcattaagaaaatcaagaaaaaccagctaatagaaattgacgggatctgttactatctcaagtcagctgatgagctggacaccgcgtaccagttgatcctgagtcgggacgataatgaaatgatttacagaatcgacagggcaattcagaacaacgattttagctatttcgacaataaaaaggagaacatagatgaattataccgactcatctgccataaaatgattgagaattatccaaagtacaagaaaaaggtgtatgagttcatcaaagaacgggaggaagagtttttcgaactggacaactcgcaaaagtgcatcgttatttttgagatgatacgcgtgatgaaaagaggagagcagtacatcaatattcctttcgaaccctataaccttaagaatgataggaagggtcggctgaactgtcagtccatcttgctcgacaatacatacttttacgatgtctctattaccggcatctatagcaaaaagtacaaactgtga

SEQ ID NO: 2945 - RNA, 3999 nt, synthetic construct
  misc_feature 1..3999: note = Cas9 variant
  source 1..3999: mol_type = other RNA
atgcagaagaactacaccatcggcctggacattgggacaaatagcgtgggatgggccgtcatgaaagatgactatactctcataagaaagaggatgaaagttcttggtaacacggatatcaagaaaattaagaagaatttctggggcgtgcggctgtttgacgagggggaaaccgctaaagagacacgcttgaagcgaggaactcgtagaaggtaccaacggcgcagaaacaggttaatctatctgcaggatattttccagcagcccatgctagcaatcgacgaaaatttcttccaccggctcgatgactcctttttcgtacctgatgacaaatcttacgatcgccatccaatatttggctcactggaggaagaggtggcctatcacaacacctacccgacaatctatcatcttcgaaagcacctggcggacaatcccgagaaagctgatttgagactcgtctacaccgccctggcacatattgtgaagtacaggggtcacttcctgatcgaaggggagctcaacactgaaaatacaagtattagcgagacctttgagcaattcttagacacgtattccgacatctttaaggaacagctggttggagatatatctaaagtggaggaaattctttcgtcaaagcagagccggagtcgtaaacacgagcagatcatggccttgttccctaacgaaaataagctgggcaactttggccgcttcatgatgctaattgtcgggaatacttccaacttcaaaccagtgtttgacctcgatgacgagtacaagctgaaactttctgatgagacctatgaagaggacctggatacattgctcggaatgactgacgatgtattcctggacgtttttatggctgcaaagaatgtgtacgatgccgtcgaaatgagcgctatcatctccaccgacacaggtaactcaaaggccgtgttaagtaaccaaatgattaatttctatgacgagcataaagtggatctggcgcagctcaagcagtttttcaaaacccaccttcccgacaagtactatgaatgctttagcgatccttctaaaaacggctacgcagggtacatagacggaaagacgaatcaggaggatttctataagtacatcgagaaagtcatgaagactattaaatccgacaagaaagattattttctggacaagatcgatagagaagttttcttgaggaagcaacggtcattttacaacagcgtgataccacatcagattcacctacaggagatgcaagccatcctggaccgacagagtcagtattaccccttcctcgctgaaaatcgcgataaaatcgagtctctggtaacatttaggattccttattacgtgggcccacttaccgtctccgaccagagcgaatttgcctggatggagagacaatcggatgagccgatccggccctggaacttcgacgaaattgtgaataaggagcgctctgcagaaaaatttatagagagaatgactaacatggacacatacctgttggaggaaaaggttctccctaaaaggtccctgttatatcagaccttcgaggtgtacaatgaactgacgaaggtccgttataccaacgagcagggtaagacagaaaaactaaatcggcagcaaaaggctgagatcattgagactctctttaaacagaagaaccgagtgagagaaaaagatatcgccaattacctggagcagtatgggtacgtagacggaaccgatatcaagggcgttgaagacaaattcaacgcgtcacttagtacatataatgatttggccaagattgacggcgcaaaggcttacctggatgacccagagtacgccgatgtgtgggaagacataatcaaaattctcactatctttgaggataaggctatgaggaaaaagcagctgcaaacctatagcgacacactttcccccgagattctgaaaaagttggaacgcaagcactacaccgggtggggacggttctctaaaaagctcatcaacggtctgagagatgagggcagcaacaaaactatattagactatctgaagtcagacgaagggagttccggacctacgaataggaactttatgcagctaatccgcgataatacactcagcttcaaaaagaagattgaggacgcccagaccatcgaagatactacccatatttacgacacagtcgcagagctgccaggctctcccgccatcaaaaagggtatacgacaggctcttaaaattgtggaggaaatcattgatatcatagggtatgagccggaaaacatcgtcgtggagatggcgcgggagtcacaaaccactaagaaaggcaaggacttgagtaaggaacgtctggagaaactcacagaagcaattaaggagtttgatggacctagcgacgttaaagtgaaggatctgaaaaatgaaaacttaagaaatgacaggctgtacctttattacttgcagaacggccgcgatatgtacacgaatgagcccctcgacatcaacaatctgtccaagtatgacattgatcacatcataccacagtctttcaccactgacaactcgattgataataaagtcctagtaagccggacaaagaaccaagggaataagtccgacgatgtgccttcaatcaacatcgttcataaaatgaagcccttttggagacagctgcacaaagccggactcattagtgacaggaagttcaaaaacctgaccaaggctgagcatggtggccttacagaagccgatcgagcacactttttgaatcgccagctggtggagactcggcagatcaccaagcacgtcgccaacttactcgactctcaatacaatacggctgaagaacagagaattaacatagtgctgcttaaaagctccatgacctcaaggttccgtaaggagttcaaactgtataaggtacgcgagatcaatgattaccatcacgggcatgacgcctatttgaacgcagtggttgcgacaactattatgaaagtctacccaaatctcaagccccagtttgtgtatggacagtacaagaaaaccagcatgttcaaggaggaaaaagctacagcccggaagcacttttactctaacatcactaaattctttaagaaggagaaagtggtcaatgaagagaccggcgaaattctgtgggatacggagagacacctatccacaatcaagagggttctgagttggaaacaaatgaacatagtgaagaaagtggagaagcagaagggtcagctctggaaagaaaccatctatcctaagggggacagctctaaactgattccagtaaaggagggcatggatccgcagaaatacggaggcctttcccaagtctcagaagcattcgccgtggttatcactcatgagaaggggaaaaagaagcagttgaaaagtgacctgattagcatccccatagtggaccagaaggcttatgagcaacaccctacagcctacttagaagaggcaggatataataacccaaccgtcctccatgaactgtttaaataccagcttttcgagctggaagatggttcgcgacggatgattgcttccgccaaggagtttcagaaaggcaatcagatggtgctacccctcgagctggttgaattgctgtatcacgcgaaccgctacgacaaggtgaagttccctgattctatcgagtacgtacatgacaatttagccaaatttgatgacctcctggaatatgtcatcgatttcagcaacaagtacattaacgctgacaaaaatgtgcaaaagatacagaaaatctataaggagcacgggactgaagatgtggagcttaccgtcgagtcattcgttaacctgatgacatttacggcaatgggagccccagctaccttcaagttttacggcgaaagtattactagatccaggtatacatctatcaccgagttccggggtagcacattgatttttcagtccatcactgggctctacgaaacccgatataaactggaggacaattga

SEQ ID NO: 2946 - RNA, 3999 nt, synthetic construct
  misc_feature 1..3999: note = Cas9 variant
  source 1..3999: mol_type = other RNA
atgatgaaggagtacagcatcggcctggacattgggtcctcttcagtgggattcgtcgccgttgatgaccagtatagagtggtaagggctaaaggtaagaacgtgataggcacccggctctttgatgaagggaaaacagcagccgaccgccgaggacttcgtactacgagaaggcggctgagtcgcagaaagtggaggttgcggttactgcgcggcatcttcgagccccacattaatgaaatcgatgagagctttttcatgcgactaaaagaatccaacatttctcctaaggactcgaataagcattttccaggtgatatcctcttcaacgacagatcagatagggagttttacgagaattatccgaccatataccatctgcggcaagcgcttaaaacagaaaagcgtcagttcgacatccgcgagatttatctggctatgcatcacatcgtcaaatacagagggcactttttggaaggaggcactgtgaccgatttcgaggttggcgagctcgacctggccgggaagtttagcaggctgaacgaactcttcgagagtattaatttagaagtgccctttgtcctgcggcttgataacttggaggacgtgaaagcagtactgatcgactcccagcgatctgcccaggatcgccaaagaacactaacccctgacatatatgttccaagcactgataagattacagaaaagaggttcaaaggaatcgctaccgagctcctgaaggcaattgtgggtaataaagccaagttcgacgtccttgctggcctggagttggataaagaagaggccaagctctgggcgctgacgtttgactccgaaactttcgatgaggacatcgaacagttagagggggatatgaccgaggcaacacaggacctgatcgaaattctcaaatcacttcggagtctgatacgcttggccgtgaacatgcccgagggagtgagcctatctgaaatgatgatccagagatacgaggatcacgctgaccacctgaagctcctgagggacattatccataatactgatgccgaaaaggcagctggccttcaagccgcgtacgacggttatatagatggggtcaaaggaaagaaaacccctgttgacgatttttacaaggccattaaaaagaacctggacgattccgaggcagctcaccagatcttggccctcatcgacaagaatgagttcatgccaaaacagcgttcaaagagcaacggctggattccccatcagatccaacagaaagaactggatcggattatagagaatcagaagcaatattacccttggttagctgacgtgaacccaaacgaaagtcgaagaaaagtagccccgtataagatcgatgagctggtgacatttagggtcccctactatgtgggccctctagttacctctgaggaacagaagaaatacgggtccaagttcgcatggatggtgcgcaaagaggaaaagggagagattacgccatggaattttgaccagaaagtcgatcgggccgctagcgcgactgagttcatcaacagaatgacaaccatggacacttacctcctgaatgaagacgtgcttcccgcacactcgttgatctatcagaagtacgaggtactgaacgaactcaataaggttaaaattaacggtgatgccataacacctgagctgaagcagaaaatctatcacgacctttttgaaaagcaaaccacggtgtctattaaaaatctgcagacctacttggtctccgagtcagaagctagtgaggtgccagagatcaagggcctcgccgatgagaaaaagttcctgagcgggttaacaacttatcatgacctgatgaagatttttgataggaacgtcgtgaatgaccccgaacgcgcagaagatttcgagaaaatcatacgatggtccaccgtttttgaagacaagcacatctaccgggagaaactagattctctcagctggctgacaactgaccagaaggatcgtcttgccgtgaaaagatataggggatggggccgcttgtcagagaagctgctcattggtctgcgggacgaagggcatagaagtatcatggattacttatgggagaccacatccaacttcatgcaaattcaggctcagaatgacttcagcgaaaagatcgccgcagagaacaaagagtttctggacaatacccagtctgtacaaggcataattaacgaactttacacttcaccgcagaataagaaagcgatcaggcagacgttgctcgtcgtggaggatattaagaaggctttccacggagaagcccctaaacgaatctttgttgagttcgcacgcgaaaacgagagtacaccccagcggagcatacaaagacagcgtcaggtggagaacgcctatgaaaaggtcacccaaaatctgctagtggacgataaaatcagggctgagctgaaggactccattaacgaaaaacgcctctttcatgatcggctgttcctttactttatgcagggcgggatcgacatgtattctggaaagaaaattaatatcgataacttgtcggcctacgacatagatcacattctgccacagagcttcactgtagacaattccttagataacagagtgctcaccaatcagaaggacaacagggagaagggtaattcactgcctagtgaactttatcgaggctctatgaaagagacatgggagatgatgcggaaccaagggctgttgagcaagggaaaatttcaccgcctcatgatgacccccaattccatgactgcatacgaccagcagggcttcatcaacagacagctggttgaaacaaggcaagtcatcaagctagctgtggagattctggcctcagaatttgatcaggcggacgagaaagtggaaatcgtcagcgttaaggccggtctcacgcatcagatgcggcaggatttctctctgattaaaaatcgagacgtgaacgattatcaccatgcttttgacgcataccttaccgccttcgtggggacttacttgctgaagagatatccaaagttacgcccctacttcgtatatggcgagtttaaaaagttctcccaaaaacaggctaatctcacaaactttaacttcctgtgggcccttaagcacaaagatcaggtcgcagtggaggacaccggagaaaagatatggaataagcctcaagatctggcgtacatcaggcacctatttgccttcaaaaagattctcatcagtcgtgaggttagcgaacggcatggcgctctgtttgaccagacattgtataaagcctctgatgacaaggcatccgggcagggaagtaaaaagctgattccagctaaggataacagaccgactgagttatacggtggctattcagggcagaccagcgccttcatggcaatcgtgaaagtcacgaagggcaaaaagaccaaatacctcgtggttggagtgcccacagccgctatatcgcaactgcagggtatggacgtaaagtcctctcagtacactgagaagatctataatattcttagccctaaactgttgtcaaagaacgacgattttgaagtcatcgtgccaaaagtgaggtaccgccagctcattctggacaataaccaactattcaccctggggagtgatacatataagtacaatgcgcgacagcttgtcctctccaacgaggttctggccgtgatcaatagagacaaatcttttatagataagaagttgagcgaagaggcagaaaaccaggctctgaatgacgccttcgatgagattgtagtggccatggacaaacacttcgatttatatgacaagaacggctttcgggagaaagtcaaggctggaaaacagaggttcgaggaactccccgtgtccctgttttcagaagataaggagaatgaaggcatcactaaacgcaccgttcttaagcgtatcctgcaagggttgcatgcaaacgccacgacaagcgacctcaaggtgctggatggaaaattctacaattga

SEQ ID NO: 2947 - RNA, 4002 nt, synthetic construct
  misc_feature 1..4002: note = Cas9 variant
  source 1..4002: mol_type = other RNA
atgaagaactacaccatcggcctggacattggggtggccagcgtcggatgggtttgcatagatgagaattataaaatcctcaactacaataacagacacgctttcggtgtgcatgaatttgagtccgcagaatctgccgcgggcaggcggcttaagcgcgggatgcgacgtagatataataggcggaaaaagcgcctgcagttgttacaatcactgttcgacagttacattacagatagcggatttttctccaaaactgactctcagcacttttggaagaacaataacgagttcgaaaatagatcgctaacggaggtactctcaagcctgaggatcagttcccggaagtatcccaccatttaccatcttcgctctgatctgatcgagagcaacaaaaagatggacttgcgactcgtgtatctggctctgcacaatctcgtcaaatacagaggccactttttacaggaaggtaactggtccgaggccgcatcagccgaagggatggatgaccagctgcttgagttggtgacaaggtacgctgagctggaaaatctaagtcctctcgatctgagcgagtctcaatggaaggcagccgaaactcttctgttgaaccggaatctcaccaaaacagaccagtccaaggagctgaccgctatgttcggaaaggaatatgagccattttgtaaattagttgccggcctgggcgtgtcactccatcagcttttcccgagcagtgagcaggcgctggcatacaaggaaactaaaacaaaggtccaattgtctaacgagaacgtggaagaggtaatggaactactgctcgaggaggaatccgccctgcttgaggctgttcagcccttttatcaacaggtggtcctgtacgaattgctcaaaggggagacctatgtggccaaggcaaaagtgagcgctttcaagcaataccagaaggatatggcctcgctgaaaaatttactggacaagacgtttggagaaaaagtctatcgttcttacttcatatccgataagaactcacagcgcgagtaccagaaaagtcacaaggttgaggtgctatgcaagctcgaccagttcaataaagaagcgaagtttgccgagactttctataaagacctgaagaaacttttggaagataagagcaagacctccatcggtacaactgagaaagacgagatgctgagaattatcaaggcaattgattctaaccagtttctccagaaacaaaagggcatccagaatgctgccatacctcatcagaacagcctgtacgaagctgagaaaattcttaggaatcagcaagcccactatccattcatcaccacagaatggattgagaaggtaaagcagatcctggcatttcggatcccctactatattgggcctttggtgaaagacaccacgcagtcaccattcagttgggtcgaacgaaagggagatgcccccataactccttggaactttgacgagcagatcgataaagctgcgtccgcagaggccttcattagccgcatgagaaagacatgtacctacctcaaaggccaagaagtgctgccaaagtcttcattaacttatgagaggtttgaagttctgaatgagctaaacggtatccagctccggacaaccggggctgaaagtgacttccgccatagactgagctacgagatgaaatgctggataattgataatgtgtttaagcagtacaagacggtctccaccaaaaggcttttgcaggagctgaagaaatctccgtatgccgacgaactctacgatgagcacacaggagaaatcaaggaggtgttcggcactcaaaaagaaaacgcatttgccacctcgctgagcggctatatctccatgaagtcaattttaggggctgtagttgacgacaatcccgccatgacagaggagctgatctactggattgcagtgttcgaagatcgtgagatacttcacttgaagatccaggaaaaatatcctagtattactgacgtccagcggcaaaagctcgcgctggtgaaactaccaggatggggtcgattctctagactgctcatcgatggcctgccccttgacgagcaggggcagagcgtcttggatcatatggagcagtactcctcagtgtttatggaagttctgaagaacaaaggattcggcttagagaagaagatccagaaaatgaatcaacaccaggtggacggtaccaagaaaattaggtatgaagatatagaggaactcgctgggagccctgccctgaagcgcggcatctggcggtctgtaaaaattgtcgaggagcttgtgtccatctttggagaaccagcaaacattgttctggaggtggccagagaagacggcgagaagaagaggacaaaaagtcgcaaggatcagtgggaagagttgaccaaaactacgctcaagaacgaccccgatctgaaatctttcatcggggagataaagagccaaggagaccagcgatttaatgaacagcggttctggctatacgtcacacagcaaggtaaatgtctgtacaccggcaaggctctcgatatccagaacctgtccatgtatgaggtggaccatattcttccgcagaattttgtaaaggacgattcattggacaacctggccttagtgatgcctgaagcaaatcaacgtaaaaaccaggttgggcagaataagatgcccctcgagatcattgaagctaaccagcaatacgccatgagaactctgtgggagaggcttcacgagctgaaactaatcagtagcggaaagctcggccgcctgaaaaagccatcgttcgatgaagtcgacaaggataaatttatagcgcggcagttggtggagaccagacagattatcaagcatgtgagggacctgttagatgaacgattctccaaatctgacattcacctcgtcaaggccggtatcgttagcaaatttcgccggttctcagagatacctaagatcagagattataataacaagcaccatgctatggacgcactgtttgccgctgcccttattcagagtatcctggggaaatacggcaagaatttcttggcattcgatctctccaaaaaggacaggcaaaaacagtggcgttctgtgaagggaagcaacaaggagtttttcctgtttaaaaatttcggcaacctacgcctgcagtcccccgtgacaggggaagaggtatcaggagtcgaatatatgaagcacgtgtactttgagcttccatggcagaccactaaaatgacacaaacgggtgatggcatgttctataaggaaagcatttttagtcccaaagttaagcaggcgaagtacgtgtctcctaaaaccgagaagttcgtccatgacgaggtgaaaaatcactccatctgcctcgttgaatttactttcatgaagaaagagaaggaagtgcaggagacaaaatttatagacctgaaggtaattgaacaccatcagttcttgaaggagccagagagccaactggccaaattcttagctgaaaaggagaccaactcgccgatcatccacgcccggattatcagaacaattcccaaataccagaagatatggatcgaacattttccttattacttcatttcaactagggagctccacaacgcacgacagtttgaaatctcttatgagctgatggagaaagtcaagcaacttagtgaacggtccagcgtggaggaactgaagattgtgttcgggttgctcatcgatcagatgaatgacaactacccaatatataccaaatctagcatccaggatcgcgtccagaagtttgttgacacgcaactgtacgatttcaaatcctttgagattggattcgaggaactaaagaaagctgtggccgcaaatgcccagagatcagacacctttggcagtaggatcagcaagaagcccaaacctgaggaagtagctattggttatgagtctatcacagggctgaagtaccggaaaccacgatccgtggtcggcactaagagatga

SEQ ID NO: 2948 - RNA, 4002 nt, synthetic construct
  misc_feature 1..4002: note = Cas9 variant
  source 1..4002: mol_type = other RNA
atgagccagaacatcgtggactactgcattggcctggatctcgggaccggatccgtcggttgggccgttgtggacatgaatcacagacttatgaagaggaacggcaaacatctgtgggggtctcggttgttctcaaatgctgagacagcagccaaccgccgagcgagtcgtagcataagaaggcggtataataagcgcagagaaaggatccggttactgcgcgctattctacaagatatggtactcgagaacgaccccactttcttcatccgactggaacacacgtcctttcttgatgaggaagacaaagccaattacctgggagcagattataaggacaactacaatttgttcattgatgaggactttaacgattatacctactatcataaataccctacaatctaccacctcagaaaggccctgtgtgagtctactgaaaaggctgacccaaggctgatatatctcgcattacatcacatcgtgaaataccggggcaatttcctgtatgagggtcagaagtttaacatggatgcctcgaatattgaagaccgtctttcagacgtcttcacccagtttgctgatttcaacaatatcccgtacgaggacgatgagaaaaagaacttggaaattctggagatccttaaaaagcccctcagcaagaaagccaaggtggacgaagttatggcgctgatagcacctgagaaagattttaagagtgcctataaagaacttgtgacagggattgctggaaacaagatgaatgtcaccaaaatgatcctgtgcgagccaattaagcagggcgactccgagatcaagttgaaattctctgatagcaactacgacgatcaattttccgaagtggagaatgacctcggcgaatatgtagagttcatcgattcactgcacaacatttacagttgggttgaattacagactataatgggggccacacatacctacaatgcaagcatctctgaggctatggtgtcccgctataacaagcaccatgaggacctgcagctccttaaaaagtgtattaaagacaatgtccccaagaagtacttcgatatgtttagaaacgactcagaaaaactgaagggatattacaattatatcaaccaccctagcaaagccccagtggatgagttctacaagtatgtgaaaaagtgcatagaaaaggtcgacacgcccgaggcgaaacagattttgcacgatatcgaactagagaattttctgctcaagcaaaacagtaggactaatggttctgttccttaccagatgcagctggacgagatgatcaaaattatcgataaccaggccaagtactatccagtgcttaaagaaaagcgggagcaactgttgtccattctcaccttcaagataccgtactattttggccccctgaatgaaacaagcgagcatgcatggatcaaacgattagaggggaaggaaaaccagcgcattctgccttggaactaccaggacatcgtagatgtggacgctactgccgagggattcatcaaaagaatgaggtcgtattgtacctactttccagatgaagaggtcctacccaaaaattctctcattgtgtccaaatatgaagtttacaacgagctgaataagatacgggtggacgataaacttttggaggtcgacatcaagaacgacatttacaatgaactgttcatgaacaataagacagtgaccgagaaaaagctcaaaaactggctggtaaataaccaatgctgtaataagaacgctgaaatcaaaggctttcagaaggagaatcagttctcaacgagtcttactccttggattgattttacaaacatcttcggtgaaataaatcagagcaactttgacctgatcgaggatattatctatgacttgaccgttttcgaggataagaaaattatgaagcgcagactcaaaaagaaatacgccctgccagacgataagatcaagcaaatattaaaactgaagtataaagactggtccaggctatctaagaaactcctggatgggattgtggcagacaacaagttcggaagctcagtcactgtgcttgatgtcttggaaatgagtcgtctgaatctcatggagatcattaacgaccgggatctgggctacgcccagatgatcgaagctgcggcatcctgccccgaggacggcaagtttacatataaagaagtgcagcgattagccgggagcccggctctgaagagaggaatatggcagtctcttcaaatcgttgaggagattaccaaagtgatgaagtgtaggcctaaatacatctatattgaatttgagcgctcagaagagacgaaggagcggaccgaaagtaaaatcaagaagttggagaatgtatacaaagacctcgatgaacagacaaaggtcgagtacaaaactgtgctggaggaactaaagggttttgacaacaccaaaaagataagctccgattctctgttcctctattttacacagctgggcaagtgcatgtactcggggaaaaagctagacattgatagcttggacaaatatcagatcgatcacatcgttccccaatccctggtgaaggacgattcattcgacaatagagtcttagtggtaccaagtgagaaccagaggaaactcgatgacctggtggttccttctgacattcgcgtcaagatgaatagcttttggaaacttctgttcgatcatgaattgatctcccccaagaagttttactcactcattaaaactgagtataccgaacgagacgaggaacggttcataaaccgtcagctggtggagacaagacagatcaccaagaatgtgactcaaattatcgaggatcactacagcacgacaaaagtcgccgcaattagggccaacctatctcatgaatttcgcgttaagaatcacatctataagaaccgggacataaatgattaccaccatgctcacgacgcctacatcgtggcactgattggaggcttcatgagagataggtatccaaacatgcatgactccaaagcggtgtacagtgagtatatgaagatgtttcgaaagaataagaacgataaaaagcgctggaaggacggtttcgtaatcaacagcatgaattacccctatgaagtcgatggggagctcatttggaaccctgacatcataaatgaaattcggaaatgtttctactataaggattgctactgcaccactaaactggaccagaagtctggccagatgtttaaccttaccgtgttgccaaatgacgctcactccccgaaaggaacaaccgaggccgttatccccgtgaacaagaatagaaaagatgtcaacaagtacggcgggttctcaggactgcaatatgtgatcgttgcaattgagggtaagaaaaagaggggcaaaaagactaaattagtgaagaagataagtggggtacctctccacctgaaagccgctagccttgacgaaaagatcaaatacattgaggaaaaggagaatctgacagatgtcaaaatcattaaggactcgatcccagtgaaccagatgatagagatggatggaggcgaatatctactcacgtcccccatcgagtttgtgaatggtcgtcagctggtcttgaacgaaaagcagtgtgccctgattgcagacatctacaatgctatttataaacaagattgcgacaacttagatgacgttctcatgatccagctgtacatagagcttattaataagatgaaagccctgtatcctgcgtaccagtctatcgccgaaaagttcgagagcatgaccgaggattacgtggctgtatcaaaagaagagaaggcagacatcattaagcagatgttgatcataatgcatcgcgggccacggaacggcaaaattcaatatgccgattttaatgtgggagacagaatcggcaggaagaacaaaatgagtctcgacctggaacgagtcactttcgtgtcccagtctcccacagggatttacaccaagaaatataagctatga

SEQ ID NO: 2949 - RNA, 4002 nt, synthetic construct
  misc_feature 1..4002: note = Cas9 variant
  source 1..4002: mol_type = other RNA
atgggcaaggagtactatctggggctcgacatcggaaccgatagcgtgggttgggccgtctgcgacacaaactacaaaattcccaagttcaaaggcaatgctatgtgggggataagactttttgaaaagtccaactctgcagaggaaaggcggggattccgctcaagtcgacgtagaactcagaggaaacgggagcgcctgaagttgttagaaatgctgtttgatgaggagatcagcaagattgaccctgccttctttatcaaactaagagaatccaatctctatctggaggataagtctacgaaaattccatactgtgttttctcggacgaaaactataccgataaggactttcacagggattacccgacaatctatcatcttcggaatgagctgataaaatcaaacaagccccacgacgtgcgcttggtatacctcgcgctgcatcacatcattaagaatcgaggccatttcctgtttgattacagctataaaaacgacaagagtggtgatttcatgcctatctacaatgacctcaaaaactatttttacgacaattatgagattgaattagattgctccgacgtggatgagttcgctaacactctgaaggacaaatctaaggggaaaaccaagaagaatgccgaaatcgcagagctttttggagtcagcaaaaagtacgataaagtgttgtattccgccctgtcactactcagtggcagctctgttaagctgttcgacatattcgatgacgaagctcttaaagatgtggagaagaagtccgtctcatttagcagtggcttcgacgataacgcaaatgactttcaatcttacctgggggagagattcgaattgctcgagaaactgaaggccgtgtacgactgggctgtattagccgatattctggacggaaaagaatatatctccgaggcgaaggttgcaatttacgaaaaacacaagagggatctcaagacacttaaaaagtatatcaaaatctacatgccagagaagaaagccgagatttttaacataagctcgaaggacaacaattatgtggcttactctaagcacatcaaaacctccaacggtactggcgtcctgatttcaacatgtacccaggaagagttctgcgcctatttgaagaaaacgctagggatctgtaaggatgcaagttacgaagagatgtttaaagaaatagagaatagcactttcatgcccaaacaggtgaccaaagacaacggagtggtccctatgcaggttaatgagaaggaactggtggctattctcgataacgccaaggagtacctgccatttcttctgaataaagacaacgatggcaagacagtatatgacaaaatcaaggcgttgttcgaataccggatcccctattacattggtcctctcaatactcattccaccaaatcttggctggtgcgtagcaacgagaagatctatccatggaatattgaggatgtcgtggactttgataagtcagccgaaaaattcatagagaacttaacaagtaagtgcacctacctgccgcaatatgacgttatccccaaacactccctactctacaataagttttgtgtgctgaacgaacttaataacttgaaaattgacggggagaagatcagcgtccagctgaagcaggatatctacaacgacctcttcaaaaagtattacaaagtgacgaataagaaactgtgcgattatcttaagtctcgcaacattgcattcgacgaaatatcaggaatcgataatgactttaagagtagcctgaaatcctacaaggatttggtagcttataacctcactgacgagcagaaagaggaaattgttaaggccatcacaattttcggcgatgacaaaaagctgctgaaaaagagactgaagaatgagtttggcgggtgtctatctgatgacgaaatcaaaaagatatgcaaactcaagtacaccggatggtcgaaactgagcagggagttccttactgatgtgacagctgtctataaggaaaccggtgagttgatcaacattatctgtgccctgtgggagacgaattacaacctcacctccctgttatactcagacgaattttgctgcgacgataaggagaataaaacattcaacgacaagattaatgaactgaacagttttggcaatgataaaactcttaaccaaatcgtggaggaattgtatgtctctcctctcgtgaagcggccaatataccagagcctgctaattaccaaagagctggagaagatcatgaagtgtccccctaaaaagattttcgttgaagtggcacgaggggccgaggaaaagaagcgcacagtatccagaaggaataaactcctggacctttataagtcatgcaagaacgattacccattgctgtttgacgagttacagaacaatactaccgatgacgagctcaaaagcgataagctgtatctttacttcacacagtttggaaaatgtatgtataccggcgaaaacatcgagctgggtgacttgttcaataagaacctctacgatatagaccatatctacccccaatctaaaattaaggacgattccctggacaatcgggtcctagtgaagaaaactacgaacgctaagaaagataatgaatatccgctgagtagccagatccgcgagaagatgacacctcactggaaagcgctcctggacaaggggcttattaacaaaaagaagtacgaaagattggttaggaattatcccctgtctgatgaggagttatcccagtttatctcacgtcaactcgtggaaacccggcagagtactaaagcagtcgccaacatactggagcagctttacccacgacctgacaccgaaattgtgtatgtaaaggctgccctggcaagcgagttcagacaccagtacgatatgctaaaatgcagggaagtgaatgacctccatcacgccaaggatgcttatctgaacatcgttgtcggcaatgcctacaacggaaaattcacacataataaggcaaactttatcaagggcttgcaaaacaatgacaaagcgtacaccgtgaagctggattcgatgttaaaacacaacattgacggggcttggatcgccgataataacgagtccctcaatattgtgaagtctactatgaacaaaaataacatacgctatacacggtacgcattcgagaagaagggaggtctgtttaaagtcacgatccttaagaaaggcaatgggcaggccagcattaagaaaaacgacaagagaaattcaatcgaaaagtatggaggctacaaccaggttagttccacctatttctcttgtgtggagcatggtaaagacaataacaggatgattagcatgttttccgtgaatctgtacgataagaacaaatatgaagagaatcccatcgcttacttgatagaaaactacgggctcatcaacccaattatcaaggtcaaaaaggtaaaaattcagtcatgcatcagcttcgacaatatgctgtgtcacctaggcggaaaggatagtggcgggtctcaaatatcctatcgccccggagtgcagctggttcttggttacgacaacgagcgatatattcggaatgtgatccgttgcgccggcggggatctccacttacagactagcaagaacgagaaagacatcgtcacagcagaaaagaatattgagttgtttaacctgttaatagagaaaatgaagaataacatctacggagtgctctattcgaatctgggcgataaactttactgttcaaaggaaaagttcgagaaactggacattgttgaacagtgcaacgtgatcaagaatgtattgaccattctcaaaaacaatgcttctaagggtgatctgaaaagtatcgggataaaggccaacggcgcgatcagactaaataacaacatttccgagatcaagaaagtcaagagcattaaactgatcaatcaatctgtgacaggactttttgaacaggagatagaactcctgaacttgtga

SEQ ID NO: 2950 - RNA, 4002 nt, synthetic construct
  misc_feature 1..4002: note = Cas9 variant
  source 1..4002: mol_type = other RNA
atgagccagaacatcgtggactactgcattggcctggatctcgggaccggatccgtcggttgggccgttgtggacatgaatcacagacttatgaagaggaacggcaaacatctgtgggggtctcggttgttctcaaatgctgagacagcagccactcgccgaagtagccgttccataagaaggcggtataacaagcgcagagaaaggatccggttactgcgcgcgattctacaagatatggtactcgagaaagaccccacgtttttcatccgactggaacacacctcttttcttgatgaggaagacaaggctaaatacctgggaacagattataaggacaattacaacttgttcattgatgaggactttaatgattatacttactatcataagtaccctaccatctaccacctcagaaaagccctgtgtgagtcgacagaaaaggcagacccaaggctgatatatctcgccttacatcacatcgtgaaataccggggcaacttcctgtatgagggtcagaagtttaatatggatgcttcaaacattgaagacaaacttagcgacgtcttcacccagtttgcagatttcaataacatcccgtacgaggacgatgagaagaagaatttggaaattctggagatccttaaaaagcccctcagtaaaaaggccaaagtggacgaagttatggctctgatatcccctgagaaggaatttaaatctgcctataaggagcttgtgactgggattgcgggaaacaagatgaatgtcacaaaaatgatcctgtgcgagagcattaagcagggcgattccgaaatcaaattgaagttctcagacagtaactacgatgaccaatttagcgaggtggaaaacgatctcggcgagtatgtagagttcatcgactctctgcacaatatttactcctgggttgaattacagaccataatgggggcaacgcatactgataacgcctcaatcagcgaggctatggtgagtcgttacaataaacaccatgaagacctgcagctccttaagaagtgtattaaagacaacgtcccaaagaaatatttcgatatgtttcgcaatgactctgagaaggtgaaaggatactataactacatcaatagacccaacaaggcccctgtggatgagttctataagtttgtcaaaaagtgcatagaaaaagttgacaccccagaagcaaagcagattctgcacgatatcgagttggagaatttcctactgaaacaaaactccaggacaaatggtagcgtgccctaccagatgcagctcgacgaaatgatcaagattatcgataaccaggctaagtattaccctgtactgaaagagaagcgggaacaacttctgtcgattttgacttttcgaataccatactatttcggcccgctcaatgagacctctgagcacgcctggatcaaacgcctggaagggaaggagaaccagagaattttaccctggaattaccaggacacagtggatgtcgacgcgaccgccgaaggatttatcaaaaggatgcggtcctattgtacgtacttccctgatgaggaagtgctgccaaagaactcactaatcgttagtaaatatgaggtgtacaacgagctcaataagattcgcgtcgacgataagctgcttgaagtggacgtaaagaacgacatatataatgagttgtttatgaagaacaaaactgttacagaaaagaaactgaagaattggctcgtgaacaatcaatgctgtagaaaggatgcagagatcaaaggcttccagaaggaaaaccagtttagcacctccctgactccctggattgacttcacaaatatctttggtaaaattgatcagtctaacttcgaccttatcgagaagataatctacgatctgaccgtcttcgaggacaaaaagattatgaagaggcgtttgaaaaagaaatacgctctccctgatgacaagatcaaacaaattctgaagttaaagtataaagattggagccggctgtcaaagaaactactcgacgggatcgtggccgataatcgatttggaagttccgtcacggtgctggacgttcttgaaatgagcagattgaacctgatggagataattaatgataaggaactcggctacgctcagatgatcgaggaagcctcttcatgcccaaaagacggcaagttcacctatgaggaggtggcaaaactggccgggagtcccgctttaaagaggggaatttggcagagcctgcagatcgtagaagagataacaaaggtcatgaaatgtcgcccgaagtacatctatattgaatttgagcggtccgaggaagcgaaagagagaactgaatctaagatcaaaaagctagagaacgtgtacaaggacttggatgaacaaaccaaaaaggagtataaatcggttctcgaggaactgaagggtttcgacaatacaaagaagattagctccgattcactatttctgtacttcactcagctcggcaagtgcatgtacagtgggaaaaagctggacatcgattctcttgacaaatatcagatagatcatattgtgcctcagagcttggtcaaggacgattcctttgacaacagggtgctggtattaccctcagagaaccaacgcaaactcgatgacctggtggttccattcgacatccgagataagatgtaccggttttggaaacttctgttcgaccacgaattgatcagccctaaaaagttttattctctcattaaaaccgagtacacagaacgtgatgaggagagattcatcaataggcagctggtcgaaacccgccagattactaagaacgtgacgcagataatcgaggaccattattccacaaccaaagtggcagccattcgggctaatctaagtcacgaatttagagtcaagaaccatatctacaagaatagggatattaacgactatcaccacgcccatgatgcatacatcgttgccctgataggaggcttcatgcgagaccgctaccccaatatgcacgatagcaaagctgtgtattctgagtacatgaagatgttccggaaaaacaagaatgaccagaaaaagtggaaagatggttttgtgatcaactccatgaattatccatacgaagtagacgggaagctcatttggaaccccgatctgatcaatgagattaagaaatgtttctattacaaggactgctattgcactaccaaacttgaccaaaagtcaggccagatgtttaacttgacagtcctgcctaatgatgcccatagtgcaaaaggaaccactgaggcggtgatcccagttaacaagaacagaaaggacgtgaataaatacggcgggttcagcggattacaatacgtcatagctgccattgaaggtacaaagaaaaagggcaaaaagctcgtgaaggttaggaaactgtcggggatcccgctttatctgaagcaggcagatatcaaagagcagattgaatacgtggagaaggaggaaaaactatccgacgtaaagataatcaagaacaatattcccctcaaccagctgatcgagattgatggacgtcaatatttgctgacgtctcctaccgaatgtgtcaatgccatgcagttagtgctcaacgaggaacagtgcaaactgatcgctgacatatacaatgccatctataagcaggattttgacggccttgataacatgctgatgattcaattgtacctccagctgatcgacaaactaaagactctgtatccaatttacatgggtatcgtggagaaattcgagaaacttacagaagattttgtcagcatatcaaaagaggaaaaggcaaatgttattaagcagatgctcatcatcatgcacaaagggccccagaacggcaatattatctacgacgatttcaacgtgggaaagcgcataggccggctgaatgggagaaccttttatttggacaacattgagttcatcagtcaatcccctacaggaatttacactaaaaagtataaactgtga

SEQ ID NO: 2951 - RNA, 4002 nt, synthetic construct
  misc_feature 1..4002: note = Cas9 variant
  source 1..4002: mol_type = other RNA
atgtacacctattacttcaaggagagcgaaatggtgtatgacgtcggcctggatatcgggacaggatccgttggttgggtggccctcgacgagaacggcaaacttgctagagcaaaggggaaaaatctggtaggagtgaggttgtttgatactgcccagacggcggctgaccggcgcggcttccgaaccacacgtagaaggttatctcggcgcaagtggagactgaggctactcgatgaactgttttcagccgagattaacgaaatagacagtagcttctttcaacggcttaaatactcctatgtccaccccaaggatgaggagaataaggcacattactatggtgggtacctgttccctactgaagaggaaaccaaaaagtttcaccgctcttacccaacaatctatcatttgcgacaggagctcatggcccagccgaacaaaagattcgacattagggagatctacctggctattcaccatctggtgaagtatcggggacactttctctcgtcacaggaaaagatcaccataggcagcacttacaatcccgaggatttagcaaacgccatcgaagtttatgctgacgagaagggcctgagttgggaacttaataaccctgagcaattgacagagattatctccggggaagccggatacggtctgaataagtctatgaaagcggatgaggcactaaaactcttcgaatttgacaacaatcaggataaagtggccattaagaccctgcttgctggcctgacggggaaccagatcgacttcgccaaattgtttggaaaggacataagcgataaagacgaggcaaagctctggaagctgaaattagatgacgaagctctggaggagaagtcccagactattctctcacaacttaccgatgaagagatcgaactgttccacgccgtcgtgcaggcgtatgacggcttcgtattgattggtctactgaatggggccgatagtgttagcgcagctatggtgcagctctacgaccagcatcgtgaggatcgcaaactgcttaagtctctggcccaaaaagctggattgaagcacaagagattttccgaaatctacgagcagctcgccctggcaacagacgaggccactatcaaaaacggcatttcaaccgctagggaattagtcgaggaaagcaatctgagtaaggaggtgaaagaggatacactacggcgactcgacgaaaacgagttcctgccaaagcagcgcaccaaagcgaactctgtgataccccatcaacttcacttggcagaactgcagaagatcctccagaatcagggccaatattacccttttctgcttgacacgttcgagaaggaagatgggcaggacaacaaaattgaggagctgttgagatttaggatcccatattacgtcggacccctcgttactaagaaagatgtggaacacgccggtggcgacgctgataatcattgggtagagcggaacgaagggttcgagaagtcccgcgtgacaccttggaattttgacaaagtcttcaacagagataaggccgcaagggactttatagaacgtctgaccggaaatgatacttatttaattggcgagaagacactgccacagaacagcctacggtaccaactcttcaccgtgctgaatgagcttaacaatgttcgagtgaacggtaaaaagtttgactcgaaaacgaaggccgatttgatcaatgacctgttcaaagctagaaagaccgtctctctctccgccctgaaagattatttaaaggcacaggggaagggcgacgtgacaatcactggactggcggacgaatcaaaatttaacagtagcctttcctcttacaatgatttgaagaaaaccttcgacgctgagtacctcgaaaacgaggataaccaggaaacactggagaagattatcgagattcagactgtattcgaagacagcaaaatagcctcaagggagctaagtaagctgccgctcgatgacgatcaggttaagaaactgtcccaaacccactatacaggctgggggcgccttagcgaaaagttgctggactctaaaatcattgatgagcggggacagaaggtgtcaatcttagacaaactcaagagtaccagccagaattttatgtccatcattaacaatgataagtacggtgtccaggcatggataactgagcaaaacacggggtcttcgaaactgacattcgacgaaaaggtgaatgagcttaccactagccccgccaacaaaagaggcatcaagcagtcctttgctgtcctgaatgatattaaaaaggccatgaaggaggaacctaggcgcgtgtatttggagttcgcacgagaagaccagacctcagttcggagtgtgccacgttacaaccaactcaaagagaagtatcagtctaaaagcctgtccgaagaggctaaggtactaaagaagacactggacggaaataaaaacaagatgtcagatgacagatactttctctatttccagcagcaaggcaaggatatgtacaccggtaggcccatcaattttgaacgcctgagccaggactacgatattgaccatatcatacctcaggccttcactaaagatgactctcttgataaccgggtcttggtgtccagaccagagaatgcgaggaagagtgacagctttgcctatacagatgaagttcagaaacaagacgggtctctgtggacgtccttactcaagtcaggcttcatcaaccgcaaaaagtacgagcgactgaccaaggctggaaaatatcttgacggccagaagactgggtttattgcacggcagctggtggagacaagacagatcattaaaaatgtcgccagtctaatcgaaggagagtacgaaaacagcaaggctgtggccataaggtcggagattaccgcagatatgcgtctcctggtaggtatcaaaaagcaccgcgaaattaactccttccatcacgcgtttgacgccttgctgatcacagctgccggccaatatatgcagaatcggtaccccgatagagactctactaacgtgtataatgagttcgataggtacaccaacgactacttaaagaatctccgacagctgagctcacgggatgaggttcgcagacttaaaagtttcgggtttgtcgtgggaacgatgaggaagggcaacgaagactggtccgaggaaaatacctcttatctgcggaaagtgatgatgttcaagaacatattgacaactaaaaagaccgagaaggatcgaggtccgctcaataaagagacaatctttagccctaagtccgggaaaaagctgattcccctaaactcaaaaagaagcgacactgcactgtacggcggatatagtaatgtctactctgcttatatgacccttgttcgcgccaacggcaagaatctcctgatcaagattccaatctccatagcaaaccaaattgaagtggggaatttgaaaatcaacgattacatcgtgaacaatcctgccattaagaaattcgagaagatcctgattagcaaattacccctcggacagctggtaaacgaagacggcaatcttatatatctggcttcgaacgagtacaggcacaatgcgaagcagttgtggctctcaacgacagatgccgacaaaatcgcatctattagtgaaaactccagcgacgaggagctgctagaggcttacgatatcctgacctctgaaaatgtcaagaaccgttttccattctttaagaaagacattgataaacttagccaggtgcgggacgagttcctcgattccgacaaaagaatcgccgttatacaaactatcctgaggggtttgcagattgatgccgcttatcaggcacccgtgaagatcattagtaaaaaggtctcagactggcataagttacagcaaagcgggggaatcaaactgtctgataattccgaaatgatataccagtcagccacaggcatttttgaaacccgcgtgaagatcagtgacctcctgtga

SEQ ID NO: 2952 - RNA, 4005 nt, synthetic construct
  misc_feature 1..4005: note = Cas9 variant
  source 1..4005: mol_type = other RNA
atgaagaacccctacaccatcggcctggacattgggacaaatagcgtgggatgggccgtcctcactaaccagtatgatcttgttaaaagaaagatgaaagtggctggtaattccgacaagaaacaaataaagaagaacttctggggcgtaaggctgtttgatgacgggcagacggcagtggatcggcgcatgaatcgaaccgcccgtagaaggatcgagcggcgcagaaacaggatttcttacttgcaggaaatcttcgcggtcgagatggctaatattgacgccaactttttctgccggttaaatgattcattttatgtggacagtgaaaaacgcaacagccgacaccctttctttgcaacaatcgaggaagaggttgcctaccataagaattatagaactatataccacctgagggaggagctagtgaactcctctgagaaagctgatctccggctggtctatcttgcactggcccatatcattaagtaccgtggaaatttcttgatcgaaggcgctctcgacaccaaaaacacatcggtggatggtgtatacgagcagtttattcaaacctataatcaggttttcatgtcaaacatcgaggaagggactctggccaaggtggaggaaaacatagaggtcgcgaatattctggcaggaaagtttacacgcagagaaaaattcgagaggatcctccagttatacccaggcgaaaagagcaccggcatgtttgcccagttcattagtctgatcgtggggtccaaaggaaacttccaaaaggtgtttgaccttatcgaaaagacggatattgagtgtgctaaggactcttatgaagaggacttggaagccctgctagcaataatcggtgatgagtacgctgaactcttcgtcgccgcgaaaaatacttataacgccgttgtgctgagctccattatcaccgtaacagcaactgaaaccaatgctaaactttcagccagtatgatagagcggtttgacgctcacgaaaaggatctgggcgagttgaaagccttcattaagctccatctgccgaaacagtaccaggaaatctttaacaatgcagccatcgacgggtatgctggatacattgatggcaagacaaaacaggtggacttctacaagtatttaaagaccatcctggagaacattgagggtgcggattactttatagcaaaaatcgaagaggaaaatttcctccgaaagcaacgcacgtttgacaacggggccattccccaccagcttcacctggaggagttggaagctatcatccatcagcaagccaaatattaccctttcctaagagaggattatgaaaagattaaaagcctggtcacttttaggataccatacttcgtgggacccctcgcaaagggccagtctgagtttgcctggctgacacggaaggctgacggcgaaatccgcccttggaatattgaggagaaagttgatttcgggaagtccgccgtggacttcatcgagaaaatgaccaacaaggacacttatcttccaaaagagaatgtcctgcccaagcactcattgtgctaccagaagtacatggtgtataacgaactcacaaaagtaagatacattgatgaccagggaaagaccaattattttagcggtcaagagaaacagcagatcttcaacgatctgtttaagcagaaaaggaaggttaaaaagaaggacttagaactgttcctacgtaacataaatcatatcgagagtcctacgattgagggcctcgaagattcttttaacgcatcctacgcgacctatcacgacctgcttaaagtggggatgaagcaagagatcttggataatccactgaacacagaaatgctcgaggacattgtcaaaatcctgactgtgttcgaagataagccgatgataaaagagcagcttcagcagtttagcgacgtcctggatggaggcgtgttgaagaagctcgagcggcgacactacaccggttgggggagactgtcggctaaattactggttggcattagggaaaagcaatctcatctaacaatcctcgactatctgatgaatgatgacggacttaaccgcaatttgatgcagctgattaacgactccaatctctcattcaaaagtatcatagagaaggaacaggtgagcactaccgataaagacctgcagtccatcgtagccgatttagcaggctctcccgccattaagaaggggatcctgcaaagccttaaaattgtcgacgagttggtgtcaatcatgggataccctccacagacaatagttgtggagatggctcgggaaaaccagaccactggtaagggcaaaaataacagtaagcccagatacaaatccctcgagaaggccattaaggaatttgggagcaaaatcctgaaggagcaccctacggataatcaagaactgaaaaacaataggctatatctctactatctgcagaacggaaaggacatgtacacaggccaggagcttgatatccataacttgtctaattatgacattgatcacatcgtcccacagtcattcattaccgacaacagtatagataatctggtgttaactagctccgcaggtaaccgcgagaaagggggcgacgtacccccgctcgaaatcgtgcgaaagcggaaagtcttttgggagaagctgtaccaaggaaatcttatgtctaagcgtaaattcgattatctgaccaaggctgaaagaggcgggttgacagacgccgacaaagcgaggtttattcatcgccagctcgttgagacccggcagatcactaagaacgtggccaatattctgcaccagagattcaacaatgaaacagataaccacggaaatacgatggagcaagtgaggatcgtcaccctaaaatcggctctggttagccagttccgaaagcagtttcagctctacaaggtgcgcgaggtgaacgactaccatcacgcacatgatgcctatctgaatggtgtagtcgctaacactcttttgaaagtgtaccctcaactggaacccgagttcgtttatggcgaataccaccagtttgactggttcaaggccaataaagcaacagcgaagaaacagttttataccaacataatgttattctttgggcaaaaggagcggatcattgatgaaaacggagagatcctctgggacaagaaatacctggagacaattaagaaagtgcttgattatagacagatgaatatcgtcaagaaaactgaaatacagaagggcgagttctccaaggccaccattaaaccaaagggtaactcaagtaaactgatccctaggaaggaaaattgggaccccatgaaatacgggggcctagattctccaaacatggcttacgccgtgatcattgagcacgcaaagggaaagaaaaagctcatatttgagaaaaagatcattcgtatcacgattatggaacgcaaaatgttcgagaaggacgaagaggcttttctggaagagaaaggctatcggcatcccaaggttttgaccaagctgcctaaatacacattatatgagtgtgaaaaggggagaaggcgaatgctcgccagcgcaaatgaggcccagaaaggaaaccaactggtgctttccaatcacctggtatcattgctctaccatgctaagaactgcgaagcgagcgatggcaaatctctgaagtatatcgaggcccaccgggaaactttctccgagctactggcacaggtcagtgagttcgctacccgctacacacttgccgacgccaatctcagcaagataaacaatctgtttgaacagaacaaagagggtgacatccaggctattgcacaatctttcgtggatttgatggcctttaatgcgatgggggctccagcctccttcaagtttttcgaagcaactatcgacagaaaaaggtataccaacctgaaggagttactctcaagtacgattatctaccagagcataacaggactgtacgaatcgcggaaacgacttgatgactga

SEQ ID NO: 2953 - RNA, 4005 nt, synthetic construct
  misc_feature 1..4005: note = Cas9 variant
  source 1..4005: mol_type = other RNA
atgaagaaaccctacaccatcggcctggacattgggacaaacagcgtgggatgggccgctctcactgatcagtatgaccttgtcaagagaaaaatgaaggttgcaggtaattccgagaaaaagcaaataaagaaaaacctgtggggcgtgaggttggtagatgaagggaagacggccgcgcaccggcgcgtgaatcgaaccacacgtagaaggatcgagcggcgcagaaacaggatttcttacttacaggaaatcttcactgctgagatgtttgaagtcgacgccaatttcttttatcggctggaggattcattctacattgagagtgaaaaacgccagagccgacatcctttcttcgcaaccatcgaggaagaggtggcctatcacgagaactacagaacaatatatcatctaagggaaaagctcgttaattcctctgacaaagctgatctgcggcttgtgtacctggcattggcccacatcattaagtaccgtggaaactttctcatcgagggcaagctggacaccaaaaatacttcggtcgatgaagtgttcaagcagtttattaaaacatataaccaagtattcgcttcagacatcgaggaaggtagcctgacccgcatagaggagaataacgaagttgccaagatttttagtgagaaactcacgaagagagaaaaattagataagatcctgaatctttacccaaacgagaagtccactgacttgttcgcgcagtttatttctctgatcatcgggagcaaaggaaatttcaagaaattctttaacctaaccgaaaagacagatattgagtgcgcaaaagactcctatgaggaagacctcgaggtgctgcttgccagggtcggcgatgaatacgctgagatattcgtggccgcaaagaacgcttataatgccgtggtcctgtcaagtatcattactgttagcaacaccgaaacaaaggcgaaattgtctgcctccatgatcgagcggtttgacaagcatgataaagacctcaagcgaatgaaagcattctttaaggtgcgcctgccggagaatttcaacgaagtatttaatgatgtggagaaggacggctacgctgggtatatagaaggaaaaaccaagcaggaggccttctacaaatacatgaagaaaatgttagagcacgtcgaaggtgctgattattttattaaccagatcgaggaagagaatttcctgagaaagcaaaggacgtttgacaacggcgccatcccccaccagctccatcttgaggaactggaggcaattttgcaccagcaggccaagtactatcctttcctaaaagtggattacgaaaagatcaaatcactggttacttttcggattccatatttcgtggggcccctcgctaatggacaaagcgagttcagttggctgacacgcaaggcggacggcgaaataagaccttggaacatcgaggaaaaagtcgattttggtaagtctgcaattgacttcatcgagaaaatgaccaataaggacacttaccttccaaaggagaacgtgctgcccaaacattccatgtgttatcagaagtacatggtatacaatgaattgacaaaaatcaggtataccgatgaccaggggaagacgcactactttagcggacaagagaaacagcagattttcaacgatctctttaagcagaagcgtaaagttaagaaaaaggacctggaattattcctgtataatatgaaccacgtggagtcgcctaccgtcgaaggcgtggaggatgcctttaactcttccttcacaacttaccatgacctacaaaaagtcggcgtgccacaggagatactcgatgacccgctgaataccgaaatgcttgaggaaatcattaagatcttgacagtttttgaggataagcggatgattaacgagcgactgcaggagttctcaaatgtgctcgacgaagctgtactgaaaaagctcgaaagaaggcactatactgggtggggacgcctgagtgccaaattgctcatcggtatacgggataaggagagccatctgaccatcttagactacctgatgaacgatgacaaacacaatagaaacctaatgcagctcattaatgactccaacctgtcttttaagagcatcattgaaaaggagcaagtctcaacagcagataaagacatccagagtatagtggccgatcttgctggctcccccgccattaagaaagggatcttgcagagcctgaagattgttgacgagctcgtgggaatcatgggctatcctccacagaccatagtcgtggaaatggcaagggagaatcaaactacgggtaaagggaagaacaattctaaaccccgcttcacatcactggaaaaggcgatcaaggagttaggcagtcagattctgaaagaacatcctaccgataaccagggacttaagaatgaccgattgtacctctactatctgcagaacggcaaagatatgtacactgggcaagagctagacatccacaatctgagcaactatgatattgaccacgtagtgccacagtcctttatcaccgataactctatagacaatcgggttctcgcttcgagcgccgcaaaccgtgagaagggagataatgtcccctccctggaagtggtgagaaaaaggaaggtctactgggagaaactttatcaggccaaattgatgtcaaagcgcaaattcgactacctgacaaaggctgaacggggtggcttaaccgaggccgacaaagcaagattcattcataggcaactcgttgaaactcgacagatcacaaagaacgtggctaatatcctgcaccagcgctttaactgcaagaaagatgagagtgggaatgtgattgagcaggtacggatcgtcacgcttaaggccgcgctggtgtctcaattcagaaaacagtttcagttgtataaggttagggaagtgaacgactaccatcacgcccacgatgcttacctcaattgtgtcgtggcaaacaccctgctaaaagtttatccgcagctggagcctgagttcgtgtacggagactatcatcaatttgattggttcaaggccaataaggctactgccaaaaagcagttttacacaaacattatgcttttctttgcaaagaaggaccgtataatcgatgaaaatggcgagattctgtgggacaaaaagtatcttgataccatcaagaaagtattgaactaccgccagatgaatattgtcaagaaaacagaaatccagaagggtgagttcagcaacgcgactgccaaccccaaaggcaattcctcaaagctgataccacggaaagctgactgggatcctatcaagtatgggggatttgacggcagcaacatggcctacgcaattgtgatcgaacacgagaagaggaaaaagaaaaccgtgattaagaaagaattaatccaaataaatattatggagagaacggctttcgagaaggaccagaaggagttcctcgaagggaaaggataccgaaaccccaaggtcatcaccaaaatcccaaagtatacactgtacgaatgcgagaatggtcggcgcagaatgcttggctctgccaacgaagcacagaaagggaatcaaatggttctgcccaaccatctaatgactctcctgtatcacgccaagaattgtgaggcttccgatggaaagagtttggcgtacattgagagccatagggaaatgtttgccgagctgttagactctatatccgaatttgcatcacggtataccctcgctgatgccaacctggagaaaatcaatacaatttttgaacagaacaagagtggcgacgtgaaagtaatcgcccagagcttcgtgaatcttctggagtttaacgctatgggtgcccctgcatcgttcaagtactttgagactaatattgaacgaaaaagatataacaatttgaaggagctcctgaacgcgaccatcatataccagtccatcacggggctatacgaagctcgcaagaggctggatgactga

SEQ ID NO: 2954 - RNA, 4005 nt, synthetic construct
  misc_feature 1..4005: note = Cas9 variant
  source 1..4005: mol_type = other RNA
atgaagaacccctacaccatcggcctggacattgggacaaatagcgtgggatgggccgtcctcactgatcagtatgaccttgttaaaagaaagatgaaagtggctggtaactccgataagaaacaaataaagaagaatttctggggcgtaaggctgtttgacgatgggcagacggcagtggaccggcgcatgaaccgaaccgcccgtagaaggatcgagcggcgcagaaataggatttcttacttgcaggaaatcttcgcggtcgagatggctaacattgatgccaatttcttctgccggttaaacgactcattttatgtggatagtgaaaaacgcaatagccgacaccctttctttgcaacaatcgaggaagaggttgcctaccataagaactatagaactatataccacctgagggaggagctagtcaattcctctgagaaagctgacctccggctggtgtatcttgcactggcccatatcattaagtaccgtggaaacttcttgatcgaaggcgctctcgataccaaaaatacatcggtggacgaggtatacaagcagtttattcaaacctataaccaggttttcatgtcaaatatcgaggaaggtgccctggcgaaggtggaggaaaacactgaggtcgcaagcatactggccgggaaatttacacgcagagaaaagttcgagaggattctccggttatacccaggagagaaaagtaccggcatgtttgctcagttcatctccctgattgtgggcaacaaggggaatttccagaaagtgtttaaccttgtcgaaaagacggatatcgagtgtgccaaagactcttatgaagaggacttggaagcactgctagctatcattggagatgagtacgccgaactcttcgttgcggccaagaatacttataacgcagtggtactgagctccataatcaccgtgacagctactgaaaccaatgccaaactttcagctagtatgattgagcgatttgacgcccacgaaaaagagctgggtgaattgaaggcattcatcaaactccatctgccgaagcaataccaggagatatttaacaatgccgagattgatggctatgctgggtacatcgacggaaaaacaaagcaggtcgatttctacaagtatttaaaaaccacgctggaaaacgtggagggcgcggactactttatcactaagattgaagaggagaatttcctccgcaaacagagaacatttgataacggtgttatcccccaccaacttcacctggaagagttggaagcaattctacatcagcaggccaagtattaccctttcctgagggaggggtatgacaaaataaagagcctcgtgacctttcggatcccatacttcgtcggacccctggctaatggccaatctgaatttgcctggcttactcgcaaggatgacggcgagattagaccttggaacatcgaggaaaaagtggatttcgggaagtccgcagtagacttcatcgagaaaatgacaaataaggacacctatctgccaaaagaaaacgttttgcccaagcactcactctgctaccagaagtacatggtgtataatgagctgacgaaaattaggtacatagatgaccagggaaagaccaactattttagcggtcgtgaaaaacagcaaatcttcaacgatttatttaagcagaaacggaaggtcaaaaagaaggacctggagctattcctccgaaatattaaccatatcgagagtcctacaattgaaggcctggaggattcttttaatgcctcctacgctacttatcacgaccttttgaaagtggggctgaagcaggaaatcctcgataacccactgaataccgagatacttgaagacatcgtcaaaattctgacagtgttcgaggataagagaatgatcaaagagcagttggaacaatttagcgacgttctcgatggagtggtactgaagaagttagagaggcgccactacactggctggggtcggctgtcggccaaactactcgtcgggattagagacaagcagtctcatctgaccatccttgattatttgatgaacgacgacggcctgaataggaacctcatgcagctgataaatgattccaacttatcattcaaaagtattatcgaaaaggaacaggtgagcacaaccgacaaagatctgcaatccattgttgcagaccttgcgggatctccggctatcaagaagggcatattgcagagcctcaaaatcgtggatgagctggtctcaattatggggtatccccctcagactatcgtggtagaaatggcccgcgagaatcagacgacaggaaagggtaaaaacaatagtaagccacgatacaaatccctagaaaaggcaattaaggactttggcagccaaatcctgaaagagcaccccaccgataaccaggaactcaagaataaccggctgtacctttactatttgcagaacgggaaagacatatacactggacaagagctggatattcataatttatctaactatgacatcgatcacatcgtgcctcagtcattcattaccgacaatagtatcgataacctcgttctgacaagctccgccggcaatcgtgagaagggtggggacgtcccaccccttgaaattgtgagaaaaaggaaggtgttttgggagaaactgtaccagggcaacttgatgtctaagcgcaagttcgactatctcaccaaagctgaacggggaggcctgactgaggccgataaggcaagatttatacataggcagctagtcgaaacacgacaaatcacgaaaaatgttgctaacattctgcaccagcgcttcaataaggagaccgacaaccacgggaatactatggaacaggtgcggatcgtgacactcaaatcggccctggtaagccagttcagaaagcaatttcagctttacaaggtcagggaagtgaacgattaccatcacgcgcatgacgcctatttgaatggagttgtggctaacaccctgttaaaagtctacccgcagctcgagcctgaatttgtgtatggtgagtaccaccagtttgattggttcaaggcaaataaagccacagctaagaaacaattttatactaacattatgctgttctttgcccagaaggaacgtatcatagacgagaacggcgagatcctttgggataagaaatacctggaaaccattaagaaagttctagactatcgccagatcaatattgtgaagaaaacggagatccaaaagggggagttctccaaggcaaccataaaacccaagggaaactcaagtaaactcattccacggaaggagaattgggatcctgtaaaatacggcggtctggactctcccaacatggcgtacgccgtcatcatcgagcacgctaaggggaagaaaaagattgtgatagaaaagaagttgatccagattaatatcatggagagaaaaatgtttgaaaaggatgaggaagccttcctggaggagaaaggctatcatcagccaaaggtgttaacaaagctccccaaatacactctgtatgaatgtgagaagggaaggcgacggatgcttagctccgcaaacgaagctcagaaaggcaatcaactggtcttgtcaaaccacctcgttagcctgctataccatgccaagaattgcgaggcatctgacgggaaatccctgaagtatattgaagcccaccgcgagacctttagtgagcttctcgctcaggtgagcgagttcgcgacaaagtacactctggccgacgcaaacttgtctaaaatcaataacctgttcgagcagaataaggaaggagatataaaagctatcgcccagtcctttgtagacttaatggccttcaacgctatgggcgcccctgcatcatttaagttctttgaggcgaccattgatagaaaaaggtatacgaatctcaaggaactgcttagtagcacaatcatttaccaatcgatcaccggtctgtacgagtcccggaagcgattggacgattga

SEQ ID NO: 2955 - RNA, 4005 nt, synthetic construct
  misc_feature 1..4005: note = Cas9 variant
  source 1..4005: mol_type = other RNA
atgggcagaaagccctacatcctgagcctcgacattgggaccggatccgtgggttatgcctgcatggataaaggcttcaacgtccttaagtaccacgacaaagatgctctgggggtttatttgtttgacggagcattaacagcccaggagaggcggcaattccgcacttctcgacgtagaaagaataggcggataaaacgcctgggcctactccaggaactgcttgcgcctctggtgcagaacccaaatttttaccagttccaaagacagtttgcttggaagaacgataatatggacttcaagaacaaatcattgagtgaggtactcagctttctgggttatgaatccaagaaatacccgacgatctatcatctgcaggaggccctcttactgaaggatgaaaaattcgaccccgagcttatttacatggcattgtaccacctggtgaagtatagggggcattttctattcgatcacctcaagatcgagaatctgaccaacaatgacaacatgcatgattttgtcgaacttattgagacatacgaaaatctgaacaatatcaaattgaacctcgactatgagaagactaaagtgatatacgagatcctgaaggataatgaaatgaccaaaaacgaccgggccaagcgcgttaaaaacatgcagaagaagttagagcaattctctattatgctgctcggacttaaatttaatgaaggcaagctgttcaaccacgctgacaatgcagaggaattgaaaggcgccaaccagtcgcacacattcgctgataattatgaggagaacctaaccccttttctgactgtggaacagtcagagttcatcgaacgagccaataagatttacctcagcctgacacttcaggacatcctgaaagggaagaagagtatggcgatgtccaaagtcgcagcctatgataagtttagaaacgagttgaaacaagtgaaggacatagtatacaaagctgattctaccaggacgcagttcaagaagatttttgttagctccaaaaagtcactcaaacagtacgacgccactccaaatgatcaaaccttcagtagcctgtgtttatttgaccagtatctgatccggcccaagaaacagtactctctactcattaaggaactgaagaaaatcatccctcaggattccgagctttatttcgaggcagaaaacgacacattgctgaaggtgctcaatactaccgataacgcttcaattccaatgcaaataaatctgtacgaggccgaaacaatccttcgtaaccagcagaaatatcatgcggagattaccgacgaaatgatcgagaaggtcctgagcttgatacagtttcgcattccctactatgtgggacctctcgtgaatgaccacacggccagtaaattcggttggatggagagaaagtctaacgaatccatcaaaccatggaactttgatgaggtcgttgacaggagcaagtcggcaactcaattcatccggcgaatgacaaataagtgctcttacctgattaacgaagatgtgttaccgaaaaattccctgctataccaggagatggaggtactcaacgaactgaatgctacccagatccgccttcagactgaccccaagaacagaaaatataggatgatgcctcaaattaagttgtttgccgtggagcatatattcaaaaagtacaagacagtctcacacagtaaattcctggaaatcatgctcaatagcaaccaccgggagaattttatgaaccatggcgaaaagctgtccattttcgggacccaggatgacaaaaagtttgcttctaaattaagctcatatcaggatatgacgaagatcttcggagacatcgagggcaagcgcgcccagattgaggaaataatccaatggattaccatctttgaggataaaaagattctggtgcagaaacttaaggaatgttacccagagttgacaagtaaacagatcaatcaactcaagaagctgaactattccggttgggggagactaagcgaaaaactgctcactcacgcataccagggacattctataatcgagctgcttaggcactcagacgagaatttcatggaaattttgaccaacgatgtttatggctttcagaatttcatcaaggaggaaaaccaggtgcaaagtaacaaaattcagcatcaggacatcgccaatctgacaactagccccgctttaaagaaaggcatatggtccaccattaagctcgtccgtgagctgacatctatctttggggaacctgagaaaattatcatggagttcgcgaccgaagatcagcaaaagggaaaggagcagaaatcgcggaagcagctttgggacgacaacatcaaaaagaataaacttaagagcgtggatgaatacaagtacataattgacgtagcaaacaaattgaataacgagcagctccaacaggagaagctgtggctatatctgtcccagaatggtaaatgcatgtactcaggccaaagtatcgatctcgacgccctgctttctccaaacgctactaagcactatgaagttgatcacatttttccccgatccttcatcaaagacgatagcatagacaataaggtgttggtcattaagaaaatgaaccagacgaagggggatcaggtgccgctgcagtttatccaacagccttacgagagaatcgcctattggaaatcattaaataaggcaggactcattagcgactctaaactgcataagctgatgaagcccgagttcacagccatggataaagaaggcttcatccagaggcagctggtcgaaacccgccaaatttccgtgcacgttcgggactttctaaaggaggagtacccaaacactaaagtgatacctatgaaggctaaaatggtaagtgagttcagaaagaagtttgatatccccaaaattaggcagatgaatgacgcccatcacgcaatcgacgcgtatctcaacggtgtcgtgtaccacggggctcagctggcctacccaaatgttgatttgttcgactttaacttcaagtgggaaaaagtgcgcgaaaagtggaaagcactgggcgagtttaacaccaagcagaaaagccgagaattattctttttcaagaagctcgagaaaatggaggtctctcaaggagaacggctgatttccaagatcaaacttgatatgaatcattttaagataaactattcacgtaaactggccaatatcccccagcagttctacaaccagacagctgtgagtcctaagaccgccgagttgaagtatgaaagcaataaatcgaacgaggtagtgtacaagggcctcactccatatcaaacatacgttgtcgcaattaaatccgtgaataagaaagggaaggaaaagatggagtatcagatgatcgaccactacgtgttcgatttttacaaattccagaacggaaatgagaaggaactggctctatatctggcccaaagagagaacaaagacgaagtccttgatgcgcagattgtttactctctcaataagggtgacctgttgtatatcaacaatcatccgtgttactttgtgagcaggaaagaggtgataaacgccaagcagttcgagctgacggtagaacagcaattatcactctataatgtcatgaacaataaggagaccaacgtggaaaaactgcttattgagtacgattttatcgctgaaaaggttatcaacgagtatcaccattacctgaatagtaaattgaaggagaaacgcgtgcggactttcttttccgaatctaaccagacacacgaggacttcattaaggcactcgatgaactgtttaaagtcgtgaccgccagcgctacaagatccgacaagataggctcaaggaagaatagcatgactcaccgagccttcctagggaaaggaaaggacgttaaaatcgcatacaccagtatttctggcctgaagacgaccaaacccaagtccctttttaagctcgcggagagccgcaacgaactgtga

SEQ ID NO: 2956 - RNA, 4005 nt, synthetic construct
  misc_feature 1..4005: note = Cas9 variant
  source 1..4005: mol_type = other RNA
atgaagaacccctacaccatcggcctggacattgggacaaatagcgtgggatgggccgtcctcactgatcagtatgaccttgttaaaagaaagatgaaagtggctggtaactccgataagaaacaaataaagaagaatttctggggcgtaaggctgtttgacgagggggaaacggcagccgatcggcgcatgaaccgaaccgcgcgtagaaggatcgagcggcgcagaaataggatttcttacttgcaggaaatcttcgctttagagatggccaacattgacgcaaactttttctgccggctgaatgattcattttatgtggacagtgaaaaacgcaatagccgacaccctttctttgccacaatcgaggaggaagtcgcttaccataagaactatagaactatataccacctaagggaggaactcgttaattcctctgagaaagcagatctgcggcttgtgtatctggccttggctcatatcattaagtaccgtggaaacttcctcatcgagggcgccctggacaccaaaaatacatcggtggatggtgtctacaagcagtttattcagacctataaccaagtgttcatctcaaatatagaagaggggactctggcgaagatggaagagaacacaaccgtagcagacattctcgccggaaaatttacgcgcaaggaaaaattagagagaatcctgcagctttacccaggcgaaaagagcactggcatgttcgctcagtttattagtttgatcgttgggtccaaaggaaacttccagaaggtgttcgatctggtcgagaaaaccgacatcgagtgtgccaaggactcttatgaagaggatctagaagcactcctggctattataggtgacgagtacgccgagctttttgtggcggccaagaatacatataacgcagtggtcctgagctccatcattactgttaccgatacagaaaccaatgctaaattgtcagccagtatgatcgagaggttcgacgctcacgaaaaggatctccgggagctgaaagcctttataaagttacatctgccgaaacaatacgaagagattttcagcaacgtggcaatcgacggctatgccgggtacatcgatggaaagacgaagcaggtagacttttacaaatatctcaagactcttctggagaatattgaaggcgctgattacttcatcgcgaaaattgaggaagagaactttttgcgaaagcagcgcacattcgacaatggtgcaataccccaccagctacacctggaggaactcgaggccatcctgcatcaacaggctaaatattacccatttttcaaggaagcctatgataagattaaatctcttgtgacctttagaatcccttacttcgtcgggcccctggcaaacggacagtccgactttgcctggttgactaggaaggctgacggcgagatccggccttggaatattgaagagaaagtggatttcggcaagtcagccgttgacttcatagagaaaatgacaaacaaggatacctatctcccaaaggaaaatgtgctgcccaaacacagcttatactaccaaaagtatatggtctacaacgagctgacgaaagtgcgctatatcgacgatcaggggaagaccaattactttagtggacaggaaaaacagcaaattttcaacgactattttaagaaaaagagaaaggtatctaaaaaggatctagagcagttcctcaggaatatgtcccatatcgaaagccctacaattgagggtctggaggactcgtttaactcttcctacgcaacttatcacgatcttttgaaagttggcatcaagcaggaagtgctggagaacccactcaataccgaaatgctggaggacatagtcaaaatccttacagtgttcgaagataagcgtatgattaaggagcagctgcaacagttttcagacgtcttggatggggcggtgctcaaaaagctggagcggcgacactacactggatggggcagattaagtgctaaactgctagttggtatcagggacaagcagagccatctcaccattctggactaccttatgaacgatgacgggttgaatcgcaacctgatgcagctcatcaatgattccaacctgtctttcaaaagcataattgaaaaggagcaagtgtcaacaaccgacaaggatttacagagtatcgtagccgacctggcaggctccccggccattaaaaagggaatccttcagagcttgaaaatagtcgatgaactcgtgtctatcatgggctatccccctcagactattgttgtggagatggctcgggagaatcaaacgacagtcaaggggaaaaacaattcaagaccaaggtacaagagtctggaaaaggccatcaaagagtttggaagccagattctaaaggaacaccccaccgacaaccaggagctgcgcaataaccgactctatctgtactatcttcaaaatggtaaagatatgtacactggccaggaattggacatccataacctgtccaattatgatatagaccacattgtgcctcagtctttcatcaccgataactcgatcgacaacttagtactcacaagctccgcagggaatcgggagaagggagacgatgtgccacccctggagattgttcgtaaaagaaaggtcttttgggaaaaacttttccagggcaacctgatgtcaaagaggaagtttgactacttgaccaaagctgagcgcggtgggctcactgaagccgataaggcgacattcatccatcggcaactggtggagacgagacagattaccaaaaatgtggccaacatactacaccagaggttcaataacgaaactgacaatcacggcaacaatatggagcaggtccgaatcgttatgctgaagagtgctctcgtgtctcaatttcgcaaacagttccagctgtacaaggtgcgggaggtaaacgattatcatcacgcacatgacgcctaccttaatggagtcgtggctaacacattgctgaaggtttatccgcagttagaacctgagtttgtgtacggcgaatatcaccaattcgattggtttaaagccaataaggcaaccgcgaaaaagcagttctacacaaacattatgctctttttcgcccagaaagagagaatcattgacgaaaatggggagatcctgtgggataagaagtatcttgagactatcaaaaaggtcctggactacaggcaaatgaacatagtgaaaaagaccgaaattcagaaaggagagtttagcaaggctacgatcaagcccaaaggtaactcctcaaagctaattccacgtaaagaaaattgggatcctatgaagtacggcgggctcgacagccccaacatggcctatgcagttatcatagagcacgctaaaggaaagaagaaagtggtattcgagaagaaaattatccgcatcaccattatggaacggaaggcctttgagaaagacgaaaagtctttcctggagaaacagggctacagacagccaaaggtcttgacaaagctgcccaaatatactttatacgaatgcgagaatggtaggcgacggatgctcgcatccgccaacgaggctcaaaaggggaatcagcaggtcctgaaaggccagcttataaccctgttgcatcacgcgaagaactgtgaagccagtgatggaaaaagcctcgactatatcgagtctaatcgcgaaatgttcggcgagctgctagcacatgtgtccgaatttgctaagagatacacactggccgatgccaacctttcaaagattaatcaactcttcgagcagaacaaagacaatgatatcaaggtgattgctcagagttttgttaacctgatggcattcaatgccatgggggcgcctgctagctttaaattctttgaggccactatcgaaaggaagcggtataccaacttgaaagagctgttatcggcaacgataatctaccagtccattacaggactctacgaagcccgaaagagactggacggctga

SEQ ID NO: 2957 - RNA, 4005 nt, synthetic construct
  misc_feature 1..4005: note = Cas9 variant
  source 1..4005: mol_type = other RNA
atgaagaacccctacaccatcggcctggacattgggacaaatagcgtgggatgggccgtcctcactaaccagtatgatcttgttaaaagaaagatgaaagtggctggtaattccgacaagaaacaaataaagaagaacttctggggcgtaaggctgtttgatgacgggcagacggcagtggatcggcgcatgaatcgaaccgcccgtagaaggatcgagcggcgcagaaacaggatttcttacttgcaggaaatcttcgcggtcgagatggctaatattgacgccaactttttctgccggttaaatgattcattttatgtggacagtgaaaaacgcaacagccgacaccctttctttgcaacaatcgaggaagaggttgcctaccatgataattatagaactatataccacctgagggaggagctagtgaactcctctgaaaaggctgacctccggctggtctatcttgcactggcccatatcattaaataccgtggaaatttcttgatcgaaggcgctctcgataccaagaacacatcggtggacgaggtatacaaacagtttattcaaacctataatcaggttttcatgtcaaacatcgaggaaggtgccctggcgaaggtggaggaaaacctggaggtcgcaagcatactcgccgggaagtttactcgcagagaaaaattcgagaggattttacggctgtacccaggagagaagagtacaggcatgtttgctcagttcatctcccttattgtgggcaataaagggaacttccagaaggtgtttaatttggtcgagaaaaccgatatcgaatgtgccaaggactcttatgaagaggacctggaagcactactcgctatcattggagatgagtacgccgagctgttcgttgcggccaaaaacacgtataatgcagtggtacttagctccataatcactgtgaccgctacagaaactaacgccaagctgtcagctagtatgattgagcgatttgacgcccacgaaaaggatttgggtgagctcaaagcattcatcaagctgcatttaccgaaacaataccaggaaatatttaataacgccgctattgacggctatgcggggtacatcgatggaaagaccaaacaggtcgacttctacaagtatctgaagacaaccctcgagaatgtggagggcgcagattactttatcacgaaaattgaagaggaaaacttccttcgcaagcagagaacttttgacaatggtgttatcccccaccaactgcacttggaggagctagaagccattctgcatcagcaggctaaatattaccctttcctcagggaggattatgaaaagataaaaagcctggtgacatttcggatcccatacttcgtcgggccccttgccaagggacaatctgagtttgcatggctgacccgcaaggccgacggcgaaattagaccttggaacatcgaggagaaagtggatttcggcaagtccgctgtagacttcatcgagaaaatgactaataaggacacatatttgccaaaagaaaacgttctccccaagcactcactgtgctaccagaagtacatggtgtataatgaattaaccaaagtcaggtacattgatgaccaggggaagacgaactattttagcggacaggagaaacaacagatattcaacgatctgtttaagcagaaacgtaaggtgaaaaagaaggacctagaactcttcctgcggaatatcaaccatattgagagtcctaccatcgagggtcttgaagattcttttaatgcctcctacgcaacatatcacgacttgctgaaagtcggcatgaagcaggagagcctcgattcgccactgaacgcggaaatgcttgaggacattgtgaaaatcctgactgttttcgaagataagcgaatgataaaagagcaattgcagcagttttctgacgtgctcgatggggtagtcctgaagaagttagagagaaggcactacaccggatggggccgcctgtccgctaaactactcgtgggtatccgggacaagcagtcacatctgacaattcttgattatttgatgaatgacgacgggctgaacagaaatctcatgcaactgatcaacgatagtaatctgagcttcaaatccattatcgaaaaggagcaggtttctactaccgacaaagatttacagagcatagtggccgaccttgcaggctcaccggccattaagaagggaatcttgcagagtctcaaaattgtcgatgaactggtgtccatcatgggctatccccctcaaacaatagtagtggagatggctagggagaaccagaccactgttaaggggaaaaataacagccgcccacgatacaagtctctagaaaaagccatcaaggagtttggatcacagattctgaaggaacaccccacggacaatcaagagctcaaaaacaatcggctgtacctttactatttgcagaacggtaaggatatctacacaggccaggaactggacattcataacttaagtaattatgatatcgaccacatagtccctcagagcttcattaccgataactccatcgacaatctcgtgctgacttcttcggcagggaaccgtgagaaaggaggcgatgtgccaccccttgagatcgtcagaaagaggaaagtgttttgggaaaagctgtaccaaggtaatttgatgagcaaacgcaagttcgactatctcaccaaggctgagagagggggcctgacagacgccgataaagcgcggtttattcataggcagctagttgaaacccgacagatcactaagaacgtggccaatattctgcaccagcgcttcaacaatgagacagacaactacggaaatacgatggaacaagtacggatagtcaccctcaaatccgctctggtgtcacagttcagaaagcagtttcagctttacaaagttagggaggtgaacgattatcaccatgcacacgacgcctacttgaatggcgtcgtggctaacactctgttaaaggtttatccgcaactcgagcctgagttcgtgtacggggaatatcatcagtttgattggttcaaggccaataaagcaacagcgaagaaacagttttacaccaacatcatgctgttctttgcccaaaaggaacgtattatcgacgagaacggagaaattctttgggataaaaagtatctggagacaatcaagaaagtactagactaccgccagatgaatatagtcaagaaaactgagatccagaagggtgagttcagtaaagctaccattaagcccaagggcaactctagcaaactcatcccacggaaggaaaattgggatcctatgaaatacgggggactggactcccccaacatggcctatgcagtgattatcgaacacgctaagggcaaaaagaagatagtgattgagaaaaagttgatccagatcaatattatggagagaaaaatgtttgaaaaggatgaggaagccttcctggaggaaaaaggttacaggcacccaaaggtcttaacgaaactccccaagtataccctgtacgagtgtgagaaggggcgacggcgcatgcttgcatcagccaacgaagctcaaaaaggcaatcagctggttttgagcaaccatctcgtgtctctgctatatcacgcgaagaattgcgaggcctccgacggaaaaagtctgaagtacatagaagcacatagagaggcttttagcgaacttctcgcccaggtatctgagttcgccacaaggtatactctggctgacgcaaacttgtccaaaatcaataacctgttcgagcagaataaggaaggcgatattaaggccatcgcgcaatcatttgtggacttaatggtcttcaacgctatgggggcccctgcaagttttaaattctttgaggccaccattgatcggaagcgatacacaaatctcaaagaactgcttagctcgactatcatataccagtccatcaccggactgtatgagtctagaaagcgcttggacgattga

SEQ ID NO: 2958 - RNA, 4005 nt, synthetic construct
  misc_feature 1..4005: note = Cas9 variant
  source 1..4005: mol_type = other RNA
atgaagaacccctacaccatcggcctggacattgggacaaatagcgtgggatgggccgtcctcactgatcagtatgaccttgttaaaagaaagatgaaagtggctggtaactccgataagaaacaaataaagaagaatttctggggcgtaaggctgtttgacgagggggaaacggcagccgatcggcgcatgaaccgaaccgcgcgtagaaggatcgagcggcgcagaaataggatttcttacttgcaggaaatcttcgctttagagatggccaacattgacgcaaactttttctgccggctgaatgattcattttatgtggacagtgaaaaacgcaatagccgacaccctttctttgccacaatcgaggaggaagtcgcttaccataagaactatagaactatataccacctaagggaggaactcgttaattcctctgagaaagcagatctgcggcttgtgtatctggccttggctcatatcattaagtaccgtggaaacttcctcatcgagggcgccctggacaccaaaaatacatcggtggatggtgtctacaagcagtttattcagacctataaccaagtgttcatctcaaatatagaagaggggactctggcgaagatggaagagaacacaaccgtagcaaacattctcgccggaaaatttacgcgcaaggaaaaattagagagaatcctgcagctttacccaggcgaaaagagcactggcatgttcgctcagtttattagtttgatcgttgggtccaaaggaaatttccagaaggtgttcgacctggtcgagaaaaccgatatcgagtgtgccaaggactcttatgaagaggacctagaagcactcctggctattataggtgatgagtacgccgagctttttgtggcggccaagaacacatataatgcagtggtcctgagctccatcattactgttaccgacacagaaaccaacgctaaattgtcagccagtatgatcgagaggttcgatgctcacgaaaaggacctcagcgagctgaaagcctttataaagttacatctgccgaaacaatacgaagagattttctctaatgtggcaatcgatggctatgccgggtacatcgacggaaagacgaagcaggtagatttttacaaatatctcaagactcttctggagaacattgaaggcgctgactacttcatcgcgaaaattgaggaagagaactttttgcggaagcagcgaacattcgataatggtgcaataccccaccagctacacctggaggaactcgaggccatcctgcatcaacaggctaaatattacccttttcttaaggaagcctatgacaagattaaatccctggtgaccttccgcatcccatactttgtcgggcccttggcaaatggacagtcagatttcgcctggctcactagaaaggctgacggcgagatcaggccttggaacattgaagagaaagtggactttggcaagagcgccgttgatttcatagagaaaatgacaaataaggacacctatctgccaaaggaaaacgtgttacccaaacacagtctgtactaccaaaagtatatggtctacaatgagctaacgaaagtgcggtatatcgatgaccaggggaagaccaactacttctctggacaggaaaaacagcaaatttttaatgattatttcaagcagaaacgcaaggtatccaagaaagacctcgagcagtttctgagaaacatgagccatatcgaatcgcctacaattgagggtcttgaggattctttcaactcctcatacgcaacttatcacgacttgctgaaggttggcatcaaacaggaagtgctcgagaatccactgaacatggaaatgcttgaggatatagtcaagatcctgaccgtgtttgaagacaaaaggatgattaaggagcaattgcagcagttcagtggggtcctcgatggagcggtgctgaagaaattagagcgtcggcactacacaggctggggtcgactgagcgctaagctactcgttgggatcagagacaaacagtcccatctgactattcttgattacttgatgaatgacgacggcctgaacaggaatctcatgcaactgatcaacgattctaatctgagctttaagtcaataattgaaaaagaacaggtgagtaccacagacaaggatttacagtccatcgtagccgaccttgcaggaagcccggccattaagaaaggcatcttgcagtctctcaagatagtcgatgaactggtgtcaatcatggggtatccccctcaaaccattgttgtggagatggctcgcgagaaccagactacggtcaaaggaaagaataacagtcggccaagatacaaaagcctagaaaaggccatcaaggagttcggttcccagattctgaaagaacaccccacagacaatcaagagctcaggaacaatcgcctgtatctttactatttgcagaacggcaaggatatgtacaccgggcaggaactggacatccataatttatctaactatgatatagaccacattgtgcctcagtcgtttatcactgataacagcatcgacaatctcgtactgacctcctcagcaggaaaccgagagaaaggcgatgacgtgccaccccttgagattgttcggaagcgtaaagtcttctgggaaaagctgtttcaaggtaatttgatgagtaaaagaaagttcgactacctcacaaaggctgagcgcgggggcctgaccgaagccgataaagcgacttttatccataggcagctagtggagacacggcagattacgaagaacgtggccaatatactgcaccagagattcaacaatgaaaccgacaaccacggaaataacatggagcaagtcaggatcgttatgctcaaatctgctctggtgagccagttccgaaagcagtttcagctttacaaagtgcgcgaggtaaatgattatcatcacgcacatgacgcctacttgaacggcgtcgtggctaatactctgttaaaggtttatccgcaactcgaacctgagttcgtgtacggggaatatcaccagtttgattggttcaaggccaacaaagcaacagcgaagaaacagttttacaccaatattatgctgttctttgcccaaaaggagcggatcattgacgaaaacggagagatcctttgggataaaaagtatctggagacaataaagaaagtcctagactacagacagatgaacatcgtgaagaaaactgaaattcagaagggtgagttctccaaagctaccatcaagcccaagggcaattcaagcaaactcattccaaggaaggaaaactgggatcctatgaaatacgggggactggactctcccaatatggcctatgcagttatcatagagcacgctaagggcaaaaagaagattgtgtttgagaaaaagatcatccgtattacgataatggaacgcaaagccttcgagaaggatgaaaaatcctttttggagaagcagggttaccggcaaccaaaagtactgaccaagttacccaagtatacactctacgaatgcgagaacgggagaaggcgaatgctggcaagtgccaatgaggctcagaaaggcaaccagcaggtccttaagggacaactgatcactttgctccatcacgcgaaaaattgtgaagccagcgacggcaagtctctggactatattgagtccaaccgggaaatgttcggggagctactggcacatgtgtcagagttcgctaaacgctacacccttgccgatgccaatctcagtaagatcaaccagctgtttgagcagaataaggacaacgatattaaagtgatcgctcagagcttcgtcaatttgatggcatttaacgccatgggagcgcctgcttcgttcaagtttttcgaggccacaatagaaagaaaaaggtatactaatctgaaggagttactccgggcaaccatcatttaccaatccatcacgggcctgtacgaagcccgaaaaagacttgacggttga

SEQ ID NO: 2959 - RNA, 4005 nt, synthetic construct
  misc_feature 1..4005: note = Cas9 variant
  source 1..4005: mol_type = other RNA
atgaagaacccctacaccatcggcctggacattgggacaaatagcgtgggatgggccgtcctcactgatcagtatgaccttgttaaaagaaagatgaaagtggctggtaactccgataagaaacaaataaagaagaatttctggggcgtaaggctgtttgacgagggggaaacggcagccgatcggcgcatgaaccgaaccgcgcgtagaaggatcgagcggcgcagaaataggatttcttacttgcaggaaatcttcgctttagagatggccaacattgacgcaaatttcttctgccggctgaacgattcattttatgtggacagtgaaaaacgcaatagccgacaccctttctttgccacaatcgaggaggaagtcgcttaccataagaactatagaactatataccacctaagggaggaactcgtgaatagctctgagaaagcagatctgcggcttgtttatctggccttggctcatatcattaagtaccgtggaaacttcctcatcgagggcgccctggacaccaaaaatacatcggtggatggtgtctacaagcagtttattcagacctataaccaagtgttcatctcaaatatagaagaggggactctggcgaagatggaagagaacacaaccgtagcagacattctcgccggaaaatttacgcgcaaggaaaaattagagagaatcctgcagctttacccaggcgagaaaagcactggcatgttcgctcagtttattagtttgatcgttgggtccaaaggaaacttccagaaggtgttcgatctggtcgagaaaaccgacatcgagtgtgccaaggactcttatgaagaggatctagaagcactcctggctattataggtgacgagtacgccgagctttttgtggcggccaagaatacatataacgcagtggtcctgagctccatcattactgttaccgatacagaaaccaatgctaaattgtcagccagtatgatcgagaggttcgacgctcacgaaaaggatctcagcgagctgaaagcctttataaagttacatctgccgaaacaatacgaagagattttctctaacgtggcaatcgacggctatgccgggtacatcgatggaaagacgaagcaggtagacttttacaaatatctcaagactcttctggagaatattgaaggcgctgattacttcatcgcgaaaattgaggaagagaactttttgcggaagcagcgaacattcgacaatggtgcaataccccaccagctacacctggaggaactcgaggccatcctgcatcaacaggctaaatattacccttttcttaaggaagcctatgataagattaaatccctggtgaccttccgcatcccatactttgtcgggcccttggcaaacggacagtcagacttcgcctggctcactagaaaggctgacggcgagatcaggccttggaatattgaagagaaagtggattttggcaagagcgccgttgacttcatagagaaaatgacaaacaaggatacctatctgccaaaggaaaatgtgttacccaaacacagtctgtactaccaaaagtatatggtctacaacgagctaacgaaagtgcggtatatcgacgatcaggggaagaccaattacttctctggacaggaaaaacagcaaatttttaacgactatttcaagcagaaacgcaaggtatccaagaaagatctcgagcagtttctgagaaatatgagccatatcgaatcgcctacaattgagggtcttgaggactctttcaactcctcatacgcaacttatcacgatttgctgaaggttggcatcaaacaggaagtgctcgagaacccactgaataccgaaatgcttgaggacatagtcaagatcctgacagtgtttgaagataaaaggatgattaaggagcaattgcagcagttcagtgacgtcctcgatggggcggtgctgaagaaattagagcgtcggcactacactggatggggccgactgagcgctaagctactcgttggtatcagagacaaacagtcccatctgaccattcttgactacttgatgaacgatgacgggctgaataggaacctcatgcaactgatcaatgattctaacttatcctttaagtcaataattgaaaaagaacaggtgagtacaaccgacaaggatctgcagtccatcgtagccgaccttgcaggcagcccggccattaagaaaggaatcttgcagtctctcaagatagtcgatgaactggtgtcaatcatgggctatccccctcaaactattgttgtggagatggctcgcgagaatcagacgacagtcaaagggaagaacaatagtcggccaagatacaaaagcctagaaaaggccatcaaggagttcggatcccagattctgaaagaacaccccaccgacaaccaagagctcaggaataaccgcctgtatctttactatttgcagaatggtaaggatatgtacactggccaggaactggacatccataacttatctaattatgatatagaccacattgtgcctcagtcgtttatcaccgataacagcatcgacaacctcgtactgacatcctcagcagggaatcgagagaaaggagacgatgtgccaccccttgagattgttcggaagcgtaaagtcttctgggaaaagctgtttcaaggcaacttgatgagtaaaagaaagttcgactacctcaccaaggctgagaggggtgggctgactgaagccgataaagcgacatttatccatcgccagctagtggagacgcggcagattaccaagaatgtggccaacatactgcaccagagattcaataacgaaactgacaatcacggcaacaatatggagcaagtcaggatcgttatgctcaaatctgctctggtgagccagttccgaaagcagtttcagctttacaaagtgcgcgaggtaaacgattatcatcacgcacatgacgcctacttgaatggagtcgtggctaacacactgttaaaggtttatccgcaactcgaacctgagttcgtgtacggcgaatatcaccagtttgattggttcaaggccaataaagcaaccgcgaagaaacagttttacacaaacattatgctgttctttgcccaaaaggagcggatcattgacgaaaatggggagatcctttgggataaaaagtatctggagactataaagaaagtcctagactacagacagatgaacatcgtgaagaaaaccgaaattcagaagggagagttctccaaagctacgatcaagcccaagggtaactcaagcaaactcattccaaggaaggaaaattgggatcctatgaaatacggcgggctggactctcccaacatggcctatgcagttatcatagagcacgctaagggaaagaagaaggtggtatttgagaaaaagattatccgtatcaccattatggaacgcaaagccttcgagaaggacgaaaaatcctttttggagaagcagggctaccggcaaccaaaagtcctgacaaagttacccaagtatactctctacgaatgcgagaatggtagaaggcgaatgctggcaagtgccaacgaggctcagaaagggaatcaacaggtgcttaagggccagctgataaccttgctccatcacgcgaaaaactgtgaagccagcgatggaaagtctctggactatatcgagtccaatcgggaaatgttcggcgagctactggcacatgtgtcagaatttgctaaacgctacacacttgccgatgccaacctcagtaagattaatcagctgtttgagcagaacaaggacaatgatatcaaagtcattgctcagagcttcgttaacttgatggcatttaatgccatgggggcgcctgcttcgttcaagtttttcgaggccactatcgaaagaaaaaggtataccaacctgaaggagttactctccgcaacgataatctaccaatctattacaggactgtacgaagcccggaaacgacttgacggctga

SEQ ID NO: 2960 - RNA, 4005 nt, synthetic construct
  misc_feature 1..4005: note = Cas9 variant
  source 1..4005: mol_type = other RNA
atgaagaacccctacaccatcggcctggacattgggacaaatagcgtgggatgggccgtcctcactaaccagtatgatcttgttaaaagaaagatgaaagtggctggtaattccgacaagaaacaaataaagaagaacttctggggcgtaaggctgtttgatgacgggcagacggcagtggatcggcgcatgaatcgaaccgcccgtagaaggatcgagcggcgcagaaacaggatttcttacttgcaggaaatcttcgcggtcgagatggctaatattgacgccaactttttctgccggttaaatgattcattttatgtggacagtgaaaaacgcaacagccgacaccctttctttgcaacaatcgaggaagaggttgcctaccatgataattatagaactatataccacctgagggaggagctagtgaactcctctgaaaaggctgacctccggctggtctatcttgcactggcccatatcattaaataccgtggaaatttcttgatcgaaggcgctctcgataccaagaacacatcggtggacgaggtatacaaacagtttattcaaacctataatcaggttttcatgtcaaacatcgaggaaggtgccctggcgaaggtggaggaaaacctggaggtcgcaagcatactcgccgggaagtttactcgcagagaaaaattcgagaggattttacggctgtacccaggagagaagagtacaggcatgtttgctcagttcatctcccttattgtgggcaataaagggaacttccagaaggtgtttaatttggtcgagaaaaccgatatcgaatgtgccaaggactcttatgaagaggacctggaagcactactcgctatcattggagatgagtacgccgagctgttcgttgcggccaaaaacacgtataatgcagtggtacttagctccataatcactgtgaccgctacagaaactaacgccaagctgtcagctagtatgattgagcgatttgacgcccacgaaaaggatttgggtgagctcaaagcattcatcaagctgcatttaccgaaacaataccaggaaatatttaataacgccgctattgacggctatgcggggtacatcgatggaaagaccaaacaggtcgacttctacaagtatctgaagacaaccctcgagaatgtggagggcgcagattactttatcacgaaaattgaagaggaaaacttccttcgcaagcagagaacttttgacaatggtgttatcccccaccaactgcacttggaggagctagaagccattctgcatcagcaggctaaatattaccctttcctcagggaggattatgaaaagataaaaagcctggtgacatttcggatcccatacttcgtcgggccccttgccaagggacaatctgagtttgcatggctgacccgcaaggccgacggcgaaattagaccttggaacatcgaggagaaagtggatttcggcaagtccgctgtagacttcatcgagaaaatgactaataaggacacatatttgccaaaagaaaacgttctccccaagcactcactgtgctaccagaagtacatggtgtataatgaattaaccaaagtcaggtacattgatgaccaggggaagacgaactattttagcggacaggagaaacaacagatattcaacgatctgtttaagcagaaacgtaaggtgaaaaagaaggacctagaactcttcctgcggaatatcaaccatattgagagtcctaccatcgagggtcttgaagattcttttaatgcctcctacgcaacatatcacgacttgctgaaagtcggcatgaagcaggagagcctcgattcgccactgaacgcggaaatgcttgaggacattgtgaaaatcctgactgttttcgaagataagcgaatgataaaagagcaattgcagcagttttctgacgtgctcgatggggtagtcctgaagaagttagagagaaggcactacaccggatggggccgcctgtccgctaaactactcgtgggtatccgggacaagcagtcacatctgacaattcttgattatttgatgaatgacgacgggctgaacagaaatctcatgcaactgatcaacgatagtaatctgagcttcaaatccattatcgaaaaggagcaggtttctactaccgacaaagatttacagagcatagtggccgaccttgcaggctcaccggccattaagaagggaatcttgcagagtctcaaaattgtcgatgaactggtgtccatcatgggctatccccctcaaacaatagtagtggagatggctagggagaaccagaccactgttaaggggaaaaataacagccgcccacgatacaagtctctagaaaaagccatcaaggagtttggatcacagattctgaaggaacaccccacggacaatcaagagctcaaaaacaatcggctgtacctttactatttgcagaacggtaaggatatctacacaggccaggaactggacattcataacttaagtaattatgatatcgaccacatagtccctcagagcttcattaccgataactccatcgacaatctcgtgctgacttcttcggcagggaaccgtgagaaaggaggcgatgtgccaccccttgagatcgtcagaaagaggaaagtgttttgggaaaagctgtaccaaggtaatttgatgagcaaacgcaagttcgactatctcaccaaggctgagagagggggcctgacagacgccgataaagcgcggtttattcataggcagctagttgaaacccgacagatcactaagaacgtgacaaatattctgcaccagcgcttcaacaatgagacggacaactacggaaataccatggaacaagtacggatagtcactctcaaatccgccctggtgtcacagttcagaaagcagtttcagctttacaaagttagggaggtgaacgattatcaccatgctcacgacgcatacttgaatggcgtcgtggccaacacactgttaaaggtttatccgcaactcgagcctgagttcgtgtacggggaatatcatcagtttgattggttcaaggctaataaagccaccgcaaagaaacagttttacacaaacatcatgctgttctttgcgcaaaaggaacgtattatcgacgagaacggagaaattctttgggataaaaagtatctggagactatcaagaaagtactagactaccgccagatgaatatagtcaagaaaaccgagatccagaagggtgagttcagtaaagccacgattaagcccaagggcaactctagcaaactcatcccacggaaggaaaattgggatcctatgaaatacgggggactggactcccccaacatggcttatgccgtgattatcgaacacgcaaagggcaaaaagaagatagtgattgagaaaaagttgatccagatcaatattatggagagaaaaatgtttgaaaaggatgaggaggctttcctggaagaaaaaggttacaggcacccaaaggtcttaaccaaactccccaagtatacactgtacgagtgtgagaaggggcgacggcgcatgcttgcctcagcaaacgaagcccaaaaaggcaatcagctggttttgagcaaccatctcgtgtctctgctatatcacgctaagaattgcgaggcgtccgacggaaaaagtctgaagtacatagaagcccatagagaggcatttagcgaacttctcgctcaggtatctgagttcgccactaggtataccctggccgacgctaacttgtccaaaatcaataacctgttcgagcagaataaggaaggcgatattaaggcaatcgcccaatcatttgtggacttaatggtcttcaacgcgatgggggctcctgccagttttaaattctttgaggcaacaattgatcggaagcgatacactaatctcaaagaactgcttagctcgaccatcatataccagtccatcacgggactgtatgagtctagaaagcgcttggacgattga

SEQ ID NO: 2961 - RNA, 4005 nt, synthetic construct
  misc_feature 1..4005: note = Cas9 variant
  source 1..4005: mol_type = other RNA
atgaagaaagagtacaccatcggcctggacattgggacaaacagcgtgggatgggccgtcctcactgaaaattatgatcttgttaagaaaaagatgaaagtgtacggtaacacggagaccaagtatctgaagaaaaatttgtggggcgtaagattattcgacgaaggggagacagctgcagataggcggctgaagcgcactacccgacgtagatactccaggcggcgcaacagaatatgcaggctacaggacctctttacagaagagatgaatcaagtggatgccaacttctttcaccggctgcaggagtctttccttgtccccgacgaaaaagagtttgaacgccatgcgatcttcggaaagatggaggaggaagtgtcatattaccgagagtttcctaccatttatcacctgagaaaacatttggctgatactagcgaacaggccgacctcaggctggtttacctggcactcgcccacatcgtgaagtaccggggccatttcttaattgagggtgaactgaatacagagaacagctccgtctctgagacctttcgtacgttcatccaggtgtataatcaaatatttcgcgaaaacgaggtaccacttgctgttccggataatatcgaagagttgttctcggaaaaggtgtcaagagcaaggaaagtcgaggccattctgagcgtgtacagtgaggaaaagtccactgggaccctagctcagtttctcaaactgatggtgggaaaccagggccggttcaagaaaacattcgaccttgaggaagatggcatcattcagatccccaaggaggaatatgaggaggaactggagactttgctcgccataattggggacgaatacgcggagatcttttctgcaaccaaaagcgtctatgatgccgttgctctgtccggaattttatcagtgacagacggtgacaccaaggccaagctgagtgcaagcatggtagagcgatacgaagctcaccaaaaagatctcgtgcagttcaagcagtttatccgcaaagagcttcctgaaatgtatgccccaatcttcagagacaattctgtctccggctacgcggggtacgtggagaactcaaaggttgtgacgcaggccgaattttataaatacattaagaaggcaatagagaaagtccccggagctgagtatttcctggaaaagatcgagcaagaaactttcttggataaacagaggacattcaataacggcgtgattcctcaccagatccatctagaggaactggaggccataattcaaaagcaggctacctactatccatttctcgccgacaacaaagaggaaatgaagcagctggtaactttccggatcccctactatgttggtcctcttgcagatgggaatagcccatttgcctggctggagcgcatcagttctgaaccgattagacccggaaacttggctgaggtggtcgacatcaagaaatccgcgacaaagttcattgaaaggatgaccaattttgatacgtacctccctaccgagaaagtgctgccaaagcacagcatgatatacgagaaatatatggtctacaacgaattaacaaaggtgtcgtatgttgacgagcgtggcatgaatcagcggttctctggcgaagagaagaaacaaatcgtggaggaactgttcaagcagtcccgaaaagtaactaagaaactactcgagaagtttctgtcaaacgaatttgggcttgtcgatgtggcaattaaaggaatcgagaccagttttaatgccggttacggcacatatcatgacttcttgaagatcgggattactagagaacagctggataaggaggagaacagcgaaaccctcgaggaaatagttaaaatcctgacagtgtttgaggacaggaagatgattcgcgaacagcttaaaaagtacacctatctgttcgacgaggaggtcttgaaaaagctcgaacggagacactacactggatggggcaggctgtccgctaagttactgatcggtattaaagagaagcgcacgcacaaaacaatcctagattacctcatagaagacgatgggggcaagcaacccatcaatcgaaacctgatgcagcttattaatgactctgatttgagctttaaatcagagatcgccgaagcacagagtgacatgaacaccgaggatctgcatgaggtggtacagaatctcgccggatcccctgctattaagaagggcatcctgcaaagtttaaaaatagtggacgaactggttgatattatggggtctcttccaaagaacatcgtcgtggagatggcccgggaaaatcagactacctcacgtggaagaacaaacagtaaccccaggatgaaagcattggaggaggcgatgcgcaatctccggagcaacctgctaaaggaatatccgaccgacaatcaggctctgcagaacgatagactctacctgtattaccttcaaaatggtaaagacatgtatactggcttggatctgtccttacacaacctctcttcgtacgacattgaccatatcgtgcctcagagcttcacaacggataattccctggacaacagggtccttgtttcaagtaaggagaatcgagggaagaaagatgacgtgccctctaaggaagtggtacagaaaaacataaccctgtgggagactttgaagaatagcaacctcatctcccaaaagaagtatgataatctgacaaaaggactacgcggcggtctgaccgaagacgatcgggcccactttattaagagacagctcgtcgagacaaggcagatcactaagcatgtggcacgtattctggaccagcgcttcaactcacaaaaagatgaggaagggaagaccatccgggccgttagagtggtcacgcttaaaagctctttgacctcccagtttaggaagcagttcgctatacacaaagtgcgagagattaatgactaccaccatggccacgatgcctacctgaacggagttgtggcaaacagtttactccgggtatatccacagctgcaacctgaatttgtctacggcgactatcccaagttcaatgcttacaaggccaacaaagcgacagccaagaaacagctttatactaatatcatgaagttctttgctgaggatgcagtgatcattgacgaaaacggggagatcctgtgggacaaaaagaatattgccaccgtgaagaaagtcatgagctacccacagatgaacatagttaagaaacccgagatccagacaggatctttctccaaggaaactattaaacctaagggtgattcagacaagctaatcagtcgcaaaaccaattggagcccaaagctctatggcgggtttgattcgccgcaagtggcttactccgtaattatcacgtacgagaaaggaaagaaaaaggtgagagccaaggcaatagtcggcatcacaattatggaacagtctctgttcaaaaaggaccccgtgagcttgctggaggaaaaaggttatgcgaaccctgaggttttaatccatctcccaaagtacaccctgtatgagcttgaaaatgggaggcggcgactgttggcctcagctaacgaggcccagaaaggcaatcaactcgtgctgcccgcaagtctagtcactctgctttaccacgctaaacaggtggatgaagactccggaaaatctgaggagtatgttagagaacaccgcgccgagtttgcagaaattctcaactacgtgcaggccttcagcgagacaaagatcctggctaataagaacttgcagaccatactgaaattatatgaagagaataaggaggcggatattaaagaaatcgccgagtcctttgtcaacctcatgaagttctcagcatacggcgctcctatggactttaaattctttgggaagactatcccaaggagccgttacaccagtgtaggagaactgctttctgccacaattataaaccaatccatcacgggcctgtatgagacccggagaaagttggtggattga

SEQ ID NO: 2962 - RNA, 4005 nt, synthetic construct
  misc_feature 1..4005: note = Cas9 variant
  source 1..4005: mol_type = other RNA
atgagaaagccctacaccatcggcctggacattgggacaaacagcgtgggatgggccgtcctcactgatcagtataatcttgttaaaaggaagatgaaagtggctggttccgcagagaagaaacaaataaagaagaacttctggggcgtacggctgtttgacgaaggggaggtggccgcgggacgccgaatgaatcgtacgaccagaaggcggatcgaacgcagaaggaaccggattgcttacttgcaggagatcttcgccgcagaaatggccgaggtcgatgctaatttcttctatcgcttagaggactctttttacattgaatcagagaaacgacacagtagacatcctttctttgcaacaatcgaagaggaggtggcctatcacgaagagtacaagactatatatcatctgagggaaaagctagttaacagctccgataaagctgacctccggctggtgtaccttgccctggcgcacatcattaaataccgtggcaatttcttgatcgagggtatgctcgataccaagaacacatctgtcgacgaagtgtttaagcagttcattcagacctataatcaaatctttgcatcggatatagaggaggggtcactgactcgcctggaagagaacaaagaagtagccgagattctcagcgaaaagttaacaagaagggagaaactggacaagatccttaaattgtacaccggagagaagagtacgggcatgttcgctcggtttattaatctgatcatcggctccaaaggggatttcaagaaggttttcgacctagatgaaaaagccgagattgaatgcgcaaaggacacttatgaggaagacctcgaggctctgcttgccaaaataggagatgagtacgcggaaatctttgtggccgcaaagtctacctataacgctgtcgtgctgagcaatattatcacagtgactgacaccgagacaaaagccaagttgtccgcttcaatgatagaacgattcgataagcatgccaaagacctcaagcgcctgaaagcatttttcaagatgcagttaccagagaaatttaacgaggtcttcaatgatattgaaaaggacggttacgccggctatatcgatgggaagaccacgcaggagaaattttacaagtacatgaaaaagatgctggctaacatcgacggagcggattatttcattgaccagatcgaagaggaaaactttctcagaaaacaaaggactttcgataatggcacaattccgcaccagcttcacctggaggagttggaagcaatactacatcagcaggccaagtactatccctttctgcggaaggactacgagaaaatccgcagtctcgttaccttcagaatcccttattttattggtccactggctaacgggcaaagcgacttcgcctggcttactaggaaggcagatggagaaatccgtccctggaatattgaggaaaaagtggacttcggcaagtctgccatagattttatcgagaaaatgacaaacaaggacacctacctgcctaaagagaatgtattgccaaagcactccctctgttatcagaagtacatggtgtacaacgaactgacgaaaattcggtatatcgatgaccagggcaagacccatcacttctcagggcaagagaaacagcagatttttaatggattattcaagcagcaacgaaaagtcaagaagaaagatctggaaagatttctatacacaatcaaccacatagagagccccactatcgaaggtgtggaggacgctttcaatagttcttttgccacctatcatgatctccagaagggcggggttacacaggagattctggacaaccctcttaatgcagatatgttggaagagatcgtgaaaattctgactgtcttcgaagacaagaggatgatcaaagagcagctccaatcctttagcgatgtgctggacggaaccatacttaagaagctggagcgccggcactacacaggctggggtagattgtcggcgaaactcctgaccgggattagggacaagcattctcacttaactatcctggattatctaatgaacgacgatggcctcaatcgcaacctgatgcagcttattaatgactccaacttgtcattcaaaagtatcatagaaaaggagcaggtaagcacggctgataaaggaatccagtccattgttgccgaactggcaggctctccagccatcaagaaggggattctccaaagcctgaaaatcgtggacgagttagtcggaataatgggttacccgccccagacaattgtggtcgaaatggctcgagagaaccagaccactggcaaggggaaaaataactcaaagcctcggtttatcagtctggagaaagccatcaaggaatttggatcccagattcttaaagagcatccaaccgataatcaatgcttgaagaacgaccgtctctatctgtactacctacagaatggcaaggatatgtatacaggtaaagaactggacatccacaacctcagcaattacgatattgaccacataatcccccagtcttttattaccgataactcaatcgacaatagagtgctggttagtagcactgcaaacagggagaagggggacaatgtgcctcttttggaagtagtccgcaaacggaaggctttctgggagaaactgtatcaagccaagttaatgtccaagagaaaattcgattacctcacaaaggcggagaggggcggactgacggaagccgacaaagctaactttattcagcgacagcttgtggagacccgccagatcactaagaatgttgcaaacatactgtatcaacggttcaattgtaaacaggatgaaaacggcaacgaggtggaacaggtcagaatcgtgacattgaagtctaccctcgtatcgcagtttaggaagcaattccagctgtacaaagtgcgtgaggttaatgactatcatcacgcccatgatgcttacctaaacggggtcgtggccaatacactgctcaaggtgtacccacagctggagcccgaatttgtctatggagactaccaccagttcgattggtttaaagcaaacaaggcgactgccaaaaagcaattctataccaatattatgcgctttttcgctaaggagaaccagatcattgacaaaaatggtgaaatcctttgggataaccggtacttggacacgataaagaaagttctgagctatagacagatgaatattgtgaagaaaaccgagatccaaaagggcgagttttccaacgccacagtgaatccgaaggggaactcaagtaaattaatctctaggaaggcagattggaatcctattaaatacggaggcttcgacggtagcaacatggcttattccatagtaatcgaatacgagaagcggaaaaagaaaactgtcattaagaaggaactcatccagattaatatcatggagcgagtggccttcgaaaaagaccagaaggcatttctggaggagaaagggtactattcacccaaggttcttaccaaaataccaaagtacacactgtatgaatgcgagaacggccgcagaaggatgctaggaagcgccaacgaagctcagaagggcaatcaaatggtgctccctaaccacctgatgactttgctgtaccatgcgaaaaattgtgaggccaacgatggggaatctttagcatatatcgagatgcaccgggagatgttcgctgaactcctggcctacatttccgagtttgccaagcgatatacccttgctaatgacagactggagaaaatcaacatgttctttgaacagaataagaaaggagatattaaggtcatcgcaaagagtttcgacaaattgaaggtgtttaacgccttcggcgcgccccgcgattttgagttctttgaaacgacaataaaaaggaagcgttactacaatattaaagagctcctgaacgctaccatcatctatcagagcattactggtctatacgaagcccggaagagactggaggactga

SEQ ID NO: 2963 - RNA, 4008 nt, synthetic construct
  misc_feature 1..4008: note = Cas9 variant
  source 1..4008: mol_type = other RNA
atgaagaactacaccatcggcctggacattgggacaaatagcgtgggatgggccgtcataaaagatgacctcactcttgttagaaagaaaatcaagatttccggtaacacggataaaaaggaggtgaagaaaaatctgtggggctctttcttgtttgaacagggggacaccgctcaagatacaagggtaaagcggatcgcacgccgacgttatgagagaaggcggttccgcattagagaattacagaaaatctttgacaagtcaatgggagaggtggatagtaacttctttcacaggctggacgagagcttcctagtcgaggaggataaagaatactccaagtatcccatattttctaatgagaaggaagacaaaaactactatgataagtaccctactatctatcatctccggaaagacctggccgattcgaatcagaaggcggaccttcgcctgatttacttggctctcgcccacatgatcaaataccgaggccatttcctgattgagggtgacctgaagatggatgggatctcaataagcgagagttttcaggagttcattgactcctataacgaagtgtgcgcactcgaagatgagaatttagaaatcatttacaacgacgagctgcttacccaaatcgagaatatctttaaacaggatatttctagaagcaagaagttggaccaggccatagctctgttccagggagttaaaaggcaatccctatttggcatcttcctcacactgattgtgggcaacaaggcaaatttccagaaaatctttaaccttgaagatgacataaagctggatttgaaagaggaagactatgatgagaatctcgaagaactgttatcaaacattgacgaggggtaccgggacgtcttcctgcaggccaagaacgtgtataatgctatcgaactcagtaagatccttaaaaccgatggaaaggagactaaagccccactgagcgcgcagatggtagaattgtacaaccaacaccgtgaggacctaaagaaatataaggattacattaaggcatacctgccggaaaaatatggtgagacatttaaggacgccaccaaaaatggctacgctgggtatatcgatggaaagacgtctcaggaggacttctacaaatttgttaaggcccagctcaagggcgaagagaacggtgaatatttcctggaggcaattgagaatgaaaactttcttcgcaaacaaagatccttctacaatggggtgataccctatcagatccatctgcaggagttgactgctgtcctcgatcagcaagaaaagcactactcatttctgaaagagaacagggacaagattatcagcttactgaccttccggatcccttactatgtgggaccactagccaaaggcgaaagtcgatttgcgtggctcgagcgctctaattccgaggaaaagattaaaccctggaacttcgataagatagtggacatcgataagagcgccgagctgtttattgaaaatcttacatcgagagacacttacttgcctgatgagccagtcctgcccaaaaggtctctcatctatcagaagttcaccattttcaacgaactgacaaaaatctcctacatagacgagcggggcatccttcagaatttttcaagtcgcgagaagattgcaatcttcaacgacctgtttaaaaataagagcaaggttaccaaaaaccagttggtgaagtatattgaaaacaaagagcaaatcatagctcctgaaattaaggggatcgaggattccttcaattctaactacagcacgtatattgacctctcaaaaatcccagatatgaagaagctgttagaaaaagacgaggatgagatactggaagagatcattaagatcctaactatttttgaagacagaaaaatgaggaagcgtcagctcatgaaattcaaggataagctgagtgagaaagccatcaatcagctttccaagaaacactacacaggatggggtcagttgagcgagaagctgataaacggcattcgggacgaacaatctaataaaaccatcctcgattacctgatcgaggacaacgggtgtccgaagaatatgaaccgaaattttatgcagttaattaacgatgacactctgtcattcaaagaaaagatcagaaaggctcaggatattaatcaggtaaacgacataaaagagatcgtgaaggaccttcccggaagtcctgccattaaaaagggcatctatcaaagcattaggatcgtcgatgaaataatccgcaaaatgaaggaccggccaaagaatattgtgatcgagatggcaagagagaaccagacaacccaggaaggtaaaaataagtccaaagccaggttgaagaaaattcaagaggggctcgaaaacctggattctgttcatgtggagaagcaggctctagacgaagagatgctgaagtcgcccaaatactatctctactgcctgcagaacggcaaggatatctatacgggaaaagaccttgatataggccagttgcaaacctacgacattgatcacatcatccctcgcagctttattacagacaattccttcgataacctggtcttaacttcaagtaccgtgaatcgagggaagctcgacaacgtaccatctcccgacatagttcggcagcagaaaggattttggaagcagctgcttcgtgcgggtctgatgagccaaagaaagttcaataacttgacaaaaggcaagctcactgatagggaccgccagcagtttatcaatcggcagctggtggagaccagacaaattacaaaacatgtcgcaaacctactgtcccaccacctcaatgaaaagaaagaggtgggggaaatcaacattgtcctgcttaagtcagccttgaccagccagttcaggaagaaattcgatttttataaggtgcgagaggttaatgactaccatcacgctcatgatgcctacctgaacggagtgatcgcattaaaactcctggaactttatccgtacatggccaaggacctgatatatggcaaatactcttatcaccgcaagatcgagggtgataaagctactcaggccaagtacaagatgtccaatattatcgagcggttcagtcaagacctactcgcaaaccctgatggggaaattgcgtgggagaaagacaaggatctgaatacgatcagaaaagtattgagctctaagcagataaacattatcaaaaaggctgaagagggcaagggaaggctgtttaaagagacaatcaactcccgtccctcaaagaaaaccgaaaagcgcattccaatcaaaaataacttagaccctaatatatatggcgggtacattgaggaaaagatggcctactatatcgcaattaactacctcgagaatggaaagactaaaaaggccatcgtcggtataagtattaaagataagaaagacttcgaaggccagaccacagagtatctggggaagatcggatttaacaaggctagcatcattaattcgttcaaaaactacaccctttttgagctggaaaatggctcccggagaatgatcgtgggtgcctctaaggagaacgacagcaaaggggaattgcagaagggcaatcaaatgtatctcccccagaacctgctagagttcgtttaccatctgaaacactataatgaagatgagacttcacacaagtttattgtggagcataaagcatacttcgacgaacttctcaactacatagtcgagtttgctaataagtatctggaattggagaacagtatcgaaaagattaaagatctgtaccacggaaagggcccagacgtggaggagaaagaattagtagagtccttcatcaatctcctggccatcacaaagtgtgggcccgcggccgatattacgttccttggagagaaaatatctaggaagcgatatcggagcaccaactgcctgtggggctccgaagtgatctttcagtcacctactggtttgtacgagacacgcctcagactggaatga

SEQ ID NO: 2964 - RNA, 4011 nt, synthetic construct
  misc_feature 1..4011: note = Cas9 variant
  source 1..4011: mol_type = other RNA
atggacgataactaccagctgatgcacgccaagggcaaatatgggtacggaaccagaatctatagcgagggtcaaacagctgcagacaggcggggcttccgcactacgcgacgtagactcaataggcggaagtggcgccttagactgttgcaggactttttcgaaccctacattttacctcaggatgaggcctttttcataaggcagaaacaatccaacctggtgccacaggataccaagaaacagtatccggaatctgtcctatttgacgatacatcagacaaggatttctacactgagtatcccaccatctaccatctccggcaggcgctgatgacagaaaatcgccaatttgacattcgagaggtttaccttgctatccaccatattgtgaagtatagagggcacttcctgaacaatgcccctgtaaaaacctttaagagtggaaacttggatctcgcaatcaaattcaatgagctgaacgaagagtttaagagcgtgtacccagacctggaactccagttcaatttagatcagatagacgagatcaaaaagattctgcttgactccactaagtctaggtttgatcggcagggcgaggccgtcaaattgatctatacagtgtcggaagttaagaccattgagaaactgcaaaacaagatcgtgaaacagttcctatcaggtatactcgggctgaatacgcgtttcgacgtccttactaacaccgaaagcgatgacagtatgtggaagttttccctggattctgagagctccgacgatgctttggacgaaattatcgcacagctcgatgaccccgccattcatgtggtagagctggttaatgagatccactcaagtatcacattagctggaattgtgcctgaaggccaaggcctgagcgagtctatggtcgaaaaatacgaggcccacaaggcgcatctccagcttctgaaggcagtggaaaaattggtggataagaaagccgctgacaagctagaggtcgcctatgaccagtacataaacgggaaagattccaagcagttcatcaaggaggacttttataaagcagttcaatcagaaattaagggagtggctggtgatgaggtagccgaaatcaatcagctgatagagctcgaccagttcatgccaaaacagcgcactaaggaaaacggcgcgattccccaccaactgcatcagcacgagcttgatgtgatcatcgagaaccagagcaaatactacgactggctgggggaaaaggtcggaaatgagtataagttggataaactcgtgagttttagagttccttactatgtgggcccactggtcgacaccgcctctaaggagaaaaaggatgaaacaaggttcgcatggatggtgcggaaaaacccggagtccaccgaagctattacgccctggaattttgaggacatcgtagataagaacgccagcgctgaaaatttcattaagcgaatgactacaaaagacaagtacttactgaacgaggatgttctacctaaatgctcgctcctgacccaggactttgaagtgtataatgagcttaacaatatacgcgtcaacggtgagaagttcactgccgaacaaaaacagttgatccacgacgagctgtttacaaagcatgcatctgtgtccattaaacagctcaaggatttcctggtctcagaacttatgtacgtgagagacaatctgaaggttgaggggttggccgatgagaaaaagctcatgagtagcctgtccacccagtttgactatcagaaaatcatcccagatcaaattaacgacgtgaagtacagggaagatatagagcagatcattgaatggtctacgatcttcgaggacgctgcgattttcaaaaccaagttaaaggaaatcgattggctgacagacgagcaacggaataaactagcaaacaagcgctacagaggatggggcagcctctcaaaaaggctgcttgcctgtttggtagatgaaaatggccagcgtataatcgacattctgcgggatagttccgacaactttatgatgatcgtcaaccgacccgagttcaagcaggctatttttgacgagaatgccaacctcactgaaaccaatagcaaaaaggatatgttcgagatgatcgacaacttttatacatctcctcagaataagaaagcaataagacaagtgctgttagttgtgcaggatattcagaacgccatgggaggggtcgctccacagaagatcttcattgaatttgccagggaggacgaggtgaatggtcgccggactaactcaagatacagtcaaatcagggaaatgtatagcaaagtaaccgatgacgtgataaataagacagttcgcggcgagctggaagcaaacaaagggtcccttaataaggagaagttgttcctctactttctgcagggaggcatcgatctatattctggtaaaaccattaacatcgacaatatttcgagctacgatgtcgaccacgtgctgccccagtccttcatcaaggatgactcaataaacaataaagtgctcgtcaacgcgaaggggaaccgagttaaaaatgacaacgtgccgatggaactgtttggcgctaagatgtatcctacttggaaacggatggtggatacgggaattatgagtaaggccaagttcaaaaatcttacattgaaccccgacaatgtagataagtttaaagcagagggcttcatcaaccgtcagctggtcgagaccagacaaatcattaagttagtggcccagatcctcaatgacaaactgggggatgacactaagattgtttctgtgaaggctaaccttacccatgatatgagggtcttctttgacttccctaaaaatcgcaacgtgaataactaccaccatgcctttgatgcatacctgagcgctttcgttggaacatatttgtacaagcggtatccaaaactccagccctactttgtgtatggtgagttcaagaaaatggacaagctgaagaatatgacctcctttgatttcctaagagacctgaaacacactgataaggtagtcgacaaagacacaggcgaaataatcgccgataagctcgcggtgattacgaacatgaataaaatctacgactttaagaaggtgctggtcacccacgaagttcatgagaactcaggggccatgtatgatcaaactctttacccagctaaattggacaagagcctgggaaggaaaggcgcaaagcagttaattcccaaaaaggatgacatgcctacagccctctacggtgggtataccggctctaaggatgctttcatgtccatcgtgcgactgaaaaagaaagacgaagtatactataaggtgataggaatcccagtccgcattgccgatagtgtgcagcacggcaaagaggttgacgtggaggcacttacacagtttatcgaaactaagttcaccaaagagaacctgaataagaagacgggggaaattacccggaaagtcgagtggttcgagctagtgctcccgaaggttctgtttggacaagcggtgttcgatggtggccagccctttatgttggggagctctacataccctcataacctgagagaattagtcctcactaaagactccgtaaagaaaatcgccggaaaggagtcaaataagagttatctggatgcttacgacgaaataatggaggccatgaacaaatatttcccactttacgacaccaataagtttagggaaaaagtgattgagggccgtagcaagttcatcgatctgcccgacaaagatgagtacgaaaacaataagttggttcaggtgggtaagtcgacaatcattgaccgcatgtttatagggctccacgcaaacgctgcccggactgatctgaaaaatatcggcattaccacgcctttcggatttatgcagcaagcatccggcatcaagctaacaaaagacaccgtcgtgctgttccagtctagcactgggctttttgagagaaaggtagccctcaaagatctgtga

SEQ ID NO: 2965 - RNA, 4011 nt, synthetic construct
  misc_feature 1..4011: note = Cas9 variant
  source 1..4011: mol_type = other RNA
atgaccaaggactacacaatcggcctggatattgggactaacagcgtgggatgggccgtcctcacggacgattatcagcttatgaaaagaaagatgtccgttcacggtaataccgagaaaaagaaaataaagaagaacttctggggcgctaggctgtttgacgaagggcaaacagcagagttccggcgcactaaacgaaccaatcgtagaaggttggcccggcgcaagtacagattatctaaactgcaggatctatttgcggaggaactctgcaagcaggacgattgtttctttgtgaggctggaagagtcattccttgtacccgaggaaaaacagtataagcctgctagtatctttccaacactggaggaagagaaggagtactatcaaaaatacccgaccatttatcatttgcggcagaagctcgtggacagcactgaaaaagaggatctgcgcctggtctacctcgccttagcacatctgcttaagtaccgaggacacttcttgtttgaaggctatctggacacagagaacacctccatcgaagagtctttcagagtgtttctagagcagtacggtaaacagtcggatcaacccctcattgttcaccagcctgtgctgacgatccttactgacaagctgtcaaaaaccaagaaggtcgaagagatattgaaatattacccaacagaaaagatcaatagcttctttgcccagtgcctcaaactgattgtggggaaccaggctaatttcaagaggatcttcgatttagaggcagaagtaaaactgcaatttagtaaggagacttatgaggaagacctcgagtcccttctggaaaagattggagacgagtacttggatatcttcctacaggccaaaaaggttcatgacgctatactgctctctgaaattatcagctccaccgtgaaacacacacaggccaagctgtcaagtggcatggtcgagcggtatgagcgtcacaaagcggatcttgcaaagtttaagcaattcgtgaaagaaaacgtgccccagaaggccaccgtctttttcaaagacacgactaagaatggctacgctgggtacattaaaggaaagacaacccaggaggaattttataagttcgttaaaaaggagctgagcggtgtggtaggctctgagccatttttggagaaaatcgatcaggaaactttcctcctgaagcaacgcacatacaccaacggggtgatccctcatcaggtccacttaattgaactgaaagccataatcgaccagcagaagcaacattatccctttctagaggaagcaggacctaaaattatcgctctcttcaagtttagaataccatactatgtgggcccgctggccaaggagcaggaggcgtcctcattcgcctggattgaaaggaaaacggcagagaagatccacccctggaatttcagcgaagttgtggatatcgagaaaagtgctatgcggtttattcagcgaatgaccaagcaggacacataccttcctactgaaaaagtcttgccaaagaactctctgctctatcaaaagtacatgatcttcaatgagctgaccaaagtgtcctacaaggatgagcgcggtgtaaaacagtattttagcggggacgaaaagcagcagattttcaaacaactttttcagaaggagagaggaaagataacagttaaaaagctgcagaacttcttgtacactcactatcatatcgaaaatgcccacatttttggcatcgagaaggctttcaacgcctcgtactctacctatcatgattttatgaagctcgcaaaaacaaaccaaaagtccatgcaggaatggctggagcagcccgagatggaacctatcttcgaggacattgtgaagatattaaccatctttgaagacaggcagatgattaaacaccaactgtcaaagtaccaggaggtcttcggcgagaaactactcaaggaatttgcccggaaacattatactgggtggggacgcttcagtgctaagctgatccacggtattagagataggaaaacgaataagacaatccttgactacttgataaacgatgacgatgtgccagcgaatcgtaaccggaatctgatgcagctcatcaacgacgagcacctgagcttcaaggaagagattgcaaaagccaccgtcttttccaagcataaatctttagtggatgttatccaggacctgcccggcagcccggctattaagaaagggatctggcaatcacttaagatagtggaagagttgattgccatcattggatacaagcctaaaaatatcgtaatagagatggcacgagaaaaccagaagactcacagaaccaaacccaggctcaaggccctggagaatggcctaaaacagatcggtagtacactgctcaaggaacagccaaccgataacaaggctctgcaaaaagagcgcctttatttgtactatctgcagaatgggcgggacatttacactggcgaacctttagatatcgagaacctccatcagtatgaggtcgaccacattatccccagatccttcatagtggataatagcattgacaacaaggttctggtggcctctaaacaaaatcagaagaaaagggacgatgtcccaaacaagcagatcgtgaacgaacagcgcatcttttggaatcaacttaaggaggcaaaactgatttcacccaagaaatacgcgtatttgacaaagatcgaactcacgcctgaggacaaagctcgattcattcagcggcagctggtagaaacccgtcagataactaagcacgtggccaacatcctacatcaaagttttcaccaggaggaggaaggaacagattgtgacggcgttcagattatcaccctgaaggcaacactcactagccagttcagacaaacctttgggctgtacaaagtcagggagattaatccacatcaccatgcccacgatgcttaccttaacggattcatcgccaatgtgttgctgaagcgctatccgaaattagcacccgaatttgtgtacggtaagtatgtcaaatactccctcgctcgggagaacaaggccacggcgaaaaaggagttctattctaatatactgaagtttcttgaatcggacgagcctttctgcgatgaaaacggcgagatctactgggagaaaagctatcatctgccaagaattaagaaagttctatcctcacaccaggtgaatgtggtaaagaaagtcgaacagcagaaagggggattctacaaggagaccgtgaacagtaaagaaaagcccgacaaactcatcgagaggaagaataactgggatgttacaaaatacggcggttttgggtctcctgtgattgcctatgctatcgcattcgtctacgccaagggcaagactcagaaaaagacccgagctatagaaggaattacaatcatggagcaagccgcatttgaaaaagacccaactaccttcctgaaggataaaggctttccccaggtgacggagttcatcaagttgccgaagtatacactgtttgagttcgacaatgggcgccggagatttttagcgagccacaaagaatcccaaaagggaaaccctttcattctctcagatcagctggttacccttctgtaccatgcccagcactatgacaaaataacttaccaggagagctttgactatgtgaatacacatttgtctgatttctccgctatcctcaccgaagtactggcctttgcagagaagtacactctagctgacaaaaacattgaaaggatccaagagctgtacgaggaaaacaagtatggtgagattagtatgatcgcccagagcttccttcagctcctgcagttcaatgcaataggcgccccagctgattttaaattctttggggtcaccatcccccgtaagcgctacacatctttgacggaaatttgggacgcgaccatcatttatcaatccgtgactggactgtacgagacacggatcagaatgggcgatttatgggccggtgagcagtga

SEQ ID NO: 2966 - RNA, 4011 nt, synthetic construct
  misc_feature 1..4011: note = Cas9 variant
  source 1..4011: mol_type = other RNA
atgaccaaggactacacaatcggcctggatattgggactaacagcgtgggatgggccgtcctcacggacgattatcagcttatgaaaagaaagatgtccgttcacggtaataccgagaaaaagaaaataaagaagaacttctggggcgctaggctgtttgacgaagggcaaacagcagagttccggcgcactaaacgaaccaatcgtagaaggttggcccggcgcaagtacagattatctaaactgcaggatctatttgcggaggaactctgcaagcaggacgattgtttctttgtgaggctggaagagtcattccttgtacccgaggaaaaacagtataagcctgctagtatctttccaacactggaggaagagaaggagtactatcaaaaatacccgaccatttatcatttgcggcagaagctcgtggacagcactgaaaaagaggatctgcgcctggtctacctcgccttagcacatctgcttaagtaccgaggacacttcttgtttgaaggcgacctggatacagagaacacctccatcgaagagtctttcagagtgtttctagagcagtattcgaaacagtcagaccaacccctcattgttcaccagcctgtgctgacgatccttactgataagctgagcaaaaccaagaaggtcgaagagatattgaaatactatccaacagaaaagatcaatagtttctttgcccagtgcctcaaactgattgtgggtaaccaggctaatttcaagaggatcttcgacttagaggcagaagtaaaactgcaattttccaaggagacttacgaggaagacctcgagtctcttctggaaaagattggggatgagtatttggacatcttcctacaggccaaaaaggttcatgatgctatactgctcagcgaaattatctcctcaaccgtgaaacacacaaaggccaaactgagtagcggaatggtcgagcggtacgagcgtcacaaggcggaccttgcaaagtttaaacagttcgtgaaggaaaacgtgccccaaaaagccaccgtctttttcaaggatacgactaaaaatggctatgctggctacattaaggggaagacaacccaggaggaattttacaaattcgttaagaaagagctgtctggagtggtaggttccgagcctttcttggaaaagatcgaccaggagactttcctcctgaaacagcgcacatataccaacggcgtgatcccacatcaagtccacttaattgaactgaaggccataatcgatcagcagaaacagcattacccctttctagaggaagcagggcctaagattatcgctctcttcaagtttagaataccatattacgtgggaccgctggccaaagagcaagaggcgagcagcttcgcctggattgaaaggaagacggcagagaaaatcaatccctggaacttcagtgaagttgtggacatcgagaagtctgctatgcggtttattcagcgaatgaccaaacaggatacatatcttcctactgaaaaggtcttgccaaagaatagcctgctctaccagaaatatatgatcttcaacgagctgaccaaggtgagctacaaagacgagcgcggcgtaaagcaatacttttcgggtgatgaaaaacagcagattttcaagcagctttttcaaaaggagagagggaaaataacagttaagaaactgcagaatttcttgtatactcactaccacatcgaaaacgcccagatttttggaatcgagaaggctttcaacgcctcttattccacctaccatgactttatgaaactcgcaaagacaaatcaaaaggccatgcaggaatggctggagcagcccgagatggaacctatcttcgaggacattgtgaaaatattaaccatctttgaagataggcagatgattaagcaccaactgtcaaaatatcaggaggtcttcggcgagaagctactcaaagaatttgctcggaagcattacactggctgggggcgcttcagtgcgaaactgatccacggaattagagacaggaagacgaacaagacaatccttgattatttgataaatgacgatgacgtgccagcaaaccgtaatcggaacctgatgcagctcatcaatgatgagcatctgagcttcaaagaagagattgccaaggctaccgtcttttccaaacacaagtctttagtggacgttatccaggatctgcccggtagcccggccattaaaaagggcatctggcaatcacttaagatagtggaagagttgattgcaatcattgggtacaaacctaagaacatcgtaatagagatggcccgagaaaatcagaaaactcacagaaccagtcccaggctcaaggctctggagaacggactaaaacagatcggctccacactgctcaaggaacagccaaccgacaataaggccctgcaaaaagagcgcctttacttgtattacctgcagaacggtcgggatatgtatactggggaacctttagagattgagaatctccatcagtacgaagtcgaccacatcattcccagatcattcatcgtggataactctatagacaataaggttctggtggcatcaaaacaaaaccagaagaaaagggacgatgtcccaaagaagcagattgtgaacgagcagcgcatcttttggaatcaacttaaagaagcgaagctgatcagtcccaaaaagtatgcttacttgacaaaaattgagctcacgcctgaagacaaggcccgattcatccagcggcagctggtagagacccgtcagattactaagcatgtggcaaacatactacaccaatcctttaatcaggaggaagagggcacagattgtgacggagttcagatcattaccctgaaagccacactcacttcccagttcagacaaacctttggcctgtataaggtcagggaaatcaacccacaccatcacgctcatgatgcctaccttaatgggttcattgcaaacgtgttgctgaaacgctacccgaagttagctcccgagtttgtgtatggaaaatacgtcaagtattctctcgcccgggagaataaagcgacggccaagaaggagttctactcgaacatcctgaaatttcttgaaagcgacgaacctttctgcgatgagaatggtgaaatatattgggagaagtcccaccatctgccaagaatcaaaaaggttctatcaagtcaccaggtgaacgtggtgaaaaaggtcgagcagcagaagggcgggttctacaaagaaaccgtaaattctaaggagaaacccgacaagctcattgaaaggaaaaacaattgggatgttacaaagtatggaggctttggtagccctgtgatcgcttacgcaattgccttcgtctacgctaaggggaaaactcaaaagaaaacccgagccatcgagggcataacaattatggaacaggcagcgtttgagaaggacccaactaccttcctgaaagagaagggatttccccaggtgacggaatttatcaagttgccgaaatatacactgtttgagttcgataacggccgccggagatttttagcctcccacaaggaatcacaaaaagggaatcctttcatcctcagcgaccagctggttacccttctgtaccatgctcagcactatgataagattacttaccaggagtcttttgactatgtgaacacacatttgtccgacttcagtgccatactcaccgaagtactggcatttgctgagaaatacactctagccgataagaacatcgagaggattcaagaactgtatgaggaaaataaatacggagagaccagcatgatcgcacagtctttccttcagctcctgcagttcaacgccattggtgctccagcggactttaagttctttggcgtcacaatcccccgtaagcgctacacgtccttgaccgagatatgggatgccactatcatttatcaatcagtgacagggctgtacgaaacccggatcagaatgggagacttatgggcaggcgagcagtga

SEQ ID NO: 2967 - RNA, 4014 nt, synthetic construct
  misc_feature 1..4014: note = Cas9 variant
  source 1..4014: mol_type = other RNA
atgaagaacatgaaaaagccctacaccatcggcctggacattgggacaaatagcgtgggatgggccgtcctcactgatcagtatgaccttgttaaaagaaagatgaaaatagctggtgattccgagaagaagcaaatcaaaaagaacttctggggcgtgaggctgtttgacgaagggcagacggcagccgatcggcgcatggcgcgaaccgctcgtagaaggattgagcggcgcagaaataggatctcttacttgcagggaattttcgccgaagagatgtcaaaaacagacgcaaactttttctgccggttaagtgatagcttttatgtagacaatgaaaagcgcaactcccgacaccctttctttgccactatcgaggaggaagtggagtaccataaaaattatccaaccatataccacctgagagaggagctagtcaactcttcggagaaggctgatctcaggctggtgtatcttgcactggcccatatcattaagtaccggggcaatttcttgatcgaaggtgctctcgacacacagaacacctcagttgatgggatttacaaacaatttatccagacttataatcaggtgttcgccagcggaatagaggacggcagtctgaagaaactggaagataacaaggacgtcgcgaaaattctcgtggagaaggtaacacgtaaagaaaagttagagcgcatcctgaaactttacccgggcgagaaatccgcagggatgtttgcccagttcatttctttgatcgttggaagcaagggtaattttcaaaaacccttcgacctgatcgaaaagtccgatattgagtgtgctaaagactcatatgaagaggatctagaaagtctcctggcccttataggcgacgagtacgcagagctgttcgtggctgccaagaacgcgtatagcgccgtcgtgttgtcttccatcattaccgtggcagaaacggagactaatgctaagctctcagccagcatgatcgaaagatttgatacccacgaggaagacctgggggagttaaaggctttcataaagctgcatctccctaaacactacgaggaaatttttagtaacacagagaagcacggatatgccggctacatcgatggtaaaactaagcaggcagacttctacaagtatatgaaaatgacccttgaaaacatcgagggggccgattactttattgctaagatcgagaaagaaaatttcctgaggaagcagcggacatttgacaacggagcgattccacatcagttgcacctagaggaactggaggcaatactccatcaacaggccaaatattaccccttcctgaaggaaaattatgataaaatcaagtctcttgtcacctttcgcattccttacttcgttggcccactggctaacggccagtccgaatttgcctggttgacgcgaaaggcagacggggagatcagaccctggaatatcgaagagaaagtggacttcggaaagagcgccgtagattttattgagaaaatgactaacaaggacacatatctccctaaagaaaatgtgctgccaaagcactcgttatgctaccaaaagtacctggtctataacgaactaaccaaagtgaggtacataaatgatcagggtaagacttcttatttctccggccaggagaaagagcagatcttcaacgacctctttaagcaaaaacggaaggttaagaaaaaggatctggaacttttcttgcgcaatatgtcacacgtggagagtccgacaattgaagggctggaggacagctttaactcctcttacagcacctatcatgatctcctgaaagtcggaatcaagcaggaaattcttgacaatcccgtgaacacggagatgctggagaatatcgtaaaaatattgaccgttttcgaagataagagaatgatcaaggagcagctccagcaattttcagacgtgctggatggcgtcgtgctgaaaaagttagaaaggcgtcactacacaggttgggggcggctaagtgctaaactcctgatgggcattcgagacaagcagtcccatcttactatcttggattatctgatgaacgacgacggactcaacagaaatctgatgcagttaattaacgatagcaatctgtctttcaaatcaatcatagagaaggagcaggtcaccacagccgacaaggatattcaaagtatcgtggcagaccttgcgggcagccctgctattaaaaaggggatcttgcagtccctcaaaatagttgatgaactggtgtctgtaatgggatacccaccccagactatcgtcgtggagatggccagggaaaaccagaccacaggtaagggcaaaaataactcgcgccctcggtacaagagcctagagaaagcaattaaggaatttgggtcccaaatcctgaaggagcacccaaccgacaatcaggagctcagaaacaataggctgtatctttactatttgcagaacggaaaagatatgtacactggccaagacctggatattcataatttatcaaactatgacatcgatcacatagttccccagagtttcattacggacaattctatcgataacctcgtgctgacaagctccgccggtaatcgcgaaaagggggacgacgtcccgcctcttgagatcgtgcgaaaacggaaggtattttgggaaaaactgtaccagggcaacttgatgtcaaagcgtaagttcgattatctcaccaaagctgagagaggaggcctgactgaagccgacaaggcaaggtttattcaccgccagctagtggagacccggcaaatcaccaaaaacgttgctaatattctgcatcagagattcaactacgagaaggatgaccacgggaatacaatgaaacaggtcaggatagtgactctcaagagcgccctggtgtctcagtttcgaaagcaattccagctttacaaagtccgcgatgttaacgactatcatcacgcgcacgatgcctacttgaatggagtggtggctaacacactgttaaaggtatatccccagctcgaaccagagttcgtctacggtgactatcatcagtttgattggttcaaagcaaataaggccacggctaaaaagcaattttacaccaacatcatgctgttctttgcccagaaggaccggattatcgatgaaaatggcgagattctttgggacaaaaagtatctggacactgtgaaaaaggttatgtcctacagacagatgaacatcgtgaaaaagacagaaatacaaaagggggagttcagtaaagcaaccatcaagcctaaaggaaatagctctaagctaatttccaggaaaacaaactgggatcccatgaagtacggcggtctcgactcaccaaatatggcgtatgccgtcgtgatcgagtacgctaaagggaagaacaagctggtttttgagaaaaagattatccgtgtgactataatggaacgcaaagccttcgaaaaggatgagaaagcatttttggaggaacagggctatcggcagcccaaggtactggctaagttacctaaatacaccctctatgagtgtgaagagggaagaaggcgaatgctggccagtgcaaatgaagcccagaagggcaaccaacaggtccttccaaaccacctggtgacgttgctccatcacgtggctaattgcgaggtcagcgacgggaaatcgctggattacattgagtccaaccgggaaatgttcgcggagctactggcccatgtttctgaatttgcaaagcgctatacccttgctgaggccaatctcaacaaaatcaatcagctgttcgaacagaacaaggagggagacatcaaggccattgctcagagcttcgtggatttgatggcatttaatgccatgggcgcgccggcttcattcaaatttttcgagacaactatagaaagaaagaggtacaacaatctgaaagagttactcaacagtaccatcatttaccaatccatcacaggtctgtatgaatctcggaagcgacttgacgattga

SEQ ID NO: 2968 - RNA, 4014 nt, synthetic construct
  misc_feature 1..4014: note = Cas9 variant
  source 1..4014: mol_type = other RNA
atgaagaaattcgagaactactatctgggcctcgacatcgggaccagctccattggatgggccgtgacaaattctcagtacgatatacttaagtttaacggtaaatatatgtggggcactagactgttccccgaagctaatacggcacaagagaggcggatccaccgctcaagtcgacgtagattgaagaggcggaaagaacgcattcagatcttacagatgctgtttgacaaggagattgccaagatcgatagcgggttctttcagagactaaaagactccaagtactataaagaagataagaccgagaaacaaacaaactctatattccatgacaaggattactcggacaaggagtatcaccaggattttcctactatctaccatctcaggaaattcctgcttgaaggaaataagccaaaagacattcggtttgtctacctggcgttgcaccatatcctcacccaccgcggccacttcctgtttccggatatggaggtttcaaacgtgacagagttcagcaatatttttagtgaactgaagcagtatctctacgacgagatggatttagacttcgaatggaaaaacggtaagctgaatgaggtagaaaacatccttaaagaccgaaatttggctaagtccgagaaggagaaaaagctgtgcgggataattgaactagagggaaaaatcgataaccagagaaaggccatgattggcatgatgtgtggctgcaaaaagaagttctctgacctctttcaaaatgaaaactatagggagctggaaatcagctccttctcatttgcagatagtagctacgaggaaaaacgggacgagcttgaggggatcctggccgaaaatattttgtgtctcgattatctgaagaccatatacgactggggaaaattatctgatatcctgcagggtgaggaatccatttcagtggctaaggtcaaaagctatgaggaacatcagctcgaccttaagtacctgaagaacatcttgaaactatacagtcacaaggagaaagagaacgtgttccgtaagaaagaaggcaagtatcccaagtacatatctgggaaactgtcccaggaggaatttaataagagcattaaaaagatcctcgaggagatcaaatcggttaagcaagaagatcgcaaagtgttcgacactctgcttaagagagcatctaacaatctgttgtgccctaagcaggtcattaaagagaacggagtgatcccatatcagattcataagtttgaactcgagaaaatactgaggaatatggccgatttctttcccatgttaaaggaaaagaaagacggcaagacactgtccgagaaaatcatttcagtattcacctttcggatcccttactatgttggtccactaaaccaaaatagtgaccgagcttggctcgtgaagaacaaagatgagaagatctacccctggaatttcgaagagattgtcaacctggaagagagcgccgaaaaatttatacagaatcttacgaacaagtgtacttatttggtgctggaggacgtgctccctaagtcctctatcctgtacagcaaattcatggtccttaatgagctgaacaatttgaagattgatggggaagcgatctcagttgacctcaaacagaagatttacctgaacttattccagaaatataagaaggtgaccctgaaaaagctaaaaggatacctcaagagtgagaacatcctgatagatacatccactcaaatcaccggcattgacggcgattttaaaagctctcttgggtcatatttggacttctacaatatcctgggagataaggtaaaaacagactttggtaagaagctcattgaaaactgcatcctgtggataaccttatatacgggcgagaaaaagctgcttaaaaataagattatcgcaaactacaaaggggaattgagtgaggaggaaattaagaagatcgtgaatctcaaatataaggattggggacgcctgagctacgccttcctagaggaaatacagtccgcttctctggagactggcgagctcagaaacatcattcagatgatgtgggaaacaaataacaatctgatggagcttttgtcgagcaactaccagtttctgtccgaaatcgagaaaaggaactcagtcgtggccattggtaaggagttcaattatgaaaccatcttaggggacagttacgcatctccaagcgttaaacggatgatatggcaatccctctcagtggtcgatgagattaagaagatcatgaaaaaggctccgaaaaagatctttattgaaatggcccgccaggaggacatgaaaaaggaaagaaaggagagcaggaaatctactttcctgacactttataagtccatcaaagaagagggccgtgactggattaaggagatagaaaattggagtgatagcgagtttcggtctaaaaagctgtacttgtattacacccagatgggaaagtgtatgtatacgggcgagaaaatctccctcgaccagctgttcaacaagaatatttacgatatcgaccacatttacccccgatcaaaaaccaaggatgacagtatcgaaaacatagtgctagtaaaaagaaacatcaatgcgaagaaaacagatgaatatcctctggagaggaacattcaacagaagcagcacgacttttggaagatgctccatagcaaaaagctgatcggggataaaaagtacgagcgccttactcggaccacagagttcactgacgaagaattgtcggattttattgccagacagctggttgagaccaggcaatccacaaaaatcgtggcagacatattaaagaatctcttcccagagaccaagattgtctatgtgaaagctaacctgacttctgatttccgcaagaattttaaaatccttaagagccgagacatcaacgactaccaccatgcccacgatgcttatctgaatattgtcacgggaaacgtgtacaatataaaattcacagacaacccccggaattttatcaaggataagaaactagaaggtaagaaatataacctcaaggttgagaaaattttcgaataccgtaaggagaatgaatcattttggaaccctaagaccatggtgactaaaatcgagaattacattttcaagaaaagaccacagtttaccaggtatagtttcgagcagcatggcgggtttttcgaccaaaacatcgtagataaggaatcctgcaaaaagggaacaggctacatacccatcaaatctagcaacgccattctgtataatacctccaagtacggtgggtatggctcagtcactggaacatactttttcttggtggagcacacgatgaagggcaaacgcatccggaccattgaaatgatgccgctgtatttaagcaagaaaatccacagtaaggaggaactcgagaaatactgtaaggagaagctggaacttcagaaaccttctgttagactggcaaggataaagtacaactccttgctcaaaattaatgggttcccctatcatatcactggaaagacaaacgacagctactggatcatgtcggccattcagctgctactgtctaaaaattattacgagtatcttcgaaagctctacatcttttgcaaggaggaacgcctggaagaggagatagtgggtgagaaaaacattaagttgtatacctgtatcctggaaaaattagaaaagtcaatttacagtcacaaactcctgaatatcaactacaatggcaagtccaagaaccttaaagatatactggagagcgagaaggaaaatttcttgctcctgtctgagaaaaagcaggctcaaattctaatcgaaatctttacactgcttgagagcaacaatttcggggcgaacctcgaatcctttggatgcggcaaaaagtgcggtattactaaaatcaataagaacattgacaagctggaggaggtcttgttaataaatcagtcaccaaccgggctgttcgaaaacagtatcgatctcaaaaaggtgtga

SEQ ID NO: 2969 - RNA, 4014 nt, synthetic construct
  misc_feature 1..4014: note = Cas9 variant
  source 1..4014: mol_type = other RNA
atgaagaaagactacgtgatcggcctggatattgggaccaacagcgtcggatgggccgttatgacagaggactatcagctcgtgaagaaaaagatgcccatatacggtaatactgagaaaaagaagatcaaaaagaacttctggggcgtaagactttttgaggaagggcacacggctgaggataggcggctgaaacgcaccgcacgacgtagaatttccaggcggcgcaatagattgaggtatttacaagccttctttgaagaggcgatgacagacctggatgagaacttctttgctcggctacaggaatctttcctcgtgcctgaggacaagaaatggcatcgccacccaatctttgccaagctggaagatgaggtcgcataccatgagacttatccgaccatttaccaccttcgaaagaaactggccgactcaagtgaacaggctgatttgagactcatctatctggcactggcccatatagtgaagtacaggggacacttcctcatcgagggcaaattaagcacagaaaatatttccgttaaggagcagtttcaacagttcatgatcatttacaaccagacctttgtgaatggtgaatctcggctggtctcggctccccttcctgagtcagtgttgatcgaggaagaactgactgaaaaagccagccgtacaaagaaaagtgagaaggtactacagcaattcccacaggaaaaggcgaacgggctctttggacagttcctgaaacttatggttggcaataaggcagacttcaaaaaggtgtttggcctggaggaggaagccaaaataacctatgcttccgagtcttacgaagaggatttggaagggattctcgccaaggtcggagacgagtatagcgatgtgttcctggcagctaagaacgtgtacgacgccgtcgagttatccacgatcctggcggactcagataaaaagagtcacgccaaactctctagctccatgattgttcgctttactgaacatcaggaggaccttaagaaattcaagagatttatcagggaaaattgccccgatgagtatgacaacctgttcaagaatgagcaaaaagatggttacgcaggctatatcgctcacgccgggaaggtgtcacagttgaaattttaccagtacgtaaagaaaattatacaagacatcgctggagccgaatatttcctagagaagattgcacaggaaaactttctgcggaagcagcgaaccttcgataatggcgtgatccctcatcagatacacctcgccgagctgcaagctattatccaccgccaggcggcatactatccatttcttaaagaaaaccaggagaagatcgagcagctggtcacattcaggattccctactatgtgggtcctttgagcaaaggggacgccagtacttttgcttggctcaagagacaatctgaggaaccaatccggccgtggaacctgcaggaaaccgttgatttagaccagtccgccacagcattcattgagcgcatgaccaatttcgatacgtacctgcccagcgaaaaagtgctacctaagcattcgctcctgtatgagaaatttatggtcttcaacgagcttactaagatatcttacacagacgacagaggaatcaaggccaatttttccggcaaagaaaaggagaaaattttcgattacttgtttaagaccaggcgtaaagtgaagaagaaagacatcatccagttctatcggaacgaatacaatactgagattgtaacactgtcaggcctcgaagaggatcaatttaacgctagtttcagcacctatcaggacctgcttaagtgtgggctgacgcgagccgagttggatcacccagacaatgcagaaaaactcgaggatataatcaagattctgaccatctttgaagacagacagaggattcgcacacagttatccactttcaaaggacaattttctgcggaggttctgaagaagctagagcggaaacattacaccggttggggcagactcagcaagaaactgatcaacgggatatatgataaggaatcaggaaaaacaatccttggctacttgattaaggacgatggtgtgagtaagcactataataggaacttcatgcagctgatcaatgactcccagctcagctttaaaaacgctattcaaaaggcccagtcttcagagcatgaagagactctgagtgaaaccgtcaatgagttagcagggagccccgccatcaaaaagggcatataccagtccctgaaaattgtggatgagcttgtcgctatcatgggatacgcccctaagcgcattgtggttgaaatggcacgagagaaccagacaacctctactggcaaacggcgttcgatccaaagattgaagatagtggaaaaggctatggccgagatcgggagcaatctcctgaaagaacagccaacgacaaacgagcagctaagggacacccgcctgttcctctattacatgcagaacggaaaggacatgtatactggtgatgagctgtcccttcaccggttgtcacactacgacattgatcatatcattccccaaagtttcatgaaagacgattctctggacaatttagtactcgtcggcagcaccgaaaacagagggaagtccgatgacgtgccgtcaaaagaggttgtgaaggatatgaaggcgtattgggaaaaactgtacgccgctggacttatcagccagaggaagtttcagcgactgacaaaaggcgagcagggtgggttgaccctcgaagacaaggcacacttcatacaacgccagctggtcgagactcggcagattacgaaaaatgtggccggcatcctagatcaaagatataacgctaattctaaggagaagaaagtacagatcattacactgaaggcctccctcaccagtcagtttaggagcatcttcggactgtacaaagtgcgtgaagttaacgactaccatcacggccaggatgcatatcttaattgcgtcgtggcgactacattgctgaaggtgtaccctaacttagcccccgagtttgtctatggggaatacccaaaattccaaacctttaaggagaataaggctacagccaaagcaattatatatactaacctcctgcgcttctttaccgaggacgaacctcggttcacgaaggacggagagatcctttggtctaattcctacctgaaaaccattaagaaagaactaaactatcaccagatgaatatcgttaagaaggtggaggtgcagaaaggtggcttttcaaaggaaagtattaaacccaaggggccaagcaacaaactcatccccgtaaagaatggactggatcctcagaaatacggcggtttcgactcgccaatagtcgcttacacagtgttgttcactcatgagaaggggaagaaaccgctgatcaagcaagagattttaggcatcaccattatggagaaaacaagatttgaacagaaccccatcctcttcctggaagagaagggatttcttaggcctcgagttctgatgaaattgccaaagtatactctctacgagttccccgaaggccggcgcagactgctagcctccgcaaaggaggcccagaaagggaaccagatggtgctgcctgaacaccttctcaccctgttgtatcatgctaagcaatgtctgttaccaaatcagtctgagagcctcacgtacgtcgaacagcaccagcccgagtttcaagaaatactggagagggtggttgatttcgcggaggtgcatacacttgccaaatcaaaggtacagcagattgtcaaactgtttgaagcaaaccaaaccgctgacgtgaaggagatcgccgccagtttcatccagttgatgcagtttaatgctatgggagcaccgtccactttcaagtttttccagaaagatattgaacgggcccgatatacatctataaaggagatctttgacgcgaccattatctaccaaagcactaccggcctctatgagacaagacgcaaagtggtcgattga

SEQ ID NO: 2970 - RNA, 4014 nt, synthetic construct
  misc_feature 1..4014: note = Cas9 variant
  source 1..4014: mol_type = other RNA
atgaagaaagactacgtgatcggcctggatattgggaccaacagcgtcggatgggccgttatgacagaggactatcagctcgtgaagaaaaagatgcccatatacggtaatactgaaaagaagaagatcaaaaagaacttctggggcgtaagactttttgaggaagggcacacggctgaggataggcggctgaaacgcaccgcacgacgtagaatttccaggcggcgcaatagattgaggtatttacaagccttctttgaagaggcgatgacagacctggatgagaacttctttgctcggctacaggaatctttcctcgtgcctgaggacaagaaatggcatcgccacccaatctttgccaagctggaagatgaggtcgcataccatgagacttatccgaccatttaccaccttcgaaagaaactggccgactcaagtgaacaggctgatttgagactcatctatctggcactggcccatatagtgaagtacaggggacacttcctcatcgagggcaaattaagcacagaaaatacctccgttaaggaccagtttcaacagttcatggtgatttacaaccagacttttgtcaatggtgagtctcggctggtgtcggctccccttcctgaatcagtattgatcgaggaggaactgacagagaaagccagccgtaccaagaaaagtgaaaaggttctacagcaattcccacaggagaaggcgaacgggctctttggacagttcctgaaacttatggtgggcaataaggcagatttcaaaaaggtctttggcctggaagaggaggccaaaattacgtatgcttccgaatcttacgaggaagacttggaggggatcctcgccaaggtgggagatgaatatagcgacgtgttcctggcagctaagaacgtctacgacgccgttgagttatccactatactggcggattcagacaaaaagagtcacgccaaactctctagctccatgattgtgcgctttaccgagcatcaggaagatcttaagaaattcaagagatttatcagggagaattgccccgacgaatatgataacctgttcaagaatgagcaaaaagacggttacgcaggctatattgctcacgccgggaaggtatcacagttgaaattttaccagtacgtgaagaaaatcatccaagatattgctggagccgagtatttcctagaaaagatagcacaggagaactttctgcggaagcagcgaacattcgacaatggcgtcatccctcatcagattcacctcgccgaactgcaagctatcatacaccgccaggcggcatactatccatttcttaaagagaaccaggaaaagattgagcagctggtgactttcagaatcccctactatgttggtcctttgagcaaaggggatgccagtacctttgcttggctcaagaggcaatctgaggaaccaatccggccgtggaacctgcaggagacagtggacttagatcagtccgccaccgcattcattgaacgcatgacgaatttcgacacttacctgcccagcgagaaagtcctacctaagcattcgctcctgtatgaaaaatttatggtgttcaacgagcttacaaagatctcttacaccgacgatagaggaattaaggccaatttttccggcaaagagaaggagaaaatattcgactacttgtttaagactaggcgtaaagtaaagaagaaagatatcattcagttctatcggaacgaatacaatacagaaatcgttaccctgtcaggcctcgaggaagaccaatttaacgctagtttcagcacgtatcaggatctgcttaagtgtgggctgacccgagccgagttggaccacccagataatgcagagaaactcgaagacatcattaagatactgacaatctttgaggatagacagaggattcgcactcagttatccaccttcaaaggacaattttctgcggaagtgctgaagaagctagagcggaaacattacacaggttggggcagactcagcaagaaactgatcaacgggatttatgacaaggagtcaggaaaaactatccttgattacttgataaaggacgatggcgtcagtaagcactataataggaacttcatgcagctgatcaatgactcccagctcagctttaaaaacgctattcaaaaggcccagtcttgcgaacatgaggaaaccctgtcagagacagtgaatgaattagcaggtagtcccgccatcaaaaaggggatttaccagagcctgaaaatcgtcgacgagcttgtggctataatgggctacgcccctaagcgcattgttgtggagatggcacgagaaaaccagaccacttccacgggaaaacggcgttctatccaaagattgaagattgtagagaaggctatggccgaaatcggctcgaatctcctgaaagagcagccaacaaccaacgaacagctaagggatactcgcctgttcctctattacatgcagaacgggaaggacatgtataccggagatgagctgagccttcaccggttgtcccactacgacatagatcatatcattccccaatcattcatgaaagacgatagtctggacaatttagtcctcgtgggttctacagagaacagaggcaagagcgatgacgttccgtccaaaaaggtggtcaaggatatgaaagcgtattgggaaaagctgtacgccgctgggcttatctcacagaggaaatttcagcgactgaccaagggagagcagggcggtttgactctcgaagacaaagcacacttcattcaacgccagctggtggagacacggcagatcacgaagaatgtagccgggatactagatcaaagatataacgctaagagcaaagaaaagaaagtgcagattatcaccctgaaggcctctctcacttcccagtttaggagtatcttcggcctgtacaaagttcgtgaggtcaatgactaccatcacggacaggacgcatatcttaactgtgtggtggcgacaaccttgctgaaggtctaccctaatttagcccccgagtttgtttatggcgaatacccaaagttccaggcttttaaagagaacaaggccacagcaaaaactattatctataccaatctcatgcgcttctttacggaagatgagcctcggttcaccaaggacagcgagattctgtggtctaactcctaccttaaaacaataaagaaggaactgaattatcaccaaatgaacatcgtgaaaaaggtggaggtacagaaagggggattttcaaaggaaagtattaaacccaagggtccaagcaataaactaatccccgtcaagaacggcctcgatcctcagaagtacgggggattcgactcgccagtggttgcttacactgtgctgttcacccatgagaaaggcaagaaaccgttgattaagcaagaaatcctgggtataacaatcatggagaaaactagatttgagcagaatcccattttattcctcgaagagaaggggtttctgaggcctcgagtccttatgaagctgccaaaatataccttgtacgagttccccgaaggccggcgcagactcctggcctccgcaaaggaagcccagaaaggaaaccagatggtgctacctgagcatctgcttacgctcctgtatcacgctaagcaatgcttgctgccaaaccagtctgagagcttagcgtacgttgaacagcaccagcccgagtttcaagaaatcctcgagagggtggtagatttcgccgaagtccatacactggcaaaatcaaaggtgcagcagattgtgaaactttttgaggctaatcaaaccgccgacgtcaaagagatcgccgctagtttcatacagctgatgcagtttaacgcaatgggcgccccgtccactttcaagtttttccagaaagatattgaacgggcgcgatatacatctatcaaggagatctttgacgctaccattatataccaaagcactaccgggttgtatgaaacaagacgcaaagttgtggattga

SEQ ID NO: 2971 - RNA, 4014 nt, synthetic construct
  misc_feature 1..4014: note = Cas9 variant
  source 1..4014: mol_type = other RNA
atgaagaaagactacgtgatcggcctggatattgggaccaacagcgtcggatgggccgttatgacagaggactatcagctcgtgaagaaaaagatgcccatatacggtaatactgagaaaaagaagatcaaaaagaacttctggggcgtaagactttttgaggaagggcacacggctgaggataggcggctgaaacgcaccgcacgacgtagaatttccaggcggcgcaatagattgaggtatttacaagccttctttgaagaggcgatgacagctctggacgagaacttctttgcccggctacaggaatctttcctcgtgcctgaggataagaaatggcatcgccacccaatctttgcaaagctggaagacgaggtcgcctaccatgagacttatccgaccatttaccaccttcgaaagaaactggctgattcaagtgaacaggcagacttgagactcatctatctggccctggctcatatagtgaagtacaggggacacttcctcatcgagggcaaattaagcacagaaaatatttccgttaaggagcagtttcaacagttcatgatcatttacaaccagacctttgtgaatggtgaatctcggctggtctcggcgccccttcctgagtcagtgttgatcgaggaagaactgactgaaaaagccagccgtacaaagaaaagtgagaaggtactacagcaattcccacaggaaaaggcaaacgggctctttggacagttcctgaaacttatggttggcaataaggccgatttcaaaaaggtgtttggcctggaggaggaagctaaaataacctatgcctccgagtcttacgaagaggacttggaagggattctcgcaaaggtcggagatgagtatagcgacgtgttcctggctgccaagaacgtgtacgatgcggtcgagttatccacgatcctggccgactcagacaaaaagagtcacgcaaaactctctagctccatgattgttcgctttactgaacatcaggaggatcttaagaatttcaaaagatttatcagggaaaactgccccgacgagtatgataatctgttcaagaacgagcaaaaggacggttacgctggctatatcacccacgccgggaaagtgtcacagttgaagttttaccagtacgtgaaaaagattatacaagatatcgctggagccgaatatttcctagagaaaattgcacaggaaaattttctgcggaagcagcgaacattcgacaacggcgtaatccctcatcagatacacctcgccgagctgcaagctattatccaccgccaggcggcatactatccatttcttaaggaaaaccaggagaaaatcgagcagctggtcactttcaggattccctactatgtgggtcctttgagcaagggggatgccaatacctttgcttggctcaaaagacaaagtgaggaaccaatccggccgtggaacctgcaggaaacagttgacttagatcagtctgccaccgcattcattgagcgcatgacgaatttcgacacttacctgccctccgaaaaggtgctacctaaacatagcctcctgtatgagaagtttatggtcttcaacgagcttacaaaaatatcgtacaccgatgacagaggaatcaaggccaatttttctggcaaggaaaaagagaagattttcgactacttgtttaaaactaggcgtaaggtgaaaaagaaggatatcatccagttctatcggaacgaatacaatacagagattgtaaccctgtccggcctcgaagaggaccaatttaacgcttcattcagtacgtatcaggatctgcttaaatgtgggctgacccgagccgagttggaccacccagataatgcagaaaagctcgaggacataatcaaaattctgacaatctttgaagatagacagaggattcgcactcagttaagcaccttcaagggacaattttccgcggaggttctgaaaaagctagagcggaagcattacacaggttggggcagactctctaaaaagctgatcaacgggatatatgacaaagaaagcggaaagactatccttgattacttgattaaagacgatggcgtgtcaaagcactataataggaacttcatgcagctgatcaatgacagtcagctctcctttaagaacgctattcaaaaagcccagagctctgagcatgaagagaccctgtcagaaacagtcaatgagttagcaggtagtcccgccatcaagaaagggatataccagagcctgaagattgtggatgagcttgtcgctatcatgggctacgcccctaaacgcattgtggttgaaatggcacgagagaaccagaccacttccacgggaaagcggcgttctatccaaagattgaaaatagtggaaaaggctatggccgagatcggctcgaacctcctgaaggaacagccaacaaccaatgagcagctaagggacactcgcctgttcctctattacatgcagaacgggaaagacatgtataccggagatgagctgagccttcaccggttgtcccactacgacattgatcatatcattccccaatcattcatgaaggacgatagtctggacaatttagtactcgtcggttctacagaaaacagaggcaaaagcgatgacgtgccgtccaaggaggttgtgaaagatatgaaggcgtattgggaaaagctgtacgccgctgggcttatctcacagaggaaatttcagcgactgaccaagggagagcagggcggtttgactctcgaagacaaagcacacttcatacaacgccagctggtcgagacacggcagattacgaagaatgtggccgggatcctagatcaaagatataacgctaaaagcaaggagaagaaagtacagatcattaccctgaaggcctctctcacttcccagtttaggagtatcttcggcctgtacaaagtgcgtgaagttaatgactaccatcacggacaggatgcatatcttaactgcgtcgtggcgacaaccttgctgaaggtgtaccctaatttagcccccgagtttgtctatggcgaatacccaaaattccaaacatttaaggagaacaaggctactgccaaagcaattatatataccaatctcctgcgcttctttacggaggacgaacctcggttcaccaaggacggggagatcctttggagcaactcttacctgaaaacaattaagaaagaactaaattatcaccagatgaacatcgttaagaaggtggaggtgcagaaaggaggtttttccaaggaatcaattaaacccaagggcccaagtaataaactcatccccgtaaagaacgggctggatcctcagaaatacggaggcttcgacagcccaatagtcgcttacactgtgttgttcacccatgagaagggtaagaaaccgctgatcaagcaagagattttagggatcacaattatggagaaaactagatttgaacagaaccccatcctcttcctggaagagaagggctttcttaggcctcgagttctgatgaaattgccaaagtataccctctaccagttccccgaaggacggcgcagactgctagcctcggcaaaggaggcccagaaaggcaatcaaatggtgctgcctgagcaccttctcacgctgttgtatcatgctaagcagtgtctgttaccaaaccagtccgaatctctcgcgtacgtcgagcagcaccaacccgaatttcaggagatactggaaagggtggttgatttcgccgaggtgcatacacttgcaaaaagcaaggtacagcaaattgtcaaactgtttgaggctaatcagaccgccgacgtgaaggaaatcgccgcttcattcatccagttgatgcagtttaacgcaatgggggccccgagtactttcaagtttttccaaaaagatattgagcgggcgcgatatacatccataaaggaaatctttgacgctaccattatctaccagtctactaccggactctatgagacaagacgcaaagtggtcgattga

SEQ ID NO: 2972 - RNA, 4014 nt, synthetic construct
  misc_feature 1..4014: note = Cas9 variant
  source 1..4014: mol_type = other RNA
atgaagaaagactacgtgatcggcctggatattgggaccaacagcgtcggatgggccgttatgacagaggactatcagctcgtgaagaaaaagatgcccatatacggtaatactgagaaaaagaagatcaaaaagaacttctggggcgtaagactttttgaggaagggcacacggctgaggataggcggctgaaacgcaccgcacgacgtagaatttccaggcggcgcaatagattgaggtatttacaagccttctttgaagaggcgatgacagacctggatgagaacttctttgctcggctacaggaatctttcctcgtgcctgaggacaagaaatggcatcgccacccaatctttgccaagctggaagatgaggtcgcataccatgagacttatccgaccatttaccaccttcgaaagaaactggccgactcaagtgaacaggctgatttgagactcatctatctggcactggcccatatagtgaagtacaggggacacttcctcatcgagggcaaattaagcacagaaaatatttccgttaaggagcagtttcaacagttcatgatcatttacaaccagacctttgtgaatggtgaatctcggctggtctcggctccccttcctgagtcagtgttgatcgaggaagaactgactgaaaaagccagccgtacaaagaaaagtgagaaggtactacagcaattcccacaggaaaaggcgaacgggctctttggacagttcctgaaacttatggttggcaataaggcagacttcaaaaaggtgtttggcctggaggaggaagccaaaataacctatgcttccgagtcttacgaagaggatttggaagggattctcgccaaggtcggagacgagtatagcgatgtgttcctggcagctaagaacgtgtacgacgccgtcgagttatccacgatcctggcggactcagataaaaagagtcacgccaaactctctagctccatgattgttcgctttactgaacatcaggaggaccttaagaaattcaagagatttatcagggaaaattgccccgatgagtatgacaacctgttcaagaatgagcaaaaagatggttacgcaggctatatcgctcacgccgggaaggtgtcacagttgaaattttaccagtacgtaaagaaaattatacaagacatcgctggagccgaatatttcctagagaagattgcacaggaaaactttctgcggaagcagcgaaccttcgataatggcgtgatccctcatcagatacacctcgccgagctgcaagctattatccaccgccaggcggcatactatccatttcttaaagaaaaccaggagaagatcgagcagctggtcacattcaggattccctactatgtgggtcctttgagcaaaggggacgccagtacttttgcttggctcaagagacaatctgaggaaccaatccggccgtggaacctgcaggaaaccgttgatttagaccagtccgccacagcattcattgagcgcatgaccaatttcgatacgtacctgcccagcgaaaaagtgctacctaagcattcgctcctgtatgagaaatttatggtcttcaacgagcttactaagatatcttacacagacgacagaggaatcaaggccaatttttccggcaaagaaaaggagaaaattttcgattacttgtttaagaccaggcgtaaagtgaagaagaaagacatcatccagttctatcggaacgaatacaatactgagattgtaacactgtcaggcctcgaagaggatcaatttaacgctagtttcagcacctatcaggacctgcttaagtgtgggctgacgcgagccgagttggatcacccagacaatgcagaaaaactcgaggatataatcaagattctgaccatctttgaagacagacagaggattcgcacacagttatccactttcaaaggacaattttctgcggaggttctgaagaagctagagcggaaacattacaccggttggggcagactcagcaagaaactgatcaacgggatatatgataaggaatcaggaaaaacaatccttggctacttgattaaggacgatggtgtgagtaagcactataataggaacttcatgcagctgatcaatgactcccagctcagctttaaaaacgctattcaaaaggcccagtcttcagagcatgaagagactctgagtgaaaccgtcaatgagttagcagggagccccgccatcaaaaagggcatataccagtccctgaaaattgtggatgagcttgtcgctatcatgggatacgcccctaagcgcattgtggttgaaatggcacgagagaaccagacaacctctactggcaaacggcgttcgatccaaagattgaagatagtggaaaaggctatggccgagatcgggagcaatctcctgaaagaacagccaacgacaaacgagcagctaagggacacccgcctgttcctctattacatgcagaacggaaaggacatgtatactggtgatgagctgtcccttcaccggttgtcacactacgacattgatcatatcattccccaaagtttcatgaaagacgattctctggacaatttagtactcgtcggcagcaccgaaaacagagggaagtccgatgacgtgccgtcaaaagaggttgtgaaggatatgaaggcgtattgggaaaaactgtacgccgctggacttatcagccagaggaagtttcagcgactgacaaaaggcgagcagggtgggttgaccctcgaagacaaggcacacttcatacaacgccagctggtcgagactcggcagattacgaaaaatgtggccggcatcctagatcaaagatataacgctaattctaaggagaagaaagtacagatcattacactgaaggcctccctcaccagtcagtttaggagcatcttcggactgtacaaagtgcgtgaagttaacgactaccatcacggccaggatgcatatcttaattgcgtcgtggcgactacattgctgaaggtgtaccctaacttagcccccgagtttgtctatggggaatacccaaaattccaaacctttaaggagaataaggctacagccaaagcaattatatatactaacctcctgcgcttctttaccgaggacgaacctcggttcacgaaggacggagagatcctttggtctaattcctacctgaaaaccattaagaaagaactaaactatcaccagatgaatatcgttaagaaggtggaggtgcagaaaggtggcttttcaaaggaaagtattaaacccaaggggccaagcaacaaactcatccccgtaaagaatggactggatcctcagaaatacggcggtttcgactcgccaatagtcgcttacacagtgttgttcactcatgagaaggggaagaaaccgctgatcaagcaagagattttaggcatcaccattatggagaaaacaagatttgaacagaaccccatcctcttcctggaagagaagggatttcttaggcctcgagttctgatgaaattgccaaagtatactctctacgagttccccgaaggccggcgcagactgctagcctccgcaaaggaggcccagaaagggaaccagatggtgctgcctgaacaccttctcaccctgttgtatcatgctaagcaatgtctgttaccaaatcagtctgagagcctcgcgtacgtcgaacagcaccagcccgagtttcaagaaatactggagagggtggttgatttcgccgaggtgcatacgcttgcaaaatcaaaggtacagcagattgtcaaactgtttgaagctaaccaaacagccgacgtgaaggagatcgccgctagtttcatccagttgatgcagtttaatgcaatgggagccccgtccaccttcaagtttttccagaaagatattgaacgggcgcgatatacttctataaaggagatctttgacgctacaattatctaccaaagcaccactggcctctatgagaccagacgcaaagtggtcgattga

SEQ ID NO: 2973 - RNA, 4017 nt, synthetic construct
  misc_feature 1..4017: note = Cas9 variant
  source 1..4017: mol_type = other RNA
atgcaggactactatctgggcctcgatatcgggaccaacagcgtgggatgggccgtcacagacgagaattacaaccttctgagaaagaaaggtaaggatttgtggggcgttaggttattcaaagaagctcaacccgcaactgagcggcgcgggcaccgatcctctcgtagaaggacgattcggaagtcactgcgcaaacagctactcagagaactgtttgaggaagagataaatgccatcgacaaggatttctttcttaggctggacgagagtaagtattggttggaagataaaaagattgagggaaaatacagcctcttcaacgacgaaaattttaccgataaggactattacgagaaattccctacaatctttcatctgcggaaggcgctgattgagtccgatgacaaggaagatatccgcctctatttcttagctataaaccagatgatgaaacgaagaggccactttctgatcgacggtaaactttctaatgtggaggacattactccattcaaagaatgcatccagaacttgattaatgaggaactggataccgagatcgagacagaattttacgacaaggccataaaaattgtatcggattactcactaaagaaaaccgagaagaagaacctcatcaaagacctggtgaaggaaactgatagcattgaggacagtaaaaagatcatcaatattttcaaccttctgatatccgggaaatctaaggtcaatggaatctttgatgacgaagagattttggagaagatcaaagaagataacaaggaggacttctatctcacaagcgaaaaatacgaggaaaatctggagtatttctcccaattactggattacaggtttgagctcatatcaagtcttaagagcatttatgactacatcatcctgcaggaagtgttgaaaggcaagaagtatctatcttacgcacaggttgagcggtacaaaaaccataaggaagacctgcgtaaactcaagcagctgattaaaaagtatgataagaacggcaaaatctactatcaaattttccgcgacgagaattttaagaaagggtacgtggcctatcttggatactataagaaaaacaagaaaaatgtcccggtgaagaagtgtgattacgacaccttctccaaaaacataaagtcaacgctggataaaatctgcgacaaggaggatcccttgtacattgaactcatcgacaaaatcgagaagggtggctttctgttaaagcagattgtaagcactaatagtgttatacctcaccaggtgcatgaactggagctagataaaatcctcgaaaacctggagaagaattatccatctttcaaagagatttccgacggggtcagcaagatcgataaaattaagatgatctttaacttcagaataccctactatgtgggacctcttaatgactaccacaaggataaagtgaactcgaatacctggatcgtcaagaacgaaggctttgagaatgaaaacattaggccatggaatttctctaaaatcgttgacgagcacgcttgtgaagaggagtttattaagcggatgatcaacgaatgctcctatatacccggtgagaaagtgttgcctaagtcaagtctgctctacagcgaatatatggtactgaacgagcttaataacctgcgagtgaatggggacaagttgaacccaaaaattaagaaagaaatcgtcgagaatatttacaagaaagagcgcaaggtgacactcaaaaagatcagaaacttcctgataatcaataactacgttgattccaaggtggaattttctggattaagcgacggcattaaagcaaatatgtcaagttatatcgatttcgccgagattctggacgataacttcgacaataacatggtcgaagatctaatcgagcagataactattcatgtgggcaatgtaaagctcctgaccgagaaaatctccaacaagtacccgaatcttgaaaagaagcaaatcaacaagattgttaacttgaaatttaaggactgggctaggttcagccggaaactgctcgtggggatcgagggaacagaaaaggagaccggtgaaattaatacgataatcggctttctgcgcgagactaacgagaatttcatggaattaatgtctaacagatatacattttcagaggaaattagtgagatcaaaaagaagtacattcccaataaactgagcaagcagatcgtcgatgacctttatgtgtcccctgccgtcaaaaagatgatatggcaagtgttgaacatcaatgatgaactcattaaagttctggggaagcagccaaagaaaatcttcattgagatggcgaggggaaaggaggaaaaacccgaggtgaaggactctcgtaaaaacaagctaatcgaactgtacaagaatctcggcaaagagggtaaggaatggctgaaccggatagaggataaaaccgaggcagactttcgaaatagagccctttatttgtactacactcagatggggaggtgtatgtatacaggcgaaattatcgacatcgagcgcctgtacgataaggaattatatgacctcgatcacattatacctcggaaaatgaagaaagacgattcgatccataagaacctggtacttgtcaccagaaatagcaaccagtacgagaagaaagacaattatccagtgcccgaggttattaagtccagggaaaacgtgcgccacctgtggtacgctttgaaaaagaaaggactcatcacggaggaaaagtataaccgactgacccggattaatccgctatcagataaggagctgagtgaatttatcgagcgtcagctcgtcgagacaagacaaactaccaaagtggtaaaggacctgtttgaaaactactacacagattctaaaatagtgactgttaaggccggccttgtcagcgagttgaggcgcgacttcgaagtgctgaaatgccgggagatcaatgatttaaaccacgcacatgacgcttttctcaatattatcgtgggggacgtctggtccaagaagttcacctcaaacccttataattttgttaaaaagaacagagaaaaatacacactgaataacattttcaccaagaatcagaaagatcttaggggaaacgagatctggaattgtgccgagggtaagaagcgaataattaaaactctgaacaagcccagcgtgctattctctgtggaaaattttgagcagacgggccaactcttcgaccagaacatcatcgggaaacaggattataaggaaaagacatcctacgtaccaattaagggagacgagcgcctgcaggatatcagtaaatatggcggttaccgggggataagcggcgcgtatttcttcattgtcgaacacaccgagaagaataagagagtgaaaactatcgagtctttgcctatttacatgaagtcctacgttgaagagaacggactgttagacttttgcaccaacgaaatgaaactcgtggatcccaagatcatagtcaaaaagctgaattataagtcagagattatcgtggacggcttcaaataccttatcagtgggaagacagagaacaggctgagcttggaaaccaatgagtatctctactggaaccatactcagacaacggatattaaaaagatcctgaatattaacgagaaaatagaactagaaaagtataatggagacatcgagtcggagcgtgaaaacattatcaagtacatccaaattatactggagaaatttaaacttaaaccattcatcaagcgccggaatctccccaacattgaaatcaattttgccgattatgagaccgaaaaactgttgcagctgttagttaacctcattcctctgactacaaagtacgtgtccccagtagaccttaccgtcatctctggtagcaagtacgcaggcaaagtgctgataccgaagaaaatctcaaatttgaacgaggtgattttcatcagtaagtccattacagggatctatgagtctagaaggcgaataatttga

SEQ ID NO: 2974 - RNA, 4017 nt, synthetic construct
  misc_feature 1..4017: note = Cas9 variant
  source 1..4017: mol_type = other RNA
atgaagcaggagtacttcctgggcctcgacatggggaccggaagccttggttgggccgtgacagattccacttatcaagtcatgagaaaacacggcaaggctctgtgggggacgaggttgtttgaatctgcatcaaccgccgaggaacggcgcatgttccgaacagcgcgtagaaggttagaccggcgcaactggagaatccaggttctgcaggagatttttagtgaagagataagcaaagtggatcccggattctttctaaggatgaaggagtccaaatactatcctgaagacaagcgggatgctgagggcaattgcccagaactcccgtacgccctgttcgtagacgataactatactgacaagaattaccataaagattatcccaccatctaccaccttcgcaagatgctgatggagacaaccgagattcctgacatccgattggtgtacctcgtcctgcatcacatgatgaaacatagaggtcactttctgctctctggggatatttcgcagatcaaggagttcaaatcaacttttgaacaattaatacagaacatccaggacgaggaactggaatggcacattagccttgatgacgcagccatccagttcgtggagcatgttttgaaggacaggaatctgacacggagtaccaagaaatcccgtctaattaagcaactcaacgctaaatctgcatgtgagaaggccatcctgaatcttctgagcggaggcacggtgaaattgtccgatatatttaacaataaggaactcgacgagtcagaacgcccaaaagtcagtttcgctgatagcggctatgacgattacattgggatcgtggaggccgaactggcggagcagtattacattatcgcatctgccaaggctgtatatgactggtccgttttagtggagatcctgggaaactcagtcagcattagtgaagccaagataaaagtgtaccagaagcaccaggcagatctcaaaactcttaagaaaatcgtgagacaatatatgaccaaggaggactacaagagggtctttgttgatacagaagagaaactgaataactactctgcttatattggtatgactaagaaaaatggcaagaaagtggacttgaagtccaagcagtgcacccaggccgatttctacgacttcctcaaaaagaacgtaatcaaagtgatagaccataaggaaattacacaagagatcgagagcgaaatcgagaaagaaaattttctgcccaagcaggtcaccaaggataacggggtgattccttatcaggttcacgactacgagctcaaaaagatcctggataaccttggaacgcggatgccattcattaaagagaatgcggaaaagatacagcaactgtttgagttccgaatcccctattacgtgggccctttgaaccgcgtcgacgatggtaaagacgggaagtttacttggtcggtgagaaaatctgatgccaggatttatccatggaatttcacagaagtaatcgacgttgaggcatccgctgaaaagtttatccggcgcatgaccaacaagtgtacttacctcgtgggagaggatgtcctgccgaaagactcattagtgtacagtaagttcatggtcctgaatgagctaaacaatctcagactgaacggcgagaaaattagcgtggaacttaagcagaggatatatgaagagttgttttgcaaataccgtaaggttacacggaagaaactggaacgatatctcgtgatcgagggcattgccaagaaaggggtagagatcaccggaattgatggtgacttcaaggcttccctgacggcctaccacgattttaaagaaagacttaccgacgtccagctgtctcagagggcaaaggaggccatcgtgttgaatgttgtgctattcggcgacgataagaaactgttaaagcaacgcctgagcaaaatgtatcccaacctaacaactgggcagctcaagggaatatgttcactgagttaccagggctggggtcggctttccaaaacctttttggaagagatcacagtccctgctccagggactggcgaagtgtggaatattatgaccgcgctgtggcagacaaacgacaatctcatgcaactgttaagcagaaactatggattcaccaatgaggtagaggagttcaacactctgaagaaggaaacggatctttcttacaaaacagtggacgaattgtacgtttcacccgcagtcaagaggcagatctggcagaccctcaaagtggtgaaggagattcagaaagtcatgggcaacgcccctaagcgcgtttttgtggagatggctcgagaaaaacaagaggggaagcggagtgatagccgtaagaaacagctggtggaactatatagagcctgcaagaatgaggaaagggactggatcactgagctgaacgcacagtccgatcaacagctccgctctgacaaactgttcctttactatatacagaagggacggtgtatgtactcgggtgagaccattcagttggatgaactgtgggacaatacaaaatatgatatcgaccatatttacccacaaagcaagaccatggatgactccttaaacaatagagtactcgtcaagaaaaactataatgccatcaagtcagacacttaccccctgagtcttgatatacagaaaaagatgatgtctttttggaaaatgctgcagcagcaaggcttcatcacaaaggagaagtacgtgaggttggttcgaagcgacgaactctccgctgatgagctggccgggtttattgaacgccagatcgtggagacgcggcagtcaaccaaagcagtcgcgactattctaaaggaggctctgccggacacagaaatcgtgtatgttaaagccggaaacgtgagcaatttcagacagacctacgagctcctgaaggtaagggaaatgaacgatcttcaccatgcaaaagacgcctatttgaatatagtcgtgggcaacgcttactttgtgaagttcacaaagaatgccgcatggtttattcgtaacaatcctggtcgctcttataacctgaaacggatgttcgagtttgatatcgaaagatccggggagatcgcttggaaggccggcaacaaaggaagtattgtcactgttaagaaagtgatgcaaaagaataacatcttagtaaccaggaaggcgtacgaggtgaaaggcgggttgttcgaccagcagattatgaagaaaggaaagggtcaagtccccataaaaggcaatgatgaacgactggccgacatcgagaagtatgggggatacaacaaagctgcaggcacgtactttatgcttgttaagagcctggataagaaaggtaaggaaattcggaccatcgagttcgtgccactatatctcaaaaatcagattgagatcaaccacgaatctgccatacagtacctggctcaggagcgcgggctcaattcccctgaaatcctgttatcaaagattaaaatcgacacactcttcaaggtggacggctttaagatgtggctgagtggaagaactggcaaccaacttattttcaaaggggccaatcagctgatcttgagccatcaggaggcagcgatactcaagggagtcgtgaaatatgttaacaggaagaatgaaaacaaagatgccaagctgtcggagcgggacggcatgaccgaggaaaagctactgcagctttacgatacatttctcgacaaactgtccaatactgtgtattctattcgattgagcgctcaaatcaagaccctgacggagaaaagagccaagttcatcggtttatcaaacgaagatcagtgcattgtcctcaatgagatactgcacatgtttcagtgtcagagtgggtccgcaaaccttaaactgatcggaggccccggttctgctggcattttggtaatgaacaataacatcacagcctgcaagcaaattagcgtgatcaatcagtccccaaccgggatatacgaaaaggagatcgacctcattaaactgtga

SEQ ID NO: 2975 - RNA, 4017 nt, synthetic construct
  misc_feature 1..4017: note = Cas9 variant
  source 1..4017: mol_type = other RNA
atgaccaagccctacagcatcggcctggacattgggacaaactccgtgggatgggccgtcgttactgatggttataaagtgcctgctaagaaaatgaaggtactcggcaatacggacaaatctcacataaagaagaaccttctgggggcattgttattcgattcaggaaataccgccaaagacagaaggctgaagcggacagcgcgccgacgttacactagaaggcggaaccgcatcctatatctccaggagatttttgctgaagagatggccaaagcagatgaaagtttctttcaaagactgaatgagagcttccttaccaacgacgataaggaatttgactcccatccaatcttcggcaataaagccgaggaggaagctcaccatcacaagtttccgacaattttccatctgaggaagcacttggcagattctaccgagaaatcggacctccggctgatctacctggccctcgctcacatgataaagtttcgcggtcatttcttaatcgaagggcagctgaaagccgagaacactaatgtgcagacactttttgatgacttcgtcgaggtgtatgataagaccgttgaagagtcacacttgagcgaaattagtgtgtcctctatcctgacggagaaaattagcaagtcccgaagactagaaaacctcatcaaatactatcccactgagaagaagaataccctgtttggaaaccttatagcgctgtcattgggcctccagcctaatttcaaaacaaacttcaagctgagtgaggacgcaaaattacaatttagcaaggacacttacgaagaggatctgggcgaactccttgggaaaattggagacaattacgccgatctgttcatctctgctaagaacttgtatgacgccattctactgtccggtatcctcaccatcgatgacaacacaaccaaggcaccactgtcagctagcatgattaaaaggtacgaggaacatcaggaggatcttgcccagctgaagaaatttatacggcagaatttgcccgaccaatatagtgaggtcttctctgataagacgaaagacggctacgcggggtatatcgatggaaagactaaccaggaagccttttacaagtatattaaaaatatgctctccaagacagagggcgcagactacttcctggacaaaatcgatcgtgaagactttttacgcaagcagagaaccttcgataacggtagcgtgcctcaccagatacatctgcaagagatgcacgctattctaaggcggcagggggaatactatccatttctcaaagagaatcaggacaagatcgagaagatcctgactttccgaataccctactatgtaggacctcttgcccgcaaaggctcgagatttgcttgggccgaatacaaggcagataaaaaggttacaccatggaacttcgacgatatcttggacaaagagaagtctgccgaagagtttattaccaggatgacgctgaatgatctctatctgccggaggaaaaagtgcttcccaagcactccctggtctacgagaccttcaacgtgtataatgaattgacaaaggtgaaatacgtcaacgagcaaggcaaggctatattctttgacgcgaatatgaaacaggaaatcttcgatcatgtttttaaggagaaccggaaagtgactaaggacaagctcctgaattacttaaacaaagagttcgaagagtttcgcattgtaaatctgaccgggctagataaggaaaacaaagcattcaactcaagtctcggaacatatcacgacctgagaaagatccttgacaagagctttttggatgacaaggtgaatgagaagatcattgaagatataatccagactctgaccctcttcgaggacagggagatgattcgtcagcggctgcaaaaatactccgatatctttacaacccagcagttaaagaaactggaacgaagacattatactggttggggcaggctttctgccaagttgattaacgggatccgcgacaaacagagcaataagacgatactcggatacctgatcgatgacggctattcaaaccggaatttcatgcaactaattaacgatgacagtctgccttttaaggaggaaatcgctagagcccaggtcattggtgagacagatgacctcaatcagctggtgtccgatatcgcagggagcccagccataaagaagggcattcttcagtctttgaaaatcgttgacgaactggtgaaggtcatgggacacaaccccgctaatattgtgatcgagatggccagggagaaccaaaccactgcaaaaggccgccgatcaagtcagcagcggtacaagcgtttagaagaggcgattaaaaatctcgaccacgatctgaaccataagatccttaaggaacaccctaccgacaatcaggctctgcaaaacgatagattgttcctctattacctgcagaatgggagggacatgtacacagaggatccactagacattaaccgcctgagcgattatgacatcgatcatattatcccccagtcctttataaaagacgattctattgacaacaaggtactcgtttcgagcgccaaaaatcggggaaagtccgacaacgtgccgtcagaggatgtcgtgaatagaatgaggcctttctggaacaaactgcttagttgcggtttgatctctcaacgaaagtacagcaatctgaccaagaaagaattaaagcccgacgataaagcaggcttcatcaagcgccagctcgtcgagactcggcagattacaaaacacgtggcccagatcctggacgctagatttaacacgaagagggatgaaaataagaaagttattcgtgacgtgaagataatcacccttaaatccaacctggtatcacaattccgcaaggattttaaattctataaggtccgggagattaatgactaccaccatgcccacgatgcatatctaaacgctgtgatcgggaaggccctcctggacgtttacccacagttggaacctgagtttgtgtatggagagtacccccatttccacggctacaaagaaaataaggcgactgccaaaaagtttttctatagcaacattatgaactttttcaaaaaggatgacatcagaacagatgagaatggtgaaatagtctggaagaaagacgagcatatctctaatattaagagggtgctgtcctacccacaggtaaacatcgtgaaaaaggttgaaattcagaccgtcgggcaaaacggcggattatttgacgataatcccaaaagtcctctcgaggtgacaccaagcaagctggtgccgcttaaaaaggagctgaaccccaagaaatatggcgggtaccagaagcctactaccgcttatccagtcttgctcatcacggacaccaaacagctgatacccatttctgttatgaataagaaacagttcgaacaaaaccctgtgaagttcctacgagatcggggataccaacaggtgggtaagaatgactttatcaaactgccaaagtatacacttgtagatatcggcgacgggattaaacgcctctgggcatcctcaaaggagatacacaaaggaaaccagctggtcgtgagtaaaaagagccagatcttgctgtaccacgcccatcacttagattcggacctctccaatgattacctgcagaaccataatcagcaattcgacgttctttttaacgaaattatctctttcagcaaaaagtgtaaactgggcaaggagcacattcagaaaatcgaaaatgtgtattcaaacaagaagaatagtgcttccatagaggagttggccgaatcttttatcaaactcctgggtttcactcagctaggggcaaccagcccctttaacttcctgggcgtcaaacttaatcagaaacaatacaagggcaaaaaggattatattctcccgtgcacagagggaactctgatcagacagtccattaccgggttgtacgaaacgagggtggacttatcaaaaatcggagaggattga

SEQ ID NO: 2976 - RNA, 4017 nt, synthetic construct
  misc_feature 1..4017: note = Cas9 variant
  source 1..4017: mol_type = other RNA
atgagagactactatatcggcctggatctcgggaccggaagccttggttgggccgtgacagacagggagtacgaaattatgcgggctcacggcaaggcactgtggggagtccgcttgttcgattccgccaacactgcggaggaacgacgtgggtttagaacggctaggcggcgcttagacagaaggaattggcggatagagctgctacaggaactcttcggcgaggatatcggtaaagttgactctgggtttttcctgcgcatgaaggagtcaaaatatatgcccgaagataagcgagacgtgaacggaaattgccctaaacttccatacgccctgtttgtagaggatggctataccgacaaggattaccatagacaattcccgacaatttatcacttgaggaagtggctcatggaaactgaggagacccccgacatccggctggtgtacctggcactccatcacatgatgaaacatcgtggccactttttattcagtgggaacattgaaaagatcaaagagtttcaggaaacattccgccagtacataggaaagatcagagaggaagaactggattttcacctttgtattgagggtgaagagttgagggaaaccgagaatatcctgaaagacaagaacctaactcggagcgccaagaaaacacgactcattaagctgcttggcgctcataccgcatgcgaaaaagccgctctgaatttggtcgccgggggaacggtgaagctctccgacatcttcggcaactctgagctggatgcgtgtgagaaacctaagttatcgtttgcagacgccggttatgatgactacgctgggatgatagaagatgagctgggagaacagcacgttattatcgagactgccaaagcagtgtatgactggtcagtcctcgctgatattcttggcgactaccgctgcatcagcgaagccaaggcggccgtgtatgagaagcatcaaaaagatctgagacacttgaaggagctagtaaaagaaaatctgggcagggacgtttacaaggaggtgttcgtcaaaaccaacgaaaagctcccaaattatagtgcatacatcgggatgacaaagaaaaacggagtgaagtccgagatggagggtaaacggtgtgatcgcaaggctttctacgactatctgaaaaagactgtggtcaatgccattcccgacgaatctaagaccgagtaccttagaaaagaaatggagacagaaacctttctgcctaggcaggttacgaaggataacggcgtgataccacaccaggtacatttgcaggagctcgacgctatcctggagaatttaagcgggcgtattcccgccctgaaagaaaacggatccaagatccgggatatattcacttttcgaatcccttattacgtgggcccactaaacggtattgtcaaagggggcgagagaacaaattgggtgaggcgcaagaaggcaggacggatctgcccgtggaacttcgacgaaatggttgataccggcgcctcagctgaggaatttattagaaggatgacaagtaaatgtacttatctcatccacgaggacgtgctgcccaagaatagcatgctttactctaaattcatggtcttgaacgagctgaataacgtgcgcctcaatggggaacctatttccgtagagctgaagcagaaaacctatgaagatctttttcaacgacatcggaaggttacgcgtagaaggctgaccgactacatacgccgggagggaatcgcgggtagagatgcagacattacaggcatcgatggggacttcaaaggatcattgactgcctaccacgattttaaggaaaagctcaccggctgcgagctgagccaggctgacaaagagaacatcattttaaatataacactgttcggtgaagacaaggccctactcaaaaagaggctgggggcactttatccagccttgactgagccccagaaaaaggctatctgtgccctgagttacaagggctggggacgactctctcaacgcctgttagaaggcattaccgcgcctgcaccagagacaggggagatctggaccgtgattcgggctatgtgggaaactaacgataatctgatgcaggtcctttccgagaaatattgctttgccgcagccatcgacgaagagaacgctggagaagagttgaaggagataacgtacaaaacagtggaacagatgaatgtcagccccgccgtgagaaggcaaatctggcagtcgctccaggttattaaggagatctgtaaagtgatgggtggcccgcctaagcgtgtattcgtcgaaatggcacgcgagaagatggaatctaaacggaccgagtccagaaagaaaaggctgattgatctatataagaaatgccgagaggaagaacgggactggatcgaggagctggggaacactgaagagacccgcctcagatcagataagctgtacctttattacacacagaagggaaggtgcatgtacagtggcgaggtgatagaattggaggaactgtgggacaatcggaaatatgatattgaccatatctacccccaaagcaaggttatggatgactccttagataaccgagtgctcgtcaaaaaggagtataacgctgacaaaaccgatgagtacccaattagagccgacatccgcggtaagatgagggcgttttggcgtatactgcgggaagaggggttcatctctaaagaaaagtataatagacttactaggggcacaggattcgagcctagcgaactggccggctttattgctcgccagttggtggagacgcgacaggggaccaaggcagtagcctcagtgctcaaacaggttttccccgagactgacatcgtctacgctaaggccagagtggcaagtcaatttcggcaggagttcgatctgattaaagtgagggagatgaacgacctacaccacgcgaaggatgcctatgtcaatatcgttgtgggaaacgtgtactacacaaaatttacctccaatgctgcctggtatgtaaaggaacatccaggccgcagctacaacctgaagaaaatgttcacatctgagcgtgacgtcgcaagaaatggtgaaactgcttggcgggccgggaactcaggaaccatagcaacggtgaagagggttatgggcaaaaataacattctcgtgacccgccgaagttatgaggtcaagggtggcctgtttgatcagcagcttatgaaaaaggggaagggacaagtgcccatcaaaggcagagacgagcggttggccgatatcgacaagtacgggggatataataaagctgcgggcacatacttcatgctggccgaaagcgaggataagaaaggtgcaaagattaggtccgttgaatatgtgcctttatacctctgtaactgcatcgagaaggacgaagaggctgccaaaaagtacctgcagaaagagcgcgggcttaagaatccaagagtactgattgccaaaataaagatcgatactctatttaaggtcgacggattctatatgtggctctctggcaggaccggtaaccagctgatttttaaaggcgctaatcagttgatcctgtcggaaccggacatgcggattttaaagaaagtgctcaagtacgtgaaccgtaaaaaggagaacaaaaatgcagtcctgggggaacacgatcaacttcccgagacagacctgatccgcttgtatgatgttttcctcgacaagatagagaacactgtgtaccatgtacgactgagcgcccagcagggaaccctaacgaagaataaagatacattttgtgaactgtccaacgaggacaagtgcatcgtgctttcagaaattctccacatgttccaatgtcagagtggctctgcgaatctgaaattgatcaaggggcctggaagcgctggcattctggtcttaaacaatatcatatccaaatgcaaccaggtgtcaattatccaccagagcccaaccggtatctatgagcaagaaattgatctcaagaagatatga

SEQ ID NO: 2977 - RNA, 4020 nt, synthetic construct
  misc_feature 1..4020: note = Cas9 variant
  source 1..4020: mol_type = other RNA
atgaacaaggcctacaccctgggcctcgacatcgggacaaatagcgtgggatgggctgtcgttactgatgactatagacttatggcgaaaaagatgcccgtgcactccaaaatggagaagaaaaagattaagaaaaacttctggggtgccaggctgtttgatgaaggccagacggcggaggaacggcgcaataagcgagctacccgtagaaggttgcggcgcagaaaatacaggatattagagctgcaaaagatcttctctgaagagattctaaagaaggactcacactttttcgcccggctcgatgagagttttctgatccctgaagacaagcagtatgcacgcttcccaatttttccgacacttctggaggaaaaagcctactatcagaactaccccactatctatcacttgcgacagaagctcgctgatagcaccgagaaagcagacataagactggtatacctggccctcgctcatatgatcaagtacagggggcacttcttatttgagggagaactggatacagagaatacctccgtggaagagactttcaaagaatttattgacatctataacgagcaattcgaggaaggcattatcttttacaaggatatacctcttattttgacagacaaactgtctaagtcgaagaaagtcgagaagatcctacagtattacccaaaagaaaagaccacgggttgcctcgcccagttcctgaaacttattgtggggaatcagggaaacttcaagcaagcgtttcatctggatgaggaagttaagatccagatctcaaaagagacttatgaggaagacttggagaagctcctgcggaaaagcaatgaagagatgattgacgtgttcttacaggtcaagaaagtgtacgatgcaatactgctcagtgacatcctttccaccaagatgaaggatacaaaagccaagctgtctgctggcatgattgaacgttatcagaaccacaaaaaggacttggaggagctaaaacaatttgtacgcgcccatctgcatgaaaaggttactgtgttctttaaggatagctccaaagacggctacgcagggtacatcgatggaaagaccacacaggctgacttctataaatttctcaagaaagagctgaccggtgtccccggctcagaacctatgcttgccaagatagatcaggagaatttcctgttgaaacaaagaacgccaactaacggggtgattccccaccaggtgcatctcacagagtttaaggcgatcatcgaccagcagaagcaatactatcctttcctggaaaagagtaaggagaaaatgattcagttactgacctttaggatcccatactatgtcggaccgctagcccaggataaggaaactagctctttcgcatggctcgagcggaaaacaaccgaaaagattaagccctggaatgctaaagacgttatagactacggcgcctccgctacgaagtttatccagcgaatgattaactatgatacctacctgcctacagagaaagtgcttccaaagtactcaatgttgtatcaaaaatacactatcttcaatgagctgaccaaggtagcctataaggacgatcgcggtatcaaacaccagttcagcagtgaagagaagctcagaatttttcaggaactgttcaaaaagcagaggcgggtgacaaagaagaaacttcaacactttctgtctgcaaactacaacatagaggacgccgaaatcttgggggtcgataaagtgttcaattccagctatgctacttaccatgactttctcgagctggcgaagccctataccgagaaaattatcgaattactggagcagcctgaaatggaggaaatgttcgaggatattgttaagatcataacaatctttgaggaccgcgaaatggtgagaacccagctcaaaaagtaccagaggattctaggagaggaaatcttcaaaaagctggtcaagaaaaagtacactggctggggccgtctttcgaaacggttgattaacgggatccgagatcaaaagacgaataaaacaatactggactatctcattaacgatgacgattttccatacaatagaaacaggaatttcatgcagctgatcaacgacgaccacttatcttttaaggaggagattgcaaaggaactgaccctttccgataaacagtcattgctcgaggtggtagaagccatccccggaagtccggctataaagaaaggtatctggcaaactctgaagattgttgaggaactaatcgccattatcggctataaacctaagaatatagtgattgagatggcacgcgagaaccagaccacaaccgggggaaagaatcggagcaaacccagactgaagtccctcgaagaggccctgaaaaacttcgactctcagcttttgaaggaaaggccagtcgataatcagagcctgcaaaaagaccgcttatacctctattacctgcagaacggcaaggatatgtatactggtgagtcacttgacatcgatcgactgagtgaatacgacatcgatcatattatccctcggtcctttattgtggaccacagcttggataataaggtcctcgtgtcttcaaaagagaaccgtctgaagaaagacgatgttcccgacagtaaggtggtaaaaagaatgaaggcttactgggagaagctactgagggccaacctcataagcgaacgcaaattctcctatctgacaaaacttgagttgacggacgatgacaaagcacggttcatccagagacagctggtcgaaaccaggcaaattactaagcatgtggcggctatcttacaccagtactttaatcagacacaggagctcgaaaaagagaaggatattcgaatcataaccctgaaatcttcgcttgttagccaattccgccaggtgtttgggatccacaaggtccgggagattaaccatcaccatcacgcccacgacgcatatctgaatgccgtggtagctctagccctcctgaagaaatacccaagattggcacccgagttcgtgtatggctcctttgctaagttccatctggttaaagaaaacaaggccacagcgaaaaaggaattttactcaaatatcttaaagttctttgagaaagaggaacagttctgtgatgagaacggagaaatcttttgggacaagaggaaacacattcaacagataaagaaagtcattagttctcatcaggtgaatatcgtgaagaaggtcgaggttcagactggcagcttctataaagaaaccgtgaacacgaaggagaaacctgataagctcatcaaacgtaagaataactgggacgtgaccaagtacgggggattcggttccccagtagtcgcctacgctgtggtttttacatatgagaaaggcaagaatcacaaaaaggcaaaagccattgaagggataactatcatggagcaagctctgttcgaaaaggatccgatttcatttcttatcgagaaaggatacagcaacgtgaatcagttcattaagctgcccaagtataccttgtttgaactcgccaacggccagcgccggatgctggcatctcatcaggagctacaaaaagcaaattccttcatcctgcctgagaaacttgtcacactcctgtaccacgccaaccactatgacgaaatagcttacaaagatagttatgactacgtgaacgagcattttagcaatttccaggacatcttggataaggttattatctttgccgaaaaatacacttctgcaccacagaagctgaaccagattatcgctacctatgagaagaatcaagaagccgacagaaaaataatggcacactccttcgtgaacttaatgcagtttaatgccctcggtgctcccgcggatttcaagtttttcgacacgacaattaccaggaaacgatacacttcactgacagagatctggcagagtaccatcatttatcagagcgtaactgggctttacgagacccggcgcagaatggccgatctgtgggacggcgtccaatga

SEQ ID NO: 2978 - RNA, 4020 nt, synthetic construct
  misc_feature 1..4020: note = Cas9 variant
  source 1..4020: mol_type = other RNA
atggagagataccacatcggcctggacattgggaccagctccataggatgggccgtgatcggtgatgacttcaagattaaaaagaaaaagggcaaaaacctcatcgggacaaggctttttaatgaaggagctactgcagccgagcggcgcggcttccgaacgcagcgtagaaggctgaaccggcgcaagtggagattgaagttactggaagagatttttgatccctatatggcggaagtcgacgagtacttctttgctaggctaaaatcttcaaatctcagtcctaaggatagcaacaaaaagtatctgggttcccttctgttcccagacaaatctgattcgaatttttacgacaagtatccgaccatctaccatttgcggcgcgatctcatggagaaggacgaaaaattcgatctgcgagagatatatctggccatccaccatattgttaagtacagagggaactttctcgaaaaagtgcccgcaaagaattacaaaaactcaggagccagcatcggcttcttactggaggaggtaaatagtctttataaggacattatcggcgatgaatccatagctattttgaactctgagaaatttgaagacgtggagaagatcattctggacgaagagacaaggaatctagataagcaaaagagcgtcgggaagctcctggtggaggacaaaaagaaaaagaacatcgttactgcattctccaaggccatctttggatacaaattcaatattgaagatcttctgttgatagagaacgacgaaaagaataaactcaccttcaacgatgagaacatcgacgatatttttaatgaactgtcacacagtttagacgataagcagatggacctgctcacaaaaacccgggagatctatttcaagtttaaacttaacatgatagtgcctactggttacacactgagcgagtctatgattgaaaaatatgagatgcataaggctcacttgaaaatgtacaaggagttcatcaataccctaaacacgaaagatcgtaagatcctgaagaatgcctattccgactacattaacactgagaaagcgaaggcagccaatgctcaggaaaacttttacaaaaccgtcaagaaaatcattaaggacaataactcagatacagccaaaaagataatcgtgctcattgacgagggcaatttcatgccaaagcagcgcactggggagaacggagtaatcccccaccaactgcatcagatcgaacttgatagaattatagagaatcaggcaaaatattacccttggctggctgaagccaacccagttgagaagaataggaaatttgcgaagtataaattggacgagctcgtgaccttccgggtcccctactatgtgggccctctgatcgataagacagaaagcaacaagaacgagaaagaaaccaagtttgcctggatggtgcgaaaagcaaagggtacgattactccatggaatttcgagaacttagtcgaccgcacagaaagtgctaatagatttatcaaaaggatgacctctaaggatacttacattatcggggaggacgttctgccggcctccagcctactctatgagaagttcaaagtgctgaacgaacttaataacataaaggtaaatgagaaaaagttggatatcgaacagaaacaagacatttacctgaacctctttacaaccgctaagaatgtgacgaagaaatcgctggccacctaccttaactgctctgcagattccatctcaggactgagtgacggcgagaagttcaatagctccttgtctagctatattgatctcaaagccatcctgggcaacatagtcgacgactgtaataagaacgaagatttagagaaaattatcgagtactcaacagtgttcgaagacgggaatatttataaggagaaactgagtgaaatctcctggctaactgatgagcagatagaaaagctcagcaacatccactttaagggatggggtcggctgtctaaaaagttgcttacccagattacaaacgagaatggcgagcgcatcattgacgctctgtggaacacttcaaataacttcatgcagatcataaatgatgaaagtattcaagcgaaactcgcagagatcaacgggaagtacgccggaaaaagcgacctggaagatatcttatccgaggcttatacctctccccagaataagaaggccattagacaggttatgaaagtggtcgaggacatcgaaaaggcaatgcaatgcgagcctacatcgattagcatagaatttaccaggaaaaagcagaaatcccgtctgactaacacgcggtacaagaagatctcagatgtgtatgagaaaattgccgacgaagtaatcagtgagtacgagcttcgaaagttgcagtctgaactcgatagcaatgctaacaatatgagagacaggtactatctgtacttcatgcagctaggccgcgatatgtatacaggtgagaaaattaacatcgacgaactgcatcaacggtacgacatagatcacatcctcccacagtcctttattaaggacgattcaatcaataacagagttctgaccaggaaagacgtgaataacaaggaaaagagcgataaaactgccgcagacctttatgcggtcgaaatgtctgatttctggcgcaagttgcgaaaacaggggctgattaccgagcagaagtacaaaaacttactcacaaagtccgacagtatcgataagtatgctaaaaagggctttataaaacggcaactggtggagaccagccaggtcgtgaaacttgttgccaatattctgcaggacaagtactctgatactaagatcatcgaagtgcgtgcaaaattgaactccaatctcagagaggaatacaagctgattaagaacagggccgtaaatgactatcaccatgctatagacggatacctaacaacgttcatcggccagtatctgtacaaaacctatcccaagctccgctcatactttgtctataacgatttcaaaaagctggacagtaattaccttaaacacatgaagaagtttaacttcttgtggcaactgcaggatgacaaaactattgatatctacgacaatgtgaacaataagtttgttttaaacgtgcctgagatgaaaaagtatattcagaaaatctacaattataagtacatgctcgtcagcaaggaagtgacaaccaaaaacggggccttctatgatcagacaaagtacaatgcaaaaactgtaaacctgataccaatcaagaaaaataagcccaccaacatttatggaggttacaagggcaaagtgtcgtcctacatgatgcttgttaagatccggaaaaagaaagaggtcatttataagttcgtgggggtgccgagactgtggacggacgagctagataggctcaaagacaccacagaacgaaagatcctgttgaacgagatagctaaaaattctctgagcaagactgaacaagattttgaggtcattttagacaaggtttactatggacagctcatcatcgatggcaaccagaaatacaccctgggttcaagtgagtataagtacaatgccatgcaacttcatctgtccaaacacgcgttggaagtgctcgccaaggagaacgtgaaggacgctgaaattacagacaaagatctggtatctgtctatgaggaaatcctaagcgtggttaataagtacttcgagctgtacgacataaacaaatttcgccagaaacttaatgaggggctcgaaattttccggaagctgcctgtgtataacgtctacgagtccaataagatcaaacaggtgggcaagtttgaagttttgaacaggattctgatgggattacatgcaaatgccatgatcactgatctcaaggtgctgggcataaaaaccaaacttgggcagatgcaagtaaacggaggtattaagctgtcacccgacgctaagttgatctatcagagcccaacgggcatcttcagtagagccgtccgtgtgaaggatctcgggtga

SEQ ID NO: 2979 - RNA, 4020 nt, synthetic construct
  misc_feature 1..4020: note = Cas9 variant
  source 1..4020: mol_type = other RNA
atgagcctgaacaccaataagaaatacaacatcggcctcgacattgggacaacttccgtgggatgggccgtcacggatgctgacggtcagaaacttctgaaagcaaagaataaaaacttgtggggcgtttctttattcgaggccgggaagaccgcggctgaaagaaggggatatcggtcaacacgccgacgtctgaatcacagaaagtttaggctacggctcctggaggatatgttcgaaaaagagatacttagtaaggaccccagctttttcatccgcctgaaagaagcctttttgtcccctaaggatgagcaaaaacagttcaagggcaacattctctttaatgacaaggattacactgacgcagattattacgagcagtataaaaccatctaccatctgagatatgacctgatttctcagcacaggcaattcgatatccgggaagtgtacctcgccatacatcacttaatcaagtaccgcggtcattttatttatgaggaccagacattcaccactgatgggaaccagctgcagcaccacatcaaagctattatcacaatgataaattcgattcttaaccgaatcattatcccagaaaccatcgacattaatgtatttgagaagacgttgctggacagaactatgaacaggtcaagcaaagtgaagttcctaatagagctcaccggagaagataaacaagacaagccgctgcttaaggagctgtttaatttgatcgtcggcctcaaagcaaagcccgccagtattttcgaacaggagaacctggctacaatcgtggaaactatgaatatgtccaccgagcaggttcagttagatctgctcacacttgccgacgtgctggcggatgaggaatacgacttgctactgaccgcacaaaagatatattctgccattatcctcgatgagagcatggacggctacgaatatttcgctgaggccaagaaagaatcctaccggaagcatcaggaggagctggtccttgtgaagaaaatgctgaagtcaaacgcaatcacgaacgatgaacgtgctaaatttgagtatttctacactgactacattggggccaagagtagcaattatgaagagtctaaaatcattaagaagggattgtccgcggcctacggtaaatattcaaaggaagaacgcctctttaaacacatagagctgttactggcaaaggaaaacgtactaacaaccgttgagcatgatctcctggaaaagaatatcactttcgctagccttttgcctctgcagagaagttctaggaacgccgtgattccataccaagtccacgagaaggagctcgtggctatcctggaaaatcaggccacatattacccctttcttctggagcagaaggacaacatccacaaattgctcaccttccggattccttattacgtgggcccactggcagaccagaaggattccgaatttgcctggatggtccgaaaacaagctgggaagataacgcccttcaattttgaggaaatggttgacatcgatgcgagctcggaggcattcattaaacgcatgaccaacaagtgcacatacttaatccatgaggacgtgattcctaaacactctttttcctatgccaagttcgaagtactgaatgagctaaacaagatcagactcgatggaaaaccaatagacatcccgctgaagaaaaggatttttgaaggccttttcttggagaagactaaagtgacccatacatcactgaagaagtggctcgctgaatacgagcacatgactgtcagtgtggttcagggtacccagaaagagacagagttcgccaccagcctgcaggcatttcatcggttcgtgaagatctttgatcgcgagactgtctccaatcccgccaacgaagagatgttcgagaaaattatctattggtctacggtgtttgaagacaagaaaataatgagaaggaagttaagcgagtaccctcaactgacagaacagcagcaggtacaacttgctcaggttcgtttccgggggtggggacgattgtcacagagactcattaataggatcaagaccccagtgagtggcgatgaggaccacaaactgtccattaacgaaatcctatggcagactaatgagaactttatgcaaataatccgcaacaaggattatctgttcaaaaagattatcgaggaacagtttgagaatgaaaccgccctcctgaacaaacagcggattgacgagcttgcaacaagccccgcgaataagaagggcatctggcaagctataaaaattgtcaaggaattggagaaagtgctgcagcagcctgccgagaacatcttcatcgaatttgcaagatctgatgaggaatcaaagaggagtaccccacgcgacaaattcattgagaaggcctacgctcagctcaaaaaggaaactgacacatttaatttagagcacctgaaggagcttaaacaacgaagcaagcagctgtcctctcagcggttgttcctctatttcatccagaacgggaaatgtatgtactcgggagaacatctggatattgagcgtctagacagctacgaagtcgatcacatactgccccaatcctatatcaaggacaattcaattgagaacctcgccctggtgaaaaaggttgaaaatcagagaaagaaagatagtcttttgctgaactctagcatcattaatcagaactactccaggtgggagcagttaaagaatgcaggtctcatcggcgagaaaaagtttcgcaacctgacgcggaccaaaataactgacagagataaggaagggttcatcgctaggcaacttgtggagacacgacagattaccaagcatgtaacacagctgctacaacaggaatataaagacactaccaaggtctttgccatcaaagcgacgctcgtgtcagatctgcgccggaagttcgagtttattaaaaatagaaacgttaacgactaccaccacgcccaggatgctttcttggtggcatttctgggaaccaatatcacaagcaactatccgaagatagagatggaatacttattcaagggctatcagcattacctcaatgaggtcggtaaatctgccgctaagcctaaatttactttcattgtggaaaacctgtccaagcaacagtacaatagtaccacaggggaggtaaaatggaaccccgaagtggacatcgccaaacttaagaggatcctgaattttaaacagtgcaacattgttcgtaaggtcgaggagcagagcggcgcattgttcaaagaaactatatatccagtggaggaatcttcctcaaagaccatccctctcaaaaagcacctggatacggcgatttacggaggctatacagccgtgaattacgctagttatgccctaatccaattcaaaaaggggcgcaagctgaaacgggagattatcggaataccccttgcagtccagaccagaatcgacaacagcgaaacttcgctccagacatacattgctgagcagatcaagtccgaggttgaaattctgaatggtaggatcttgaaatatcaactgatatctaacaatggcaaccgattatacattgccgggccacgggagcgccataatgcaagacagctcatcgtgagcgacgaagccgctaaggtgatctggctgatttcaaccaaacaggcggtagaggccacttttcttaagcactacaccctggaacatttggaggcagtcttcgaggaactcatcaggaagcaggctgccgattatcaaatatttgagaacctgattaaaaagatcgaagtgaacaaagcctacttctatagttgtacatacaatgagaaggttaaagtgattgaggaactactgaagatcacgcaggctaacgcaaccaatggagaccttaagctcctgaaaatgactaaccgggagggccgattgggttccgtctctgtggccttagattttaagataattaatcagagcgttacagggctgtatcaatccatcgaagactacaacaattga

SEQ ID NO: 2980 - RNA, 4020 nt, synthetic construct
  misc_feature 1..4020: note = Cas9 variant
  source 1..4020: mol_type = other RNA
atgagcctgaacaccaataagaaatacaacatcggcctcgacattgggacaacttccgtgggatgggccgtcacggatgctgacggtcagaaacttctgaaagcaaagaataaaaacttgtggggcgtttctttattcgaggccgggaagaccgcggctgaaagaaggggatatcggtcaacacgccgacgtctgaatcacagaaagtttaggctacggctcctggaggatatgttcgaaaaagagatacttagtaaggaccccagctttttcatccgcctgaaagaagcctttttgtcccctaaggatgagcaaaaacagttcaagggcaacattctctttaatgacaaggattacactgacgcagattattacgagcagtataaaaccatctaccatctgagatatgacctgatttctcagcacaggcaattcgatatccgggaagtgtacctcgccatacatcacttaatcaagtaccgcggtcattttatttatgaggaccagacattcaccactgatgggaaccagctgcagcaccacatcaaagctattatcacaatgataaattcgattcttaaccgaatcattatcccagaaaccatcgacattaatgtatttgagaagacgttgctggacagaactatgaacaggtcaagcaaagtgaagttcctaatagagctcaccggagaagataaacaagacaagccgctgcttaaggagctgtttaatttgatcgtcggcctcaaagcaaagcccgccagtattttcgaacaggagaacctggctacaatcgtggaaactatgaatatgtccaccgagcaggttcagttagatctgctcacacttgccgacgtgctggcggatgaggaatacgacttgctactgaccgcacaaaagatatattctgccattatcctcgatgagagcatggacggctacgaatatttcgctgaggccaagaaagaatcctaccggaagcatcaggaggagctggtccttgtgaagaaaatgctgaagtcaaacgcaatcacgaacgatgaacgtgctaaatttgagtatttctacactgactacattggggccaagagtagcaattatgaagagtctaaaatcattaagaagggattgtccgcggcctacggtaaatattcaaaggaagaacgcctctttaaacacatagagctgttactggcaaaggaaaacgtactaacaaccgttgagcatgatctcctggaaaagaatatcactttcgctagccttttgcctctgcagagaagttctaggaacgccgtgattccataccaagtccacgagaaggagctcgtggctatcctggaaaatcaggccacatattacccctttcttctggagcagaaggacaacatccacaaattgctcaccttccggattccttattacgtgggcccactggcagaccagaaggattccgaatttgcctggatggtccgaaaacaagctgggaagataacgcccttcaattttgaggaaatggttgacatcgatgcgagctcggaggcattcattaaacgcatgaccaacaagtgcacatacttaatccatgaggacgtgattcctaaacactctttttcctatgccaagttcgaagtactgaatgagctaaacaagatcagactcgatggaaaaccaatagacatcccgctgaagaaaaggatttttgaaggccttttcttggagaagactaaagtgacccatacatcactgaagaagtggctcgctgaacacgagcatatgactgtcagtgtggttcagggtacccagaaagagacagagttcgccaccagcctgcaggcatttcaccggttcgtgaagatctttgatcgcgagactgtctccaatcccgccaacgaagagatgttcgagaaaattatctactggtctacggtgtttgaagacaagaaaataatgagaaggaagttaagcgagtatcctcaactgacagaacagcagcaggtacaacttgctcaggttcgtttccgggggtggggacgattgtcacagagactcattaataggatcaagaccccagtgagtggcgatgaggaccacaaactgtccattaacgaaatcctatggcagactaatgagaactttatgcaaataatccgcaacaaggattacctgttcaaaaagattatcgaggaacagtttgagaatgaaaccgccctcctgaacaaacagcggattgacgagcttgcaacaagccccgcgaataagaagggcatctggcaagctataaaaattgtcaaggaattggagaaagtgctgcagcagcctgccgagaacatcttcatcgaatttgcaagatctgatgaggaatcaaagaggagtaccccacgcgacaaattcattgagaaggcctatgctcagctcaaaaaggaaactgacacatttaatttagagcatctgaaggagcttaaacaacgaagcaagcagctgtcctctcagcggttgttcctctacttcatccagaacgggaaatgtatgtattcgggagaacacctggatattgagcgtctagacagctacgaagtcgatcatatactgccccaatcctacatcaaggacaattcaattgagaacctcgccctggtgaaaaaggttgaaaatcagagaaagaaagatagtcttttgctgaactctagcatcattaatcagaactattccaggtgggagcagttaaagaatgcaggtctcatcggcgagaaaaagtttcgcaacctgacgcggaccaaaataactgacagagataaggaagggttcatcgctaggcaacttgtggagacacgacagattaccaagcacgtaacacagctgctacaacaggaatacaaagacactaccaaggtctttgccatcaaagcgacgctcgtgtcagatctgcgccggaagttcgagtttattaaaaatagaaacgttaacgactatcaccatgcccaggatgctttcttggtggcatttctgggaaccaatatcacaagcaactacccgaagatagagatggaatatttattcaagggctaccagcactatctcaatgaggtcggtaaatctgccgctaagcctaaatttactttcattgtggaaaacctgtccaagcaacagtacaatagtaccacaggggaggtaaaatggaaccccgaagtggacatcgccaaacttaagaggatcctgaattttaaacagtgcaacattgttcgtaaggtcgaggagcagagcggcgcattgttcaaagaaactatatactctgtggaggaatcctcaagtaagaccatcccactcaaaaagcatctggatacggcgatttatggaggctacacagccgtgaattatgctagctacgccctaatccaattcaaaaaggggcgcaagctgaaacgggagattatcggaatacctcttgcagtccagaccagaatcgacaactcggaaacttccctccagacatatattgctgagcagatcaagtctgaggttgaaattctgaatggtaggatcttgaaataccaactgataagcaacaatggcaaccgattatatattgccgggccccgggagcgccacaatgcaagacagctcatcgtgtcagacgaagccgctaaggtgatctggctgattagtaccaaacaggcggtagaggccacttttcttaagcattacaccctggaacacttggaggcagtcttcgaggaactcatcaggaagcaggctgccgattaccaaatatttgagaacctgattaaaaagatcgaagtgaacaaagcctatttctactcctgtacatataatgagaaggttaaagtgattgaggaactactgaagatcacgcaggctaacgcaaccaatggagaccttaagctcctgaaaatgactaaccgggagggccgattgggttctgtcagcgtggccttagattttaagataattaatcagtccgttacagggctgtaccaatcaatcgaagactataacaattga

SEQ ID NO: 2981 - RNA, 4020 nt, synthetic construct
  misc_feature 1..4020: note = Cas9 variant
  source 1..4020: mol_type = other RNA
atgaagaaagagtacaccatcggcctggacattgggacaaacagcgtgggatggtccgtcctcactgatgactatagacttgtttctaagaaaatgaaggtggccggtaatacggaaaaatcaagtaccaagaagaacttctggggcgtaaggctgtttgatgaggggcagacagctgaagcacggcgcagcaaacgaactgcccgtagaaggttggcgcggcgcagacaaaggatattagagctgcagaagatcttcgctcccgaaattctaaaaatcgacgagcactttttcgcccggctcaatgagtcctttctggtgcttgatgaaaagaaacagtctcgccatcctgtcttcgcaaccattaagcaggagaagtcgtaccaccaaacatatccaaccatctaccatctgcgacaggccttggctgactcaagcgaaaaagcagatataagactcgtgtatctggccatggctcatctgctcaagtacaggggacactttttaatcgagggcgagctgaacactgaaaatagttccgttacagagaccttccggcagtttctttctacgtataaccagcaattcagcgaagccgacgataaacagactgagaagttggacgaagcggtggattgctcctttgtcttcaccgagaaaatgtcaaagactaaaaaggcagagacactgctaaagtactttccgcacgagaaaagtaatggttacctcagccagttcattaagctgatggtggggaaccagggaaatttcaaaaacgtatttggccttgaagaagccaagctgcaattctctaaagagacctatgaagaggacttggaggaactcctggagaagatcggcgatgactacattgacttatttgttcaggctaagaatgtgtatgatgccgtcctgctctccgaaatcctttcagacagcaccaaaaacacacgtgcaaagctgagtgctgggatgatacgcagatacgatgcccacaaagaggacttggtgctactgaagaggttcgtgaaagaaaatctccccaagaagtatcgggcgtttttcggagataactctgtcaatggttacgccggctatattgaggggcatgcaacgcaggaggacttttacaaattcgttaagaaagaactgactggaatccgaggctccgaggtgtttcttacaaagattgaacaagagaacttcctgcgcaaacagagaacctttgataacggtgtaatccctcaccagatccatttgactgagctcagggctattatagccaatcagaagaagcactacccattcctgaaagaggaacaagaaaagttagagagcctgctaacatttaaaatcccctattacgtggggcctctcgctaagaaacaggaaaactcgccattcgcctggctgattcggaagtctgaggagaaaatcaagccctggaatcttcctgaaatagtcgacatggagggatccgcagtgcgcttcattgaaagaatgatcaacaccgatatgtatatgccacacaataaggttttgccgaaaaactcactgctctaccagaagtttagtatctataatgagctgacgaaagtgaggtaccaggacgaacgtggccaaatgaactatttcagctccattgagaagaaagagatctttcatgaacttttcgagaagaatcggaaggtcaccaaaaaggatctgcaggaatttttgtacctcaaatacgacattaagcacgccgagctgtctggcatagaaaaagccttcaacgcgagctatacaacttaccatgactttttaaccatgtcagagaataagcgagagatgaagcagtggctggaagatcccgagctagcaagtatgttcgaagagatcattaaaacactcactgtgtttgaggacagagaaatgatcaagaccaggctgtcccaccatgaggccacacttgggaaacacatcattaagaaattgaccaagaagcactatactggatggggtcgcctgagcaaagaactcatacagggcatccgggataagcaatctaacaaaacgattctggactacttaatcaatgatgacgatttccctcatcacagaaacaggaattttatgcagctgattaacgacgattcacttagtttcaagaaagagatcaagaaagctcagatgataacagacaccgaaaacttggaggagatcgtaaaggaactcactgggagcccagccattaagaaaggaatcctgcagtccctaaagattgttgatgagatcgtgggcataatgggttatgaacccgcaaatattgtcgtggagatggcccgcgaaaaccaaaccacagggcgaggcctgaaatcttcgcggcctcgtctcaaggctctggaggagagccttaaagactttggatcccagttgctgaaggaatacccaaccgataattcaagtttacagaaggacagactctatctgtactaccttcaaaacggcagggacatgtatactggggctcccctggatatccatcgcttgtctgactacgatattgaccacatcataccgcggagcttcacaacggataattccatcgacaacaaagtcctcgtgtcaagcaaggagaatagactgaaaaaggatgacgttccttctgaaaaagtggtaaagaagatgaggtccttctggtatgatctatacagtagcaaactgatttctaagcgaaaactcgacaacctgaccaagatcaaacttactgaggaagataaggcaggatttattaagcgccagttggtcgagacacggcagatcaccaaacacgtggcgggtatactgcatcacagattcaataaggctgaggacacaaacgaacccattaggaaagttcgtatcatcactttaaagtccgccctcgtgtcacagtttcgcaatcggttcggcatttataaagtcagagagatcaacgaataccatcacgcacatgatgcctatctgaatggggtggtagctcttgccctgctaaagaagtacccacaactcgcacctgagtttgtgtacggagagtatctgaaattcaacgctcacaaggccaataaagcgaccgttaagaaagaattttacagtaacattatgaagttctttgagagcgacacgcccgtctgtgacgaaaacggcgagatattctgggataaatcgaagtccatcgcccaggtgaagaaagtgattaatcaccatcacatgaacatcgtcaagaaaaccgaaattcagaagggtgggttttctaaagagacagttgagccaaagaaggacagctcaaaattgctgcccaggaagaataactgggatcctgctaaatatggcggattaggcagtccaaatgtggcatacactgtggccttcacctatgaaaaggggaaagctcgaaagcggacaaacgccctcgagggaatcactataatggaacgcgaggcattcgaacagtccccggtactgtttcttaagaataaaggttacgagcaagcggagatcgaaatgaagctgcccaaatatgccttgttcgagctcgaaaacggcagaaagaggatggtcgcttctaataaagaggcccagaaggcaaacagctttctgctacctgaacatctggtgacccttctctaccacgctaagcagtacgacgagatttcccataaagagtcattcgattatgttaatgaacaccacaaggagtttagcgaagtgttcgcccgggtcctggagtttgcagggaaatacacgttggccgagaagaacatcgaaaaactggagaagatttataaagaaaatcagacagacgatttagctaagctcgcgagttctttcgtgaacctgatgcaatttaatgccatgggagcaccagctgacttcaagtttttcgatgttaccatcccccgaaaaagatacacttcccttacagagatatggcagagcaccattatccatcagtcgatcactggcctgtatgaaacccgcattaggatgggtaagtga

SEQ ID NO: 2982 - RNA, 4023 nt, synthetic construct
  misc_feature 1..4023: note = Cas9 variant
  source 1..4023: mol_type = other RNA
atgaagaaagagtacaccatcggcctggacattgggacaaacagcgtgggatggtccgtcctcactgatgactatagacttgtttctaagaaaatgaaggtggccggtaatacggaaaaatcaagtaccaagaagaacttctggggcgtaaggctgtttgatgaggggcagacagctgaagcacggcgcagcaaacgaactgcccgtagaaggttggcgcggcgcagacaaaggatattagagctgcagaagatcttcgctcccgaaattctaaaaatcgacgagcactttttcgcccggctcaatgagtcctttctggtgcttgatgaaaagaaacagtctcgccatcctgtcttcgcaaccattaagcaggagaagtcgtaccaccaaacatatccaaccatctaccatctgcgacaggccttggctgactcaagcgaaaaagcagatataagactcgtgtatctggccatggctcatctgctcaagtacaggggacactttttaatcgagggcgagctgaacactgaaaatagttccgttacagagaccttccggcagtttctttctacgtataaccagcaattcagcgaagccgacgataaacagactgagaagttggacgaagcggtggattgctcctttgtcttcaccgagaaaatgtcaaagactaaaaaggcagagacactgctaaagtactttccgcacgagaaaagtaatggttacctcagccagttcattaagctgatggtggggaaccagggaaatttcaaaaacgtatttggccttgaagaagaggccaagctgcaattctctaaagaaacctatgaggaggacttggaggaactcctggaaaagatcggcgatgactacattgacttatttgttcaggctaagaatgtgtatgatgccgtcctgctctccgagatcctttcagacagcaccaaaaacacacgtgcaaagctgagtgctgggatgatacgcagatacgatgcccacaaagaagacttggtgctactgaagaggttcgtgaaagagaatctccccaagaagtatcgggcgtttttcggagataactctgtcaatggttacgccggctatattgaggggcatgcaacgcaggaagacttttacaaattcgttaagaaagagctgactggaatccgaggctccgaagtgtttcttacaaagattgagcaagagaacttcctgcgcaaacagagaacctttgataacggtgtaatccctcaccagatccatttgactgaactcagggctattatagccaatcagaagaagcactacccattcctgaaagaggaacaagagaagttagaaagcctgctaacatttaaaatcccctattacgtggggcctctcgctaagaaacaggagaactcgccattcgcctggctgattcggaagtctgaggagaaaatcaagccctggaatcttcctgaaatagtcgacatggaaggatccgcagtgcgcttcattgagagaatgatcaacaccgatatgtatatgccacacaataaggttttgccgaaaaactcactgctctaccagaagtttagtatctataatgaactgacgaaagtgaggtaccaggacgagcgtggccaaatgaactatttcagctccattgagaagaaagaaatctttcatgagcttttcgaaaagaatcggaaggtcaccaaaaaggatctgcaggagtttttgtacctcaaatacgacattaagcacgccgaactgtctggcatagagaaagccttcaacgcgagctatacaacttaccatgactttttaaccatgtcagagaataagcgagaaatgaagcagtggctggaggatcccgaactagcaagtatgttcgaggagatcattaaaacactcactgtgtttgaagacagagagatgatcaagaccaggctgtcccaccatgaagccacacttgggaaacacatcattaagaaattgaccaagaagcactatactggatggggtcgcctgagcaaagagctcatacagggcatccgggataagcaatctaacaaaacgattctggactacttaatcaatgatgacgatttccctcatcacagaaacaggaattttatgcagctgattaacgacgattcacttagtttcaagaaagaaatcaagaaagctcagatgataacagacaccgagaacttggaggaaatcgtaaaggagctcactgggagcccagccattaagaaaggaatcctgcagtccctaaagattgttgatgaaatcgtgggcataatgggttatgagcccgcaaatattgtcgtggaaatggcccgcgagaaccaaaccacagggcgaggcctgaaatcttcgcggcctcgtctcaaggctctggaggaaagccttaaagactttggatcccagttgctgaaggagtacccaaccgataattcaagtttacagaaggacagactctatctgtactaccttcaaaacggcagggacatgtatactggggctcccctggatatccatcgcttgtctgactacgatattgaccacatcataccgcggagcttcacaacggataattccatcgacaacaaagtcctcgtgtcaagcaaggaaaatagactgaaaaaggatgacgttccttctgagaaagtggtaaagaagatgaggtccttctggtatgatctatacagtagcaaactgatttctaagcgaaaactcgacaacctgaccaagatcaaacttactgaagaggataaggcaggatttattaagcgccagttggtcgagacacggcagatcaccaaacacgtggcgggtatactgcatcacagattcaataaggctgaagacacaaacgagcccattaggaaagttcgtatcatcactttaaagtccgccctcgtgtcacagtttcgcaatcggttcggcatttataaagtcagagaaatcaacgagtaccatcacgcacatgatgcctatctgaatggggtggtagctcttgccctgctaaagaagtacccacaactcgcacctgagtttgtgtacggagaatatctgaaattcaacgctcacaaggccaataaagcgaccgttaagaaagagttttacagtaacattatgaagttctttgaaagcgacacgcccgtctgtgacgagaacggcgaaatattctgggataaatcgaagtccatcgcccaggtgaagaaagtgattaatcaccatcacatgaacatcgtcaagaaaaccgagattcagaagggtgggttttctaaagagacagttgaaccaaagaaggacagctcaaaattgctgcccaggaagaataactgggatcctgctaaatatggcggattaggcagtccaaatgtggcatacactgtggccttcacctatgagaaggggaaagctcgaaagcggacaaacgccctcgaaggaatcactataatggagcgcgaagcattcgagcagtccccggtactgtttcttaagaataaaggttacgagcaagcggaaatcgagatgaagctgcccaaatatgccttgttcgaactcgagaacggcagaaagaggatggtcgcttctaataaagaagcccagaaggcaaacagctttctgctacctgagcatctggtgacccttctctaccacgctaagcagtacgacgagatttcccataaagaatcattcgattatgttaatgagcaccacaaggaatttagcgaggtgttcgcccgggtcctggagtttgcagggaaatacacgttggccgaaaagaacatcgagaaactggaaaagatttataaagagaatcagacagacgatttagctaagctcgcgagttctttcgtgaacctgatgcaatttaatgccatgggagcaccagctgacttcaagtttttcgatgttaccatcccccgaaaaagatacacttcccttacagaaatatggcagagcaccattatccatcagtcgatcactggcctgtatgagacccgcattaggatgggtaagtga

SEQ ID NO: 2983 - RNA, 4023 nt, synthetic construct
  misc_feature 1..4023: note = Cas9 variant
  source 1..4023: mol_type = other RNA
atgaagaccgactacttcatgggcctggatatggggacaggaagcctcggttgggccgtgactgactcctcttatcacctttgcagagctcatggcaaagatctgtggggagtcaggttgtttgagacggcacagaccgccgaagaacggcgcgttttccgatgtaaccgtagaaggttagaccggcgcaagagaaggatccaactgctacaggatatttttgcgcccgaaatatacaaaatcgaccctgggttctttctccggctgaaggagtcacgctatcttccagaagataaaaagaatctggagggcaagacaccggagttgccctacgctctcttcgtggacaaaaagtatactgataaagactttcacaaggaataccctaccatttatcatctgcgactgagactcatgcaggataggacaccagccgacgtacggttagtgtacctggcacttcaccatttgatcaaacaccgtggtcacttcctgtttgccgggattgaggctgataaggtcaccgacttcagtgcagcctttagcgagttcctacgcatcgtgcaggagcaagagctcgacatatcctttactcccgatgaagagtcttcgcagatcattaaggaaacactgcagaacaccaatttcacgagaagcaaaaagtcaactgagcttatcaaaggactgaaggctagtaccggctgcgaaaaagccttgctcaagctgatttccggctgtaaagttaagttatctgcggtgttcgacgatcctgggtgcgacgcatacgagaagccacaggtctgttttgccgagagctcctatgaagattacgctgccatcctggaggacgaactcgaggataggttcatagtgattgcagctgccaaagcgctttatgactggtcagtactggttaacatcttgggagaagccagtacagtgagcgaggcaaaggtcggtatttacgagaaacatcggcgagatctaaagtatctgaaacacctcgtgaagactaatctgacccgcgaagactaccaagatctttttgtgaaggctggcgccaaaaagaacaattattgcgcttacatcgggatgaccaaaaagaacaataaaaaggtcgttctggaggaaaagagatgtacaaaagaggacttctacgcctatttgaagaaagaaatctactctaaggtgcaggagaaccccgaggcagaatatctcctggaggaattagagaaaggaacgtttctgcctaggcaggtatccaaggacaatggcgtgattccataccagctacaattcctcgagctgcagaagatacttaaaaacgccgtcgaatatttgccgtttctgaaggaggaatcagagaaaatccagcaaattatgactttccggatcccctactatgtgggtcctctcaatgggaagaaagaaggacagaacacatttgcttgggcggttcgcaagaataacgagccagtgtacccctggaacttcgaggaagtcatagataccgaggcaagcgccgaacagtttattagaaggatgactaataaatgcacatacctgcctggcgaggacgtgcttccaaaggaaagtctgttgtattctaagttcatggtactcaacgagctgaataacttacgtatcaatggcaccaaaatctccgttgagctgaagcaggaactatacgagaaactctttcaacggtatcgaaaggtgagcgctaaaaagctgagagattaccttgtcaggaacgggattacggaaaaggacgccgagatctcgggaattgatggtgacttcaaaggcaccttgcgcgcatatcatgatttcaaggaaaaactgacaggggtggagctcactgaggccgaaaaggagaccataatcctgaatattacattatttggagaagacaaagtcctgcttaagaagcggatgcagagattgctccccaacctgactgagggccagaaaaaggctatcgtgaccctaaattactctggttgggggaggctgtcccgcgagttcctcgaagaggttcaggccccgaaccctgaatcaggcgagatcctgagtattatacgagcactttgggaaacaaatgcgaacttgatgcaactgttaagcaatcagtatggataccaggagatcctcgagcagatgcgggctgattggaccggccacaaactggactaccaaactgtggaagaactttatgtatcccccgccgtcaagcgtcagatttggcagacgctgcaagtggttaaagaattgaagaaggtgatgggaggggagccaaaaagagtctttctcgaagtggcaagggagaagatggagtctggtcgcacagtaagccggaaaaagcacctgaaagatctatacctgtcatgtaagagtgaagagagaaactggctcgccgaactggacaggcatgaggaacactcctatcgaagcgatcgccttttcttgtactatacccagaaaggccggtgcatgtactgtgggaagcctatcgacctgggacatttatgggacgtgaatatgtatgatattgaccacatctacccccagtctaaggttatggatgactcaataagaaacagggtcctcacttgccgtacctgcaacgctgagaaaacagatcattacccactgaaggccgagatccgccagaaaatgcggcccttttgggacagtcttaaggcaggcaatttcattgaagaggaaaaatggaagagactgatcaggagcgaggagtttacctccactgaactagctggtttcattgagcgacaactcgtggaaacacggcagtctacgaaggccgtggcggatatcctgaaacaggccatgcctgagaccgaaatagtctatgttaaggctaaaaacgtgtcggcatttcgccaggacttcaattttgtgaagaacagagatgtaaatgacttccaccacgccaaagatgcttacttgaacattgtcgtggggaatacttattttgttaagttcacaaagaacgccagctggttcatcgagaggaatccaggccggtcctacaacctgaaacgaatgtttacctcagactatgatgtgatgagtaatggagagattgcatggaaggcgggcaactctgggacaatcactaccgtcagaaaaatgatgaagaaaaatagcgtgttattcacgcgcaggtcctttgaagtttcaggaggtctcttcgaccaacagctgatgaagaagggcaaaggacaggtgtacgtaaagagcggggacgagcgtcttcggtctatagaaaaatatggcggttacaacaaggccaccggggcttactttatgctggtcgagtccgaaggcaaaaagggagtgaagaaaagaacaatcgagttcgtgccgttgtataggaaggccgagctcgaagcaagtgaggagaaaatgctggagtacctacgcactgaaattggcctgaaggagccccatgtccttctccacaaaatcaagaccgatacactgtttcaggctgacgggttcaaaatgcatttgagcggacgaactggcaagcaactggtttttaagggtgccaatcagttcttagtggcagaggattatgaaagactcctgaaaaaggtagggaaagtgaccgagcagcttaagacgaacaaaaactacaagattaatgactatgatggaatcacagaagagggcctgaaggccttgtactctgagtttctctccaaactgcagaaggctccttatggtaaccggctaggcacccaagcggaaactctggagaatgggaaagaaaagttcgacaaactttcactcgagaacaagtgtcaggtcctgagtgaaatattgcacttattccagtgcaatagctcggccgcagatctgtccaagctcggaggcccagggcacggaggcattctggtgctttctaacgagatcacaaaatgtaataagatcagcattatccatcaatcacccgctggtatttacgagcaggaaatagacctgaaaaccttgtga

SEQ ID NO: 2984 - RNA, 4023 nt, synthetic construct
  misc_feature 1..4023: note = Cas9 variant
  source 1..4023: mol_type = other RNA
atggagcaggaatactatctgggcctcgacatggggaccggaagcgtgggttgggccgtcacagattccgagtaccacgttcttagaaagcatggcaaagctctgtggggagtgaggttgttcgaatctgcatcaactgccgaggaacggcgcatgtttcgaacgagtcgtagaaggttagaccggcgcaactggagaatcgagattctgcaagagatattcgcggaagagatcagcaagaaagatcccgggtttttcctaaggatgaaggaatccaaatattaccctgaggacaagcgggatattaatggcaactgcccagagctcccgtatgctctgtttgtagacgatgacttcaccgataaggactaccacaaaaagtttcccacaatctatcatcttcgcaaaatgctgatgaatactgaagagacccctgatattcgattggtgtacctcgccatccaccatatgatgaagcacagaggtcacttcctgctgtctggggacataaacgaaatcaaagagtttggaacaaccttctcgaagctcttagaaaatattaagaacgaggagctggattggaatcttgaattgggcaaagaggaatacgcagtcgtggagtcaatcctgaaggacaacatgctaaataggagcactaaaaagacacggctcattaaagccctgaaggctaaaagtatctgtgaaaaggcagttcttaacctgttggccggcgggaccgtgaagctctccgacatatttggactggaggagttaaatgaaacggagcgtccaaaaatttctttcgctgataacggttatgacgattacatcggcgaagtcgagaatgaactgggggagcagttttatattatcgagactgccaaggcggtgtacgactgggcagtactcgttgaaatccttggaaaatataccagcatttccgaggccaaggtggctacatacgaaaaacataagtcagatctgcagttcttgaagaaaatagtccgcaagtatctaactaaagaggagtacaaggacatcttcgtgagtaccagcgataaactgaagaactactctgcctatattggcatgacaaagatcaatggtaaaaaggtggacctccagtccaaaagatgctcaaaggaagagttttacgatttcattaaaaagaacgtcctgaagaaacttgaagggcaacccgagtatgaatacctgaaggaggagttggaaagggagacctttctccctaaacaggttaaccgggacaatggagtgataccatatcagatccacctgtacgaattaaagaaaatcctgggcaacctacgagataagattgacctcatcaaagagaatgaagacaagctggtacagcttttcgagtttcgcattccctattacgtgggccctttgaacaagatagatgacgggaaagagggaaagttcacgtgggcagtcagaaaaagcaatgaaaagatctacccatggaactttgagaatgtggttgatattgaagctagtgccgagaaattcatcaggcggatgactaacaagtgtacatatctgatgggtgaagacgtgctcccgaaggattctctgctttactccaaatatatggtcctgaatgagttgaacaatgtgaagctcgacggcgagaaactgagcgtagaattaaagcaacgcctgtacaccgatgtgttttgcaaatatagaaaggttactgtcaagaaaatcaagaactacctaaaatgtgaggggattatatcgggaaatgtggaaatcacaggcattgacggtgatttcaaggcgtctctcaccgcctatcatgactttaaagagatcctgacggggaccgagcttgcaaagaaggataaagaaaacattatcacaaatatagtcttgttcggcgacgataagaaactgctcaagaaaaggctgaaccgtttatacccccagatcactcctaaccagctgaagaaaatttgcgctctttcctacaccggatggggccggttttcaaagaagttcttggaggaaatcacagccccagaccccgagactggggaagtgtggaatattatcaccgctctctgggagagtaacaataacctgatgcagctactgagcaatgagtatcgattcatggaagaggttgaaacatacaacatgggaaaacaaaccaagactctctcctatgagacggtggaaaatatgtacgtatctcctagcgtcaaaagacagatatggcagacactgaagattgtgaaagagcttgagaaggttatgaaggaatcaccaaaaagggtgtttatcgagatggcccgcgaaaagcaagagagtaaacggaccgaatccagaaagaaacagttgattgacctgtataaggcatgtaagaacgaggagaaagattgggtcaaggaattaggtgaccaggaggaacagaaactcaggagcgataagctgtacctttattacactcaaaaaggccgctgcatgtactctggggaggtgatcgagctgaaggacttgtgggataataccaagtatgacatagatcacatctacccccagtcaaaaacaatggacgatagtctcaacaatcgagtactggtgaagaaaaagtataacgccaccaaaagcgacaagtacccgctaaatgaaaacattcggcacgagcgtaagggattctggaaatccctgctcgatggcggttttatctctaaggaaaaatatgagagactgattaggaatactgaactttcgcctgaggagttggctgggttcatcgaacgccagatagttgagacacggcagagcacgaaggcggtcgcagaaattctgaaacaagtgtttcccgagtccgaaatcgtgtacgtcaaggccggcaccgtttcaagattcaggaaagactttgagttactcaaggtgcgagaggtgaacgatctgcatcacgctaaggacgcctatcttaacatcgtagtcggaaatagttactacgtgaaattcactaagaacgcatcttggtttattaaagaaaatccaggccgcacatataacctgaagaaaatgttcaccagcgggtggaatatcgagcggaacggagaagttgcctgggaggtgggtaagaagggcacaattgtcactgtgaaacagataatgaataagaacaatatcctagttaccagacaggtgcatgaagctaaagggggactctttgaccagcaaattatgaagaaaggcaagggtcagatcgccattaaggagacggatgagaggctggcatccatcgaaaaatacgggggctataacaaggcggctggagcctacttcatgttggtagagtcaaaagacaagaaaggcaagaccatacgtacaatcgaatttattcctctgtatttaaagaataaaatcgagagcgatgagtctattgcactcaacttcctggaaaaggggcgcggacttaaagagcccaagatcctgttgaaaaagataaaaattgacactctcttcgatgtcgacggctttaagatgtggctgtccggtcggaccggggatagactactgttcaagtgtgccaatcagcttatcctcgacgagaaaatcattgtgacaatgaagaaaatagtgaagtttatccagaggcgacaagaaaaccgggaactgaaattgagtgataaggacggaattgataatgaggtcctgatggagatctacaacactttcgttgacaagttagaaaacaccgtgtatcgcattagactcagcgagcaggctaaaacgctgatcgacaagcagaaagaatttgagaggctttctctggaagataagtcctcaacattgttcgagatactccacatctttcaatgccagagtagcgccgcaaatctgaaaatgattggcggtccaggcaaggctgggatcctagtaatgaacaataacatttcgaagtgtaataaaatctccataattaaccagtctcccaccggaatcttcgagaatgaaatcgacctgcttaagatttga

SEQ ID NO: 2985 - RNA, 4023 nt, synthetic construct
  misc_feature 1..4023: note = Cas9 variant
  source 1..4023: mol_type = other RNA
atgggcgaggaatacttcctggggctcgacatgggaaccggtagccttggctgggccgtgacagatgacaagtatcagatcctgagaaggcacgggaacgctttgtggggagtccggttatttgagactgcaaatacggccgaagaacgccgaatgttccgtaccaacagaaggcggctggatcgccaaggctggagaattaaaatactacaggaactctttgcggaggagatctgcagggttgaccccggtttctacctgcggatgaaggaatccaaatattaccctgaggataagcgcgacgctaatggggaatgtccagcccttccgtatgcactgtttgccgatgctcagtacacagacaaagattatcatcgagagttccccactatttaccacttgagaaagatgctcatggagaccgaaacaacccctgacatcaggctggtgtacctggcatttcatcacatgatgaagcatcggggacacttcctcttatctggcgatatttcacaggtaactgagtttcgtaacacattcctgcaaatgatcgccaatataaaaagtgaagaacttgactttagcttggaaatcgaggagacccagatgggccagattgaagctgtgctgaaggatcacaaactaacgcgctccgagaagaaaagaaggctcactcagatcctgaagccagccaccgcgtgcgaaaaggcaattttcacacttctgtctgggggaactgtcaaattgtcggacatctttggtaaggccgagctcgacgaaggcgagcggcccaaaatatcattcgctgataacgggtatgacgattacagcgccagtgtggaggcagacctgggagaacaatattacattatcgagtccgctaaggccgtttatgattggtctgtgttaagcgacattctgggcgattccgtctcaatcagtgacgcgaaagtgaagctctacgaaaaacataagaaggatcttgcctatctgaaaaaggtagttcgagagaatttgcctcgcgaagtgtacaaccaggtcttcgtgaataccgacgagaaactatgtaactactgcgcatatatcggtatggctaagaaaaatgggagaaaggtggccctggagggaaagaggtgtacacgggaagagtttgagagcttcctccgcaaaaagattgtcaacaaaatagaggataaggagatccaggaatacctgtctgaggaaattgagaaaggcacctttcttccaagacaggttacgaaggacaatggcgtgatcccctatcaaatacacctgtacgaattgaggaagattatcgacaacctctcccctcgtatgccattcatccgggataatggggacaaaattatccagctgtttactttccgaataccgtattacgtaggacccttaggtaagggcgaggggtcagagaaatttagctgggctgtgagaaggacagatgaagccatttatccttggaacttcaaggacgtcatcgatgtggaggcaagtgccgaaaaatttatttgccgcatgaccaacaagtgtacttacctgtacggagaggacgttctaccaaaggattctcccctctattccaaattcatggtgctgaatgaacttaacaatttgaagctggacggccagagcgtctcggtggagctcaaacaacggatctaccaggagctgttttgccatacaagaaaggtaacccagaaaaagctggtttcttatcttgtgagggaaggtatcacggggaaaaacgtcgagatttccggcatagatggagacttcaaggcttcattgaccgcgtaccacgattttaaggaaaaactcacaggcgtggagctgagtcagcaagaacaggaggagatcgtccgcaatattgtgttattcggggaagacaagaaactgctaaagcagcgactcgagggacggttccctcagctgactcaaaaacagatcagcgttattgcaaccctttcctataagggttggggccgtttgtctagagaatttctggagaacatcacagtgccagcccccgggactggagaggtatggaatataatcaccgctctctgggaaacaaacgataatctgatgcagttactgtacggcgagtatggtttccagaccgaaattgagtgttttaacgccaaggagaaaaagaaaagcctttcatacgagactatcgaggaaagttacgtctccccgagcgtgaagaggcaaatttggcagacgttgcaggttgtgaaagagctcaagaaggtcatgcgcggggaccctaaacgggtgttcatcgaaatggcaagagagaatcaggaatctaagaggacagagtcacgaaagaagaccctgctagacctgtataaaaactgcaagaaggaggaacccgagtggatagccgaactcactgagcacctggaaaaacttgatgacagtcaattgcgcaaggataaactgtttttatactatacccagaagggccggtgtatgtacagcggagagagaattgagctcgaagacctgtgggataatacaaggtatgacatcgatcatatttacccacagtccaaaaccatggacgattctgtagacaaccgtgtgcttgttaagaaagagtataatgctaagaagactgatgtctaccctatcgccgcagacatacgcggcaaaatgtcgcccttctggaagaaactgttggataacaagctcatcagcaaaaagaagtacgaccggctggtgagaacagaagaactaacgccagaggaactggcggggtttattgacaggcaactcgtggagacccgacagtccactaaagtcgttgctgaaatcctgaaggaggccttccccgatacagaaattgtgtatgtgaaagcaggaaacgtatcaaattttcggcacatgttcgacatcgtcaaggtgcgcgagcttaacgatttgcatcacgccaaagacgcttacctgaatatagttgtgggtaacgcctattacgtcaagtttaataagaacgcagcttggttcattaaagagaatcctggcagaagttataacttaaagaggatgtttgattacgacatccggcgaaataacgaagtggcctggctcgcggggtctaccggaacaatcagccaggttaaaaatatggtgtccaagaaccatattctggtaactagaaaatcatatgaggtcaccggcggtcttttcgatcagcaactgatgaagaaggggaaaggccaggtgccagtgaagacgagcgacgaacgcctaggaaatatcgagaaatacggcgggtacaacaaggcctctggagcttatttcatgctcgtcaaatccaagaataagaaaggcgaggagcagaggaccattgagtacgttccgatatatctgaagcactacatcgaagagagtaaagaaaacgcattggattatctgaagaacgagcgtaaattaaatgaacccgagattctcctggacaagatcaaaaaggatacactttttcgggtgaacggtttctacatgtgcctgagcaagagaactgggaaacagttggcctttaagggagctaatgagctcctgctacctgaaccagagaccctgcttctcaaaaagattacaaaatatatccaaaggcgcaaggaaaacaaggacctgaaattgactaagcaggacaatataaccgagaaagagctgttagaactctacgatgtattcacggagaagctgaaccactctgtgtacgccgtctgccttggcacacagggtaaaaccctggtgcagaagaagcccgcatttgttgcgttgcctgtggaagagaaatgtatcgtcctctccgaaattctgcatctattccaatgccagtcaggcagtgccaatctgaaacttatcgggggaccagctagcgccggcattctctatctgaactcgaatatctccgacgcaggggagatattgattatcaaccagtctcccagcggaatctttgagaaacgaattgatttactgagactctga

SEQ ID NO: 2986 - RNA, 4023 nt, synthetic construct
  misc_feature 1..4023: note = Cas9 variant
  source 1..4023: mol_type = other RNA
atgaagaaagagtacaccatcggcctggacattgggacaaacagcgtgggatggtccgtcctcactgatgactatagacttgtttctaagaaaatgaaggtggccggtaatacggaaaaatcaagtaccaagaagaacttctggggcgtaaggctgtttgatgaggggcagacagctgaagcacggcgcagcaaacgaactgcccgtagaaggttggcgcggcgcagacaaaggatattagagctgcagaagatcttcgctcccgaaattctaaaaatcgacgagcactttttcgcccggctcaatgagtcctttctggtgcctgatgaaaagaaacagtctcgccatccagtcttcgcaaccattaagcaggagaagtcgtaccaccaaacatatccgaccatctaccatcttcgacaggccctggctgactcaagcgaaaaagcagatataagattggtgtatctcgccatggctcatctgctgaagtacaggggacactttctcatcgagggcgagttaaacactgaaaatagttccgttacagagaccttccggcagtttctgtctacgtataaccagcaattcagcgaagccggtgacaaacagactgagaaacttgatgaagcggtggactgctcctttgtcttcaccgagaaaatgtcaaagacaaagaaggcagagactttgctgaagtactttccccacgaaaagagtaatgggtacctaagccagttcattaagctcatggtgggaaaccagggcaatttcaaaaacgtatttggcctggaggaagaggccaaacttcaattctctaaagaaacctatgaggaggatctggaagagttgctcgaaaagatcggggacgattacattgacctgtttgttcaggctaagaatgtgtatgacgccgtcttactgtccgagatcctctcagatagcacaaagaacacccgtgcaaaacttagtgctggaatgatacgcagatacgacgcccacaaagaagatctggtgttgctaaagaggttcgtgaaagagaatctgcctaagaagtatcgggcgtttttcggtgacaactctgtcaatggctacgccgggtatattgagggacatgcaacgcaggaggctttttacaaattcgttaagaaagaactcactggcatccgaggttccgaagtgtttctgacaaagattgagcaagagaacttccttcgcaaacagagaacctttgataacggggtaatcccacaccagatccatctgagcgaattgagggccattatagctaatcagaagaagcactaccccttcctcaaagaggaacaagagaagctggaatcgttactgacttttaaaatcccttattacgtgggaccactagccaagaaacaggagaactctcccttcgcatggctcattcggaagtccgaggaaaagatcaagccttggaatctgccagagatagtcgacatggaaggctcagccgtgcgcttcattgagagaatgatcaacacagatatgtatatgccgcacaataaggttcttcccaaaaacagtttgctgtaccagaagtttagcatctataatgaactcaccaaagtgaggtaccaggacgagcgtggccaaatgaactatttctcctctattgagaagaaagaaatctttcatgagctgttcgaaaagaatcggaaggtcacgaaaaaggatcttcaggagtttctgtacttgaaatacgacattaagcacgctgaactcagcgggatagagaaagcgttcaacgcatcatataccacataccatgattttctgactatgagtgagaataagcgagaaatgaagcagtggttagaggaccctgaactggcctccatgttcgaggagatcattaaaaccctaacagtgtttgaagacagagagatgatcaagactaggctcagccaccatgaagctaccctgggaaaacacatcattaagaaacttacaaagaagcactataccggttggggccgcttgtctaaagagctgatacaggggatccgggataagcaatcaaacaaaactattctcgactacctgatcaatgatgacgatttcccacatcacagaaacaggaattttatgcagttaattaacgacgatagtctgagcttcaagaaagaaatcaagaaagcccagatgataacggacacagagaaccttgaggaaatcgtaaaggagttgaccggatcccccgcaattaagaaaggcatcctccagtctctgaagattgttgatgaaatcgtgggtataatggggtatgagcctgccaatattgtcgtggaaatggctcgcgagaaccaaactaccggccgaggactaaaatcgagccggccacgtctgaaggccctcgaggaatccctgaaagactttggctcacagcttttgaaggagtaccccacagataatagttctctgcagaaggacagattatatctctactacctgcaaaacgggagggatatgtataccggagcaccgcttgacatccatcgcctgagcgactacgatattgaccacatcatacctcggtccttcactacagataattcaatcgacaacaaagtcttggtgagctctaaggaaaatagactcaaaaaggatgacgttccctccgagaaagtggtaaagaagatgaggagtttctggtatgatctgtacagctctaaactaatttccaagcgaaaactggacaacctcacgaagatcaaactgaccgaagaggataaggcgggttttattaagcgccagcttgtcgagactcggcagatcacaaaacacgtggctggcatattgcatcacagattcaataaggccgaagacaccaacgatccaattaggaaagttcgtatcatcacactgaagtcagcattagtgagtcagtttcgcaatcggttcgggatttataaagtcagagagatcaacgaataccatcacgcccatgacgcttatctcaatggagtggtagccctggcacttctgaagaagtaccctcaactagctcccgagtttgtgtacggcgagtatctcaaattcaacgcccacaaggcgaataaagccactgttaagaaagaattttacagcaacattatgaagttctttgagtcggataccccagtctgtgacgaaaacggtgagatattctgggacaaatccaagtctatcgctcaggtgaagaaagtgattaatcaccatcacatgaacatcgtcaagaaaacggaaattcagaaagggggctttagcaaagagaccgttgagcccaagaaggattcaagtaaactgttgcctaggaagaataactgggacccagcaaaatatggaggcctggggtccccgaatgtggcctacacagtggctttcacttatgaaaagggaaaagcccgaaagcggaccaacgcattagagggtatcacaataatggaacgcgaggcgttcgaacagtctcccgtactctttctgaagaataaaggctacgagcaagccgagatcgaaatgaaacttcctaagtatgctctgttcgagttggaaaacgggagaaagaggatggtcgccagcaataaagaggcacagaaggctaactcctttctcctgccagaacatctagtgactctgctttaccacgccaagcagtacgatgagatttcacataaagagagcttcgactatgttaatgaacaccacaaggagtttagtgaagtgttcgcacgggtcctcgagtttgccggaaaatacaccctggctgagaagaacatcgaaaaattggagaagatttataaagaaaatcagacggatgacctggcgaagttagcctcttccttcgtgaacctcatgcaatttaatgcaatgggcgctcccgccgatttcaagtttttcgacgttacaatccctcgaaaaagatacaccagcctgactgagatatggcagtcgacaattatccatcagtcaatcaccggtctttatgaaactcgcattaggatggggaagtga

SEQ ID NO: 2987 - RNA, 4023 nt, synthetic construct
  misc_feature 1..4023: note = Cas9 variant
  source 1..4023: mol_type = other RNA
atggagcaggaatactatctgggcctcgacatggggaccggaagcgtgggttgggccgtcacagattccgagtaccacgttcttagaaagcatggcaaagctctgtggggagtgaggttgttcgaatctgcatcaactgccgaggaacggcgcatgtttcgaacgagtcgtagaaggttagaccggcgcaactggagaatcgagattctgcaagagatattcgcggaagagatcagcaagaaagatcccgggtttttcctaaggatgaaggaatccaaatattaccctgaggacaagcgggatattaatggcaactgcccagagctcccgtatgctctgtttgtagacgatgacttcaccgataaggactaccacaaaaagtttcccacaatctatcatcttcgcaaaatgctgatgaatactgaagagacccctgatattcgattggtgtacctcgccatccaccatatgatgaagcacagaggtcacttcctgctgtctggggacataaacgaaatcaaagagtttggaacaaccttctcgaagctcttagaaaatattaagaacgaggagctggattggaatcttgaattgggcaaagaggaatacgcagtcgtggagtcaatcctgaaggacaacatgctaaataggagcactaaaaagacacggctcattaaagccctgaaggctaaaagtatctgtgaaaaggcagttcttaacctgttggccggcgggaccgtgaagctctccgacatatttggactggaggagttaaatgaaacggagcgtccaaaaatttctttcgctgataacggttatgacgattacatcggcgaagtcgagaatgaactgggggagcagttttatattatcgagactgccaaggcggtgtacgactgggcagtactcgttgaaatccttggaaaatataccagcatttccgaggccaaggtggctacatacgaaaaacataagtcagatctgcagttcttgaagaaaatagtccgcaagtatctaactaaagaggagtacaaggacatcttcgtgagtaccagcgataaactgaagaactactctgcctatattggcatgacaaagatcaatggtaaaaaggtggacctccagtccaaaagatgctcaaaggaagagttttacgatttcattaaaaagaacgtcctgaagaaacttgaagggcaacccgagtatgaatacctgaaggaggagttggaaagggagacctttctccctaaacaggttaaccgggacaatggagtgataccatatcagatccacctgtacgaattaaagaaaatcctgggcaacctacgagataagattgacctcatcaaagagaatgaagacaagctggtacagcttttcgagtttcgcattccctattacgtgggccctttgaacaagatagatgacgggaaagagggaaagttcacgtgggcagtcagaaaaagcaatgaaaagatctacccatggaactttgagaatgtggttgatattgaagctagtgccgagaaattcatcaggcggatgactaacaagtgtacatatctgatgggtgaagacgtgctcccgaaggattctctgctttactccaaatatatggtcctgaatgagttgaacaatgtgaagctcgacggcgagaaactgagcgtagaattaaagcaacgcctgtacaccgatgtgttttgcaaatatagaaaggttactgtcaagaaaatcaagaactacctaaaatgtgaggggattatatcgggaaatgtggaaatcacaggcattgacggtgatttcaaggcgtctctcaccgcctatcatgactttaaagagatcctgacggggaccgagcttgcaaagaaggataaagaaaacattatcacaaatatagtcttgttcggcgacgataagaaactgctcaagaaaaggctgaaccgtttatacccccagatcactcctaaccagctgaagaaaatttgcgctctttcctacaccggatggggccggttttcaaagaagttcttggaggaaatcacagccccagaccccgagactggggaagtgtggaatattatcaccgctctctgggagagtaacaataacctgatgcagctactgagcaatgagtatcgattcatggaagaggttgaaacatacaacatgggaaaacaaaccaagactctctcctatgagacggtggaaaatatgtacgtatctcctagcgtcaaaagacagatatggcagacactgaagattgtgaaagagcttgagaaggttatgaaggaatcaccaaaaagggtgtttatcgagatggcccgcgaaaagcaagagagtaaacggaccgaatccagaaagaaacagttgattgacctgtataaggcatgtaagaacgaggagaaagattgggtcaaggaattaggtgaccaggaggaacagaaactcaggagcgataagctgtacctttattacactcaaaaaggccgctgcatgtactctggggaggtgatcgagctgaaggacttgtgggataataccaagtatgacatagatcacatctacccccagtcaaaaacaatggacgatagtctcaacaatcgagtactggtgaagaaaaagtataacgccattaaaagcgacaagtacccgctaaatgaaaacatccggcacgagcgtaagggattctggaaatccctgctcgatggcggttttatttctaaggaaaaatatgagagactgatcaggaataccgaactttcgcctgaggagttggctgggttcatagaacgccagattgttgagactcggcagagcacaaaggcggtcgcagaaatcctgaaacaagtgtttcccgagtccgaaatcgtgtacgtcaaggccggcacggtttcaagattcaggaaagactttgagttactcaaggtgcgagaggtgaacgatctgcatcacgctaaggacgcctatcttaacattgtagtcggaaatagttactacgtgaaattcaccaagaacgcatcttggtttatcaaagaaaatccaggccgcacttataacctgaagaaaatgttcacaagcgggtggaatattgagcggaacggagaagttgcctgggaggtgggtaagaagggcaccatagtcacagtgaaacagatcatgaataagaacaatattctagttactagacaggtgcatgaagctaaagggggactctttgaccagcaaatcatgaagaaaggcaagggtcagattgccatcaaggagaccgatgagaggctggcatccatagaaaaatacgggggctataacaaggcggctggagcctacttcatgttggtagagtcaaaagacaagaaaggcaagacgatccgtaccattgaatttatccctctgtatttaaagaataaaattgagagcgatgagtctatcgcactcaacttcctggaaaaggggcgcggacttaaagagcccaagatactgttgaaaaagattaaaatcgacacactcttcgatgtcgacggctttaagatgtggctgtccggtcggactggggatagactactgttcaagtgtgccaatcagcttatcctcgacgagaaaattatagtgaccatgaagaaaatcgtgaagtttattcagaggcgacaagaaaaccgggaactgaaattgagtgataaggacggaatcgataatgaggtcctgatggagatttacaacacattcgttgacaagttagaaaacactgtgtatcgcatcagactcagcgagcaggctaaaaccctgatagacaggcagaaggaatttgagcggctttctctggaagataaatcctcaacgttgttcgagatcctccacatttttcaatgccagagtagcgccgcaaatctgaagatgatcggcggtccaggcaaagctgggattctagtaatgaacaataacatctcgaagtgtaataagatatccattatcaaccagtctcccacaggaatcttcgagaatgaaattgacctgcttaaaatctga

SEQ ID NO: 2988 - RNA, 4026 nt, synthetic construct
  misc_feature 1..4026: note = Cas9 variant
  source 1..4026: mol_type = other RNA
atgagattccagaacaagaaaaccggcgactactttgtggggctggatatcggaacaaatagcgtcggttgggccgttactaacgagaagtatgaaattctcagggctaaaaatcaccggatgtggggctcccgccttttcgaggaagggaagacggcagaggaacgacgtgtgcatagagccggaaggcggcgcctgaacagaaggaatgaccggttgatgatattagaggatctgtttgcggaggaaatctctaaagtagacaaggctttctaccaacgcctacacgagtcacagtatcgacaggaacataagaccgtgagtggcccctactttctcttcaacgataaagagtttacagacgaggattatcacattgactaccctactatctatcatctgagagtcgcccttatgaaggcaccagccaaagatgtgaggctgttgttcctcgctattcaccacatcataaagtaccggggtaattttctgcatgaaggggagaccttcaaaacaaccggaggcctgactgacatcctccagcgtgttttagcatgcaacgaatttagcggcctgaagcaacacattgatgacacagcccttgtgaagttgctgaccaataaagggatcacgcgctccgatattgctaagcagatctctgagctagccactgacaaactctacagaaagcaggcgaaagcattcgcctcgctggtccttggactgaaggctaacttggacgatctctttaatgaaccggagtataaagagctggactcagaaataaggaccgtggagttcagcggtaaggaatactgggaggaacgggataagtatgagccctacttaggcgagagtctgttcgccctcgacgggtgtaaaacactttatgatactctgttgctatccaacattaagcctgacggaaaatacctgtctgaagcaaaggtagagacctttgaaaaacatcacgagcacctcgaaagcctgaaggatcttctgaagtccaataaagctctatataaccgagttctccgcgacgatgagaagaatctgaacaactacatcacatacattggcaaatcagagttcaataagagatgcagtagggacgaattttataaattcttaaagcagaccatcaaggatatcagcgacaacgagaataaagccgaaattgtgcaactgatggagctagactcttttctcccactgcttcgggtccgcgagaacggtgtgataccctaccagatccatgaagaggaattggagcagattctgaatgtgtcctcagaaaagtatcctttcctcaacaaagcggatgggagcggatttacgatcgcccagaagatactgaaacttctgactttcaggattccatactttgtcggccccttgaatcctgcacacaaggacagagataacggcttcgcttgggttgtgcgtaaggccccagggaaagtatatccgtggaattttgaggacaaggtggatatcagtgcttctgccacagcattcatcgagaacctcaccaataaatgtacttacctgattggagaagacgtcttacccaagtattccctggcctacagcaaattttcgctactcaacgagctgaataaccttcggtacgatggtaagcctttgtcttatgaaacaaaacaatccttcatcaaggactgcttcgagaaggaacatcgaaaaatgaccgagaagagaattagggagtttctgaaacacctcggcgggacggatggaaagggcgctctgaccggtttagacgtggatataaaatcagacctgaagagttaccgcgatatggttcggatccttggggacggcttcgacgaaacaatggcggagagaattatcaggtatgtgactttgtttggagaagcaaagaaagtcctcctgagcaccctagagatcgagttcggcgatgacctgtccgatacacagaagaaacagattctcaagctgcaataccgcgactgggggcgactttctgccactttgctgaaaggaataaagggtgtggctggcgataatccagaatgtagcatcttagagtgcatggaacagcagcccctcaacctgatggaggtactttcaagtcataacacctatctggccgcaattgaagagtttaataaggagcggacagaacctaccgacatcgttgattacaaattggtggacgatctctatatttccccagccgtcaagcgtagcgtgtggcagactctgagaatcctagacgagataacgaaactgagggggtctgtccccaagaaagtgttcgttgaagtggctcgcacaaaccgggccgagaagaagaaaaccgattcaagaaaggaaaggctcctgcaactttacaaaactatcaaggacgagggacgaaattggaccgaggaaattaaacagcgcgatgcaggcgactttaacagtaagaaattgttcctgtactatacacagcagggtcggtgtatgtacagcggggagaagatcacctccattggcgacttatttacttctaagtatgatatcgaccacatatacccgagatcggtaacaaaagataatagctgggacaacctcgtcctggtgaaggcggaacttaatagggagaaaaaggatatttatcctatcgaaaaagacacgcaagatcgttgcatttccctgtggaagcagctactcgagcagggactgatctcagagcgcaagtacgaacggttggttagaaccactcccctgacagctgacgagttagccgatttcgtgaacaggcagctcgtcgaaaccaatcaaagtgtgaaagcagtaacaaacctgcttaagcgactgtatccagacactaccatatgttacgtgaaagccgagaatgtttctgattttcggcaggaacgcgagttcgtcaagttgagaagcctcaacgctcaccatcacgccaaagacgcatacctgaatatcgtggtgggcaacgtctatcatgagaagtttacgaataaccctaggaacttcattaagaatgctcggtccgacaaaaagcgaccctactcactaaaccacatgttcgattatctgcttcaggttgggaataaagaaatctggaacccaaagaccgacaataacctcgtgaaaaagatgatgagaaataacgatgtgcaggtaacacgcatgctggtcgagcaaactggagccttgtacgacgcgaccatttataaggccagcgtgacaaaatctgaatcctacgttcccctgaagagtagcgatgctatcttatctgacgtgaaaaagtatggtggctttacttccataaaaattgcatactactcaatcttcaggttttataagaagaatagtgaggagttcgaaacccacatcattagcatccctgtcctcaaagccgggacgctgaactcgaaggaggattacgtggcttatggagaagagattatgaataaacagaagtttgaccgtgttgaacttgtgtacaaaaagctgtgcatgaactccttggtacggataaatggcgtcatgtattacctcggtgggaaaacaaacaattctctgtatatcgatagcgccatttcattggtgctgccagacaacatcgcaaagaagattaaagcggtggagaagtacatcgccagagtcgctgagaacggcaattacaaaccgcagcccgatcaagttagtcctgaatttaacatgataatctataaggcccttaccgagaaaatgaagcagccagcattcgtgggactcaagactaatagggaaaacgagctggaaaaagagacaaccattactgctttcatcgccatgaccttgattgagcagtgtaagatgttaatggaaatcctgaatctcctgacacagcagaaaacgacctacgcacttaagcccataggcgtatccgcctctcgcagcactctggggatgaacattacaggattgtccgagtttaccatcatcacacaatcagtgactggcctacaggaaaaagagattcgaataatctga

SEQ ID NO: 2989 - RNA, 4026 nt, synthetic construct
  misc_feature 1..4026: note = Cas9 variant
  source 1..4026: mol_type = other RNA
atgtggggcagcagactgttcgaggaagcctccaccgctcaggacaggcgggagcaccgctctaaccgacgtagactcgaaaggcggaagtaccgccttgatctgttggaggaattatttgtggaggagatcaataaaattgaccccgagttctttataagactgagggagtcaaagttccattttgaagatcggagtcttaaaaacacattcatcctctttaatgacaagatggaagggggatataacgataaagtcttctttagcaagtaccctactatttatcatctgcgctccgcacttatcaatggtaacaaggaggacgttcgagccgtgttcctggcgattcacaatatcttgaaaaacagaggccactttctcctggctgggaatgatataaacatctctctgtcgctcaatgacacgttaaccgatctgttcgaataccttaagattcatttgggaatcgaggtagaatttgagaacaaactgaaggacattgagaaaatcgccctagataagaatctctcaaagagcgacaaacaaaagaaaatagtgcagctgcttgaaacagattataagaaacagctggcagacgtcttcaagttgagtctcggcctgactgccaacatggagaatattttcggtaaagaaaacgagcaggggttagaatttatcaacgctgagaataagattaagaaaatccaattcgactcctcttacgaagagaacatcgcagagtttgatcagttctatggagaatactttgagattatagacatctgcaagaaaatttacgatgccatcagcctgtcccagatactcgtggacggcaagggcctttcagaaagtaaagttctgagctatgagaagcacaaggaagatttgaaactactgaagaaagtgctcaagaatattgacaaggcttacgataacaaaggggaggacaggctggtctataaggtgcttaaagaggataaggacaaaggaaccaattacgtaaactattctaagctgtccaataacggtacagccaccactaaagaagagttctacaagtttttgtcaaagaatctcgatctgaaaaagttcggcaaattaaacaaggaagacatcgagacactggactatatcaatagcgagattctactcgggcggtttctgccacttcagaaagaaaagatcaacggagttattccgtaccaattgcagatgaaagagctgacccagatactcaataacgcgagtaagtacctgcccttccttaataagatcgaagatggcatgacggtgaaagacaagattatctctctgatcaaatttcgtattccttattacgtcggtccattgaacgagtataaccgcatagaaaatgggaacggattcgcatggatcgagaagaaaaagaatgagaagatttttccctggaacttcaatgatgtggtggacatcgaaaaatccgccgagaagttcattaacaatctcactaacaaatgtacctacatcaaggaagagacagtcctgcctaaaaatagcataatctattcgaagtttatggttttaaacgaactgaataacctacagtacggcaataagaaactcgatattgagctgaagatgaaaatgtatactgaccttttcttggagaagaaagataacagaaaggtgaccgaaaagaggatcctggagtactttcggattaatggcatcaacgacgggaaagaaaagctcacaggactgaacaatgagatacacgctgatatgaaatcttaccgagacatgtgcgaaattatgggtgagaacttcaatatcaacgtagccgagaatattatcaactggataaccgtgtttcatggcgaaaagaaaatcttaattaataagatcaaaaacgtctatgggaagatgttcaatgatgagcaaatttccaagctgtcaaaacttaactacagtgactggggacgcttgagcaagaaactcctgacggatatcaagtgttatatagacgcagacggcattaattttccagtgtccatcctagaagctatggaggtttctaacaaaaatctgatggagctcctgagcaacaagtacgagttcatctcatgcattgatgacatcaataacaagtattttggtgatagagacattagtgcctccgaacttatagatgaattgtacgtgagccccgcggtcaaaagggggatctggcagtctgtgcggattctggaggaaatcgtatcaattatcggccacaaccctaagaaaatattcatcgagatgactcgccataatgaggaaaaggttcagaaaagtagcagaaggcacaacttagaggaactctataaggccattcgtaaggacccagagtacgtggaactgatcaaagagtttgattccacaaccgacactgattctttcaagattaaaaagctatacctgtattttatgcaattgggaaaatgtgcatactcgaaggagaagatcgacttcgataaactcttcacagacagctatgatatagaccacatttacccgcggtccaagaccaaagacgattcaatccataataacctggtcctagtgaaggctaaatataatcgagaaaagacggacgtctaccccatcgatattaacatacagaagaatatgaacagtttttggaatttcctgtataccaaaaagtttatcacagaggaaaaatacaagagactcattaggacttctgacctgaccgatgaggaacttgccaaattcatcagccgccagttggtggagacatcccagtcaactaaggctaccgccgaggttctgaaacaaatttacggcgacagcgatatctgctatgtgaaggcagaaaacgtatctgactttcggtacgggtccagtagacagaaggataaaaatgacatacagaagttattcgtcaaatgtagggaggtgaaccactttcatcacgccaaggatgcttatctcaatatcgttgtgggaaacgtctacgacgtgaaattcacaaagaatcctgtaaactttattaagaaaaataagatgggtaacaaaagcaactattctctgaatcatatgttctgctttgacgtggaacgcaacggctacaaggcgtgggattcctcagagaccatcaaaactgttgggcgaatgatgaagagtaatgacgtccggattacgaagcacgtgcacccaacacgtggagagctttatgatgcaaccatctacaaagccaagatagctaaaactggcagctacatgcccctgaagtcgtccaaaaacacccctctatctgacgtgacaaagtatggtgggtacaccaagattaaaatcgcctattacagcgtctataagtacaaattctcagataagaatctcatcaaaactgaaattagactgatcccaatacccatttatttgagtaagaacgacgatgacatcaaagagtacgttaagaattacctgaacgatagggtaaattccaagttaattgacttcacaaaaatctatgataagctctacgtgaactctctgataaaaattaatggctatctttactatctgggaggcaagacgaacgaccgcgtgtggatcgataatgcagtcagcatcgtgttggacgacaaaattgaatacctcatcaagcggatttccaacgatataaagtatgggtacgagatcaatgtttcagacgatgaactgatggacatttacgagagcctagccgagaaagctaacaagaaaatcttttataacagactgagtgatttcgaaaagatcttttctaatatggacgtgaaaaagaagttcgtcaaacttgagaagaacgataaatgtagggtgctcctgcagttgctgaatgttttaaccgactcccaaactacatacaagctcgaaatggtgggactgaaacatagccgatcgaacattggtatgaagatatcaaatcttgaggaatttaaggtaatcaactctagtattaccggcctgtattccaatgagatcgatattttgaacatctga

SEQ ID NO: 2990 - RNA, 4026 nt, synthetic construct
  misc_feature 1..4026: note = Cas9 variant
  source 1..4026: mol_type = other RNA
atggagaaggactactatctgggcctcgatatggggagcggatccgccggttgggctgtgaccgacgatcagtaccacgtccttagagcacatggcaaagccatgtgggggacaaggctgttcgaatctgcgaacactgctgaggaacggcgcatcaatcgaacggcccgtagaaggttgaagcggcgcaaccaaagaattgagtggttacaggaaatatttgcagaggagatcaataccaaagactcaggattctttaggcggatgaaggaaagtcgctattgggccgaggataaacgagacgaaaacggcagctgccccgagatgccttactccctgttcattgatgaggactttacagataaggaatatcacgagaagttcccaactatctaccatctaagaaaatatctcatgaccacagaagagaccccgggtattaggctggtttaccttgcttttcaccatatgatgaagcaccgggggcacttcctgttgaatggaaacatcgaagagatacgtaaatttcgcaagactttcgaccagtttctcgaggtggtaagaaatgaagagatgggcttcgcaggcgaaatcgaggaagagacatacaaaaagattgagatgaccctgaaggatgtgaacctgacgaggtctgccaaaaagactaccctcatcaaatcgttaaaggtcacacgggtggaagagaaagaactgcttgctttgatttcagggtgtactgttaagctgagcaatatctttaacgacaaaagtctagatgagaccgaacgacccaagatatccttcgccgacgcgggattcgacgattatgaggcagagattcagtctaatctcaacgaaaagtactatatcattgagagcgccaaagctgtgtacgactgggccgcactggctgatatccttggtgaatattcctgcatctcagaggccaaggtcgcgctgtacgagaaacatcacaaggacttgaaacgcctcaaggatctggtgagaaataacattagtagcgaagtatataaggagatatttgttgacgtgtctggcaaatacaagaattactgtgcctatatcgggacaaccaacattaacggaaagaagaaagatttcgaaggcaagaagtgcacgaaagaggacttttacgcatatttaaagaaatccgtcatcgaatgtataaatgattcagagaagactgactggctgaaactcgagcttgaaaagggtaacttcctgcctaagcaattgacaggggagaatagcgtgattccataccaggtgcatctatatgaactgaacgctatcatcaccaatctccaggagaggattcccctgcttaaacgggatggagaaaagatccgccagatttttactttcagagtcccttactatgttggcccactgaacggcataagtatcgacgggaaaaagacaaattgggtgaaaaggaaggagggagtaatttacccctggaacttttctgacatcgtggatgaggaatccagcgccgagtcgttcatccgtcggatgaccaataaatgcacgtacttgattcacgaagacgtcctccctaagtattctctgttatactcccgatttgaggtgctgaacgaactaaataacgttagactcaatggtgagctgctttcagtggagttgaagcagaaaatatatgaagatgtcttccagaggtaccgcaaggtgacccagaaacggctgaagagatatctcctgacagagggcatcattgacgaaaacactgtaatcaccgggcttgatggagactttaaaggcagtctgacagcttaccacgatttcaaggagaagttgactggtctcaatctgaccgagagggaaaaagaggaaattatcttaaacataacactgtttggggacgcccgcagcctactccgaaagcggatcggcaaaatttgttcccagctgtctgataagcaaaaagagaaccttagcaagttgtcatatcagggatggggccgtctgagtaagaaattcctcaatgggatcgcaatttccgttcagggagaagaggagtggaccatcataaaggccctgtgggaaactcaagacaacttaagccagctgatgggtgctaaatacacgttcagaaatgcggtggagaaggaaaacggcgagcttgaaaatagggagatttcttacgagacagtcaaagatttgtcaatcagtccaagcgtgaagcgccaggtctggcagtccctcctgattgtgaaggaaatctgcaaaatacaaaagaaaccgccccggaaggtttttgtggaggtagcaaaagaaaagaccaactctgggagaactgagtcgaggaaaaagcgactacaggacttctataagtactgtagcaaatatgaaaaggagctgtacgatgagtccatccagaataaactcgaaaagtgctcagagagtgacctgcgctctgacaaattatttttgtattacatgcagatgggacggtgtatgtataccggccaacctattgatttcgacgaactgtggaacaatcagaagtacgatatcgaccatatttacccacagagcaagacaatggatgactccatcgataacagagtcttagtgaaaaggatatcaaatcaggagaagaccgacgtttatcccattcgtgccgatatccgcgagaaacggagaggtttttggaaggaactcaaaaacgtggggctgatcagcgaggaaaagtacaagaggcttactcgagctacagagttcgaacctgccgagctggcaggctttatttctcggcaattggtcgagaatcgccagacgaccaaagtggtagcctccatcctcaagcaggctatgccagacactgaaattgtgtatgttaaagccagaacagtcagtgagttcaggcacaagtttaacttcataaaagtgcgggaaatgaatgattttcatcacgcaaaggacgcgtacctgaacgtggtcgttggaaacacctatctagtgaagttcacaaaaagccccgtgaattttatcgagaaccattctaatcgatcctacaacctgaagaaaatgttcactgatggcagagtagaacgcaatggggagattgcttggatctcaggagagaacggtaccattggcacggtcaggaatatcatgaagaaaaacaatatactcgtgacccgtcgggcccacgaagcaacagggggattctttgaccagcaactgatgaagaagggcaaaggtcaggttccggtgaaggggagtgacgagagacttttggatatcgaaaaatatggcggatacaacaaggagactggcgcctacttcgtcctggtggaaagcgacgagaaaaaggggaaaaagaagaggaccattgagtatgttcctatccgccttaaaaagcagctcgaaaataaccgaaaagctctggagaattacctttgcgaacaaagaggactgacaaaccccgtggtactaattgataagatcaaaatggactcgctctttcgggtcgatggcttctttatgtggctgtccggtaggactgggaatcagttgctgttcaagtgcgccaaccagttagtgctctctaccgaggacgaggcaacgctgaagaaaatagtgaagtttgtcaaccgccgtaaagaaaataaggagattaaaatctatgaaagcgataaacttaacgaggaaatgctgaatagattgtacaacacattcctctataagctgcaaaattcaatctacggaaaccggctaggcgagcaagctaaaaccctgagttccaagaaagagaattttgacaaacttcagattgaagagaagtgtctcgttctgtatgaaatattgcacatgttccagtgccagtctgccactagcgatctgcaattaatcgagggtccaggcaaggcggggacactcaggctgaactccaatattaccaagtacaaaaacatcaatattatcaaccagtcacctactggaatatacgaacaggtgatcgaccttcagaagatttga

SEQ ID NO: 2991 - RNA, 4026 nt, synthetic construct
  misc_feature 1..4026: note = Cas9 variant
  source 1..4026: mol_type = other RNA
atgggcaaggggtactatgtgggactggacatgggtaccggcagcgtcgggtgggccgttacagatgagtcctaccagatcctcagaaggcacggaaaagctatgtggggcgtgcggcttttcgaatctgcaaagactgccgaggaacgccgaatgtttcgtacgggtagaaggcggctggaccgcagagggtggaggattgagatattgcaagaaatcttcgcggaggagatttcacgggtagatcccggatttttcttacgcatgaaagaaagtaagtattaccctgaggacaaacgagatatccagggcaactgcccagaactgccgtataccctatttgtggacaagacattcactgataaggactttcataaaaagtaccccaccatttatcacctcagaaaaatgctgatggagacagaggatacccctgacatgaggcttgtctacctggctttgcatcacatgatgaagcatcggggccacttcctcctgagcggggatatctcccaggtgactgaatttaaaaatacattcaaccagtttatagagaatatccgtaacgaagagatggacttcgaaattgagctggatgagtctgccgttcaaatgatcgaagagaccctcaaggacaagaatttaacgcgctcggctaaaaagtcaaaactggtgaagggacttaacgccaaaaatgtcagagacaaggcatttttgactctgctaagcggtggcaccgtgaaactcagtgatctgttcgggatggaggagcttaacgaaggagagaggccaaagatttccttcgcagacaatggctacgaggaatatgccgctgtagttgagatggaactgggtgagttgtactatatcgtggaatctgccaaggcggtctacgattgggcaatactcagcgacattctagggggatccacatcagtgagtgatgccaaagtgcgggcttatgagaagcacaaagccgacttaaagtacctgaaagcagtcgttaaggagtattttcccaaggaagtgtacaacgctgtattcgtggagagctctgataaactcaataactaccctgcctatatcggcatgactaagaaaaatggcaagaaagtctcccttgaagggaagcgatgttcacgcgaggagtttatggacttcctgaagaaaaacattgtggttaagttgccagatgaagaggcgaaaatgtacctacagagcgaactggagaaggacagttttctccccaaacaggtgaataaggataacggagtcatcccttatcaggtgcataagtacgaactgaaaaagatccttgacaacctgggtgacaaaattccattcttgaaggagaatgccgagaaaatagaaaagctcttttctttcagaatcccgtattacgtaggccccctgaggaccgggaacggagaaaattccaaatttgcatgggctgaacgcaagagcacagagaagatttatccttggaacttcgaaaatgttatcgatgtggagcaatcggccgagaactttatacggagaatgaccaataaatgcacgtacttaattggcgaagacgtcctgccaaaggattctctactctactccaaattcatggtgctgaacgagcttaataacttgaggctggacggtcagaagatctcagtcgaactcaaacagaagatctatcgtgatgtgttttgtcggagtcgaaaggttactcagaaaaagctgaaaagctaccttattagagaggggatcgctggcaagaatgtggaactgacaggaattgacggcgatttcaaagggtccttgaccgcctatcacgacttcaaggagaagctcatagatgtagagctgactcaaaaagaaaaggaggaaatcattttaaacatcgtcctgtttggagacgataaaaagctactcaaacagaggctgaagaagaaattcccccagcttacagagaagcaaatcaataccgtgacggcattgtcttacaaaggttggggccgcctgagcaagaaactcctggaggaagttaccgtgcctgccccagagacaggggaagtctggaacattataactgctttatgggagaccaatgacaactttatgcagctgctttcaaaggaatatcagttcagtgatcggatcgaggagtttaacgaagagaaagcggaccccgaagtgtcctaccagacaattgaggacttgtatgtaagcccggcagtgaagagacaaatctggcagactctccagattatccaggaaatagagaaggttatgggagagaaacctaagagggtcttcgtggaaatggcccgcgagaaacaagaaaataagcgaaccgagtctcggaaaaagacactgtcagatctatacaccaagtgcaaaaaggaggaacccgagtggatcgaagctctgtgtacgagtctcgagaaacatgaggaacaccagctgcgtagcgacaaactttacttgtattacactcagaaaggcagatgcatgtattccggtgagccaattgatctggaagacttatgggataacacaaagtacgacatcgatcacatttatcctcagtctaagaccatggacgattcgctcaaaaatagggtgctggtcaagaaagagtacaacgccaagaaaagcgacacttatcccatcgcagccgatatacaaaagaagatgatgccattttggaaatcccttctgaccgggggcttcattcccaaggaaaaatacgaccgcttggttcggaataaccctctcgatgctaatgagctggccggatttatcgaaagacagattgtggagacaaggcagtcaaccaaggcagtggcggagatcctgaaaaagatactgccagacactgaaatcgtatacgtcaaggctaaaacagtgagtaagttccgacaggactttgatttcattaaagttcgcgacatgaacgatctccatcacgccaaggacgcatatctgaatatcgtggtcggcaacgtgtactttgttaaattcacgaagaatgccgcttggttcgtgaaagagaacccggggcggacctataatcttgaaaagatgtttatttgggatgtagccagagacggagagatcgcatggaaggctggtaaatctggcagcatagtccaagtgagggccatgatggaaaagaaccatattttggtgactcgtcgctcctacgaggtcaaagggggactgttcgatcagcagatcttaaagaaaggcaagggtcaagttcccgtgaaggagtcagacgaacggctcagagatatcgggaaatatggcggatacaataaggcggccggcgtatattttatgctggtgagctctaaagacaagaaagggaaggagcagaggacaattgagttcgtccctatctaccttaaggatcgagtggaaaaagacatggaatccgctcggaactacctgatggaggagcgcggactaagagaaccaaagattctcataaagaagatcaaaattgacaccctgtttaaggttgatggcttctatatgtggttgagtggtaggacaagcaaccagctgatctttaagggggcaaatcagttaattctctctaaagaggacatgaagactctgaaaaaggtggtcaaatacatccaacggcagaaggaagataaaaacgtgaagatatccatgcgagacggaatcaccgaggaggaacttctgaagttgtatgagacgttcctcgataaaattagacactcaatctacggcgcccgcctgagtagccaggaaaagaccctagttaatggtaaagagaagtttattgacctgtcggtggaagctaaatgtcaggtcctttatgagatcctccatctgttccaatgccagtccggcgccgcaaacttgaagatgatagggggacccgcgtctgccggcattctggtaatgaataacaatatcagcaagtgtaaaaacatctcaattgtgaatcagagtcctacagggatatacgagaaggaaatcgatttactcagggtttga

SEQ ID NO: 2992 - RNA, 4026 nt, synthetic construct
  misc_feature 1..4026: note = Cas9 variant
  source 1..4026: mol_type = other RNA
atgacccagaaggtgatcccctacaacattggcctggacatagggacaaatagcgtcggatgggccgttactgataacgagaataaactccttcacatcaagggtcataacggcattggggtgagactgttcaaagaaggacaatccgctgcagagaggtgcggctttcggacgacccgccgacgtttgtctagaaggaagtggcggttacgcctgctaaatgaaatcttcgccgacaaaattgcgaaggtagatccttcatttttcgctagactcaagcagagtaacgtgagcccaaaagacccgaataagacaatgtttggtaacatcctgttcgataatgggaaccttaatgacaaatcctttcacgatgagtataagactatataccatctgaggcagtctatcattgaccaccccgagaaaaagttcgatatccggttgatttatctcgccatgcatcacatcataaagtaccgcggacactttctgaaccaggcaaatgtccaagacttcaaaggcggcaagattgatctggaagagtcgtttaaagacctcaactcaatcttcgaaaatcaggggcgagatttaagactggtgaccgaggacgccaacaagtatgttaaagaacttagcgacaacagtaagacaaggaatgatcggcagaaagagttgtccaaggtgctgtacattcctatcgacaagaactctgataaaaataacaagaaagtcaccactgagatcattaaggctatactaggaatgaaagcaaagtttgacgtgatcttcggtattgatgccgaaaatgctaaggagtggagcctcacattcaactccgacgattttgacgataaaatcgaaggcctgtcagcccagatgaccgacgaggcgggggaaatacttctgattttgaaggagctctatttcgcactgaatttaagtgatatcctgaacaatagcgtaacggacaaaaacgccaagactctctctgaggctatgatcaatcgttacgacgatcataaagaacaacttaccatgctgaagcaggttattgacaactccgataagaaacacgccaaggcattgaaagctgcctactcagcgtatatcgacggagagaataacaagaaaattagctttgaagatctacgcaagagaatacagaagaatctggacaacagtgagacatctaaaaagatcaacgatctcctggaacatgactacttccttccaaaacagaggtccaaggagaatggcgccattccccaccaactgcagcagcaagagttggataaaatcatcgaaagccagaagcactattacccttttctcgcagagctgaacccaaatgaaaaacggtcgcgacaggctaagtataagttagacgagctggtggccttccgcgtcccctactatgtgggtcctatggtgaaagctactgaaaacaatcagtctaacaatgggaagtttgcctggatgattaaaaacgataatatatccgacaagctcaaaaaggaggagatcaccccatggaacttcgataagaaagtcgacagaacagaaaccgcaacgaagtttattactaggatgacaaccactgacacatacctaatcggagagccggttctgcccaaaaattcacttttgtaccaaaagttcgtggtactgaacgaactcaataacctgaaaattaataagcagcctatcaccccagagcagaagcagtatgtgtacgagcatgtcatgaaacaaacgaagcgggtgagtcttaaaaagatagccgatgctctggttatcaaaggcgactatccctacgcgcctgaaattaccggcacaactgatcagaagaacatgaacaatgggttgagcacctatatcgacctcgcaaagatttttggagatgagctggacgatatcgaccgcaaagaagatttcgagaagataattgaatggtccacaatctttgaggaccagcacattttcgccttaaaactgaaggagatcaaatggctaactgaagatcagagaaagcaagtggtcaaactcaggtaccagggttggggcaagctgtctaagaaacttttggctgacctggtggatgacaacgggcagcgtataatcgacctcctgtgggatagcaagcaggacttcatgcaaattgtaaatcagaactcatttaaacaggccatcgcagagcataatggagcccacttagaagagaaggatctgaaagacattatcaacaatctttataccagtccacaaaacaagaaggctatacggcaggttattttggtggtcgatgacatcatccgagccgtgggctacgaacccgtcaatattatgatggagttcgcaagagaggattccaaagaccataggctcacaaacagccgctctcggcagctggaaaaggtgtacaaagatatcaccaattcatggtttgacgatgacaacgttaaggacgagctaaaagataagattaaggacaaagcgaagttcactgatagactgtatctctactttacgcagggtgggaaagacctgtatacaggcgaaccgcttgatatagacaatttgagtaactaccaaatcgatcacattctgcctcagagcttcatcttagacaattccctcgataacagggtgctgacctctaagattaacaatcagatcaaaaaggacaaccttcccggagagtttttcggctcgaagatgcacaatttttggaaacatctgaaggaattgcacctcataagcaacaaaaagtattacaatctgactctaaccccaaactccatctcaaaattcaataaccaggggcgctttattaatcgacaactggtagagacacggcaggtcatcaagctcgctgccgagattctgcataaccgttatagtgaagagaatggaaccaacatcgtgactgttaaggcaaatcttacacaccacatgagagaaaaattcaacttttacaagaataggaacgtgaatgattaccatcacgccttcgacgcttatttggccgcattcgtcggtaactggctgttacagcagtaccctaaactcaagccctattttgtgtacggcgatttcgctaaaacggagatagacaacctgaagtcttttaatcttatttataaattcgagcaagcccatcagctgaacgaagaggacgggaagatcgcgaaggataccgacgccctactcggatacatgaaaaatgtatatcactttaagaaaatgctggtgactaaggaattggagacaaaccatggcaatctgttcaaacagaccttatacccaagccacggtaagatgaagaacctcatcaatcccaaagaaaaccgctcctcagatatttacgggggctatagctctgagacaggagcttacgtttccctgataaaggtctttaaaaagaataaaatcgagaacaagattatcaagattcctcttctgtatatcgacaaattgaatcggcaagcaaacgccaagcagttcataagaaattttatcattaaagatgacagtaacaagttcgatatcctcagcgagaaaatttttctgaatcagctagtgatcgacggcgatgaactgttcactatatctgggtccggagacaggcagaacgctcaacagcttattctctcagataagagtctgaagatcttgagcaaaaacatcaatgtgatttcgaagaacgacctgatcataattttcaatgaaatcattgatgacatctgtaaatacatgaagatgtatgaggtcgaaaactccgacgagaccaaagccaagtttgaggaaataaatgataaagaccgaatgttaaagattatcaacgatctcctgcttggtctgcacgcaaatgcgtctcgcagcaacttgtcaagtatcggcctctccccatctttcgggcggtttttcagcggaaatgccggcattaagctgtccgagaacgctaaatttatctaccagtcaccgacgggtctattcagcagaaaggttaaaattagtgacctgtga

SEQ ID NO: 2993 - RNA, 4032 nt, synthetic construct
  misc_feature 1..4032: note = Cas9 variant
  source 1..4032: mol_type = other RNA
atgacctactatctgggcctcgacatggggacaagctccgtgggatgggccgtcactgatgagaactacaatcttatccacagacataggaaggacctgtggggtattcgggagttcgaagaagctaaaacggcagttgagcgccgaacccagcgtatatctagaaggcggcgccaaagagaagtggccaggatcggcttgttaaaggattattttcacgacgagattcagaaagtagatcccaacttctaccagcggctggacaattcaaagtattttcctgaggataaagaagaggtggtcaaggggaagaacggaatcttcgcggacgaaaattacacagatcgcgactattttgctgagtacccaactattttccatctacgaagagagctcctgaacagtaaagaaccgcacgatgtgaggcttctgtacttggccctcctgaatatgtataagcatcggggccactttctgaacaccacactcggtaccgacggggagaatcgtaaattaagcgatgtttaccgcgacttcgtggtcaagactgaagaggtgctgggacttacatttccccaggaaaccgacaacggcaaaatgcaagagatcatgtgctccagagagttctctaggaagcggaaggcagaattgctgtgtgccctactcgagatagataaaaagcagaaacagcaggtagctctgatcgaatgcgttcttggcctggacaagtcggtgaaacaaatgtatgggacggcagtccctgatgactttgataagtcagtgaaagtgaatttcagcgacagttcctttgaggaaaaggtctctgaggttgaggaattgctcgatgaggaaaagtacgagctgattttatgtatgaaagaactgtatgacactgccgtgctcaaccagatcatgggagattgcaattaccttagcgaggctcgagtacaggagtatgaaaagcacaaagaggacctgaagttgctaaaacgcaccgtgaagaagtacggtacagccgaagagtaccagttcctgttcagatcctcagagaaagcgagttataacgcatacgtccatagcgttaattctggcgaaaagattaggcggaacatggatgggcgctccagagacgacctctatactgtgctgaaaaagatgcttaaaaactacccacaagaggatgccgactgtaagtatatcctggaagagatagaaaaggagcagtttttgcccaaacagctcgtgtcagataatggagtcattcctaaccaaatccactacaaggagatgaaaaagattctggaaaatgctgagcagtatttacatttcctgagggaaaaagacgagagcggctacaccgtggccgaacgtatcctaaagctctttgcattccagatcccatactatattggtcccacaagtgagaagtctgggaaaaacggaggcaatggctgggtagttcggaaggagcaggggcaagtgctgccttggaacatagaagagaaaatcgatatgaaggctacctccgaaacgtttattagccgaatggtcagaaggtgcacttacctttcggacgagatggtgttgccaaaagcctctctggaatatgagtccttctgtgtcctcaatgagctgaacaatcttcgcatccggggagtgaagctgccgataacagttaaacaggatatttacaaggacttgtttgaaagaggtaagagggtgacccgcaaacagatcgtaaactatctcaagggcgtcgggatcctgcaggagggagaagaggatgagttaactggcatgatggacacattcaattcaagtctggcgagctacggtaaatttaagtccattctaggggagaaaatccaagaagattcttgcaagcgaatggtggaacagattatattctggtgtaccatctatggcgacgccaagaaatttctcaaggagcagctggaagagaaatacggagatgttcttacgcgggagcagattaagcgtatcttgggcttcaaactgaaggactgggggaacctcagcaagaaatttctggaattaaatggatgcgacagaaacaccggtgaggtgatgtcactgatcaggatgctttgggaaagtgatgacaatttgatggagctcctgaaggattccagctacacatatcgcgcagaactagaggagcaacaggaaaaactgactaagaccctcacagagatttgtcccgaagacctggagggctactatttctctgctcctgtcaaacggatgatatggcagactcttttgatcctgaaggaagtggagaaggtaatgggggagccacccaaaagagtgttcgttgaaatgaccagggagcacgatgaacgacgcgagatgaaggactcacggggcaaaaagtttcaggagttatacaaaaacattaaggatgaggaacacaactggaaagccgaaatcgaggacgctgaaaaggatggaagaattaggagtaagaaaatgtatctctacctgacacaacgtggtcgctgcatgtataccgggaatcctatcgaccttgaggagctgttcactacgaagtacgatatagaccatatctacccacggcactttgtcaaagatgacaacttggacaataacctcgtgctggtggaaaaggagaaaaatgcccataagagcgatcagtatcccctaggcgacgatatttacacaggaagactgtcctggtggaaggaactccacagggagaaactgatcaacgacgaaaagtataaacgacttaccggccgggcaccgttctctgatgagcagaaggccgggtttattgctcgccaattggtcgagacttcgcagggaaccaaaggtgttgcgagcatcctgaaggaagtgttacctgagacaaccactatagtgtacgcaaaggccagaaatgtatccgacttcaggaacacaaatgaactcctgaaagctcggtcagtcaacgattttcatcacgcccaggacgcatatcttaatattgtggttggcaacgtgtactatgtcaagttcacgaataaccccctgaattttgtgcgaagtggggagggatacaacctagatggcgttttccgcaaaaacgtgatcagaggtcaggaaaatgcctggattgtaaagccagagaaaggggagaagatgaccctcgaaactgtcaagagggtgatggctaaaaacacacctctgttgacccgtctgtcttttgagggccggggaggcttagccaatcaaacactctacagcgcaaaggaagcggctggggagggatatgtgcccctgaaatcctcagacagcagacttcaggatgtcactaagtacggcggtttcacctctgttacgaccgcctattttatcctggtggagcacgacatgaaaaagaagagggtacgcacaatagaatccgtgccaatcttgtggaaagagcgaattgaaaaggagagtgggcagctcgaaatctactgcagagaggcactgggcctagtcaaccccgacattcgggtgaggaaaatcctgatacagagccttgttaagaaagatggattctatatgcatctctctggtaagactggcaatcgcttcattatgcgtaacgccgtggagctgtgtttgaaacaagaatggatcaattactccaagaagctggagaaagaagggtgcgacgagtcaatcaccaaggagaaaaacgaagagttatatgaaattctcaaggagaaacacatcaatggaatttacagaaagcggcctaacccaatgggcgaaaagctgcatataaggcaggagacatttcgcatgcttactctggaggaacagaaaaaggtcttgctcagtctgctaaatctgaccaaaatcgggccggtggaggctaaccttgaactcattggagagagcgcccacacgggcaagatgctgatctcgaaaaatattacagaagttaaggagttctacttgatccaccagtccgtgaccggtatatatgagaagcaagtcaacttactgactgtatga

SEQ ID NO: 2994 - RNA, 4032 nt, synthetic construct
  misc_feature 1..4032: note = Cas9 variant
  source 1..4032: mol_type = other RNA
atggccaccaagaaagagtacaacatcggcctggacattgggacaactagcgtgggatggtccgtcgttgaaacggataatcagaaggtgatgagaaaaggtaacaaggctctctggggcgtaaggcttttcgaggaagcaaccacagccgagtctcggcgcatgcaacgatcaactcgtagaaggtatgaccggcgcagagaaaggataaaactgttgcaggaggagtttagtgaagagatcaataaggtggataagaacttctttcagaaattaaaggaaagcaaatacgtcgagaatgacaagattaacaaaaagatcgtgctgaccaaggaggaaaaacaggagctaaaggattatcaaaataaatacaagacaatttatcacctccgggacgaactgatcaacaatcccgagaaaaaggatatacgccttgtttacctggcgatccatcacattatcaaatatcgagggaacttcttgtaccagaatgctaactttaatattgacaacctcgatatcaaggacaagctgaatgaactgttctccatactctctaacaacattcaggagttagagatccctgaagattacattaatatcatcgactttgatgagctggaagccgaccttttgaaagacaccaagaacgatgtgaaagcactgctaattgacaatctcactgagctgacaaacaagtcgtcagccaccgagttcggaaaacttatggtcggcaataagggtaacataaataagctgttgatgctcgagacggataacaaaatcgagattagctttagtgggactgactatgatgacaagtacgaagagtatcaggaagctctgggagagaatatcgaaatattagatattctgaaacaaatctacgactgcatcttcctcaagaaaatttttaagggcaacaagaatacctccatctctagccttatggtgaaatccttcgagcagcataagaaagatctgaactttttgaaggagctattcaaagacaatagagaactgtataacgagattttcaggacaaagaaggatctctgtctgtacgaaaaatatataactaataagatcgactgcgacgagtttcggaaagagattaacaaacttctggaatcattgttcagtgatgagaacatcaagcagaatctcctggacgaatacaacttagaggtaaaggaacgtatcgagaatggcacctttctgccacgcattacaaccacggataacgggaaatacccgtatcagctaaataagagcgagctcataaagatcattgaaaaccaaggaaaatactatcccttcctgcttaataagttgaacgacaataaaacttacaagatcgttaaactgctcgagtttaggattccttattacgtgggtccactggtctctgaaaagaggtccgagaactcatggcttgaacggaagatcaataacgtgaaaataacaccctataatttcgatgacgtggtcgataaggagaaaaccgcagagaagtttatcaaacgaatgattagccactgtacttacctgttggacgaatacgccctcgctaacaatagtatcctgtattctgagttcaaggttatgaacgaattaaagcagattcgcgtgaacgatagaaaactggagctaaagtttcagcaacagatcctcgaagacttctttaaaaagacatccggcaccataacggagaggaaattcaagaattacctgattagcaccggggagtattcgatggaaggaggcaactttcggatcacaggttactctgccgatgggaagttcgcgaataacatgcagtcctatgtagacttctttggagagaatggcattttcgcagatactgactacaaccttgaaaatgccgaggagatcatagaatggatcaccatttttgaggacaaagatatcttggaaaagaaagtgcgcgacaactattcaaagctgaatgagaaccagattaaaaaggtcctcgctaaaaagtacagtggctgggggagcctgtccaagaaattactgaagacaaaatactataaggataaagccactgaactttacaagtctatcttggacctcatgtatgagaccgataagaatttcatgcaaataattaacgacgataaatacaattttcaggagatgatcaagaaattcaacaataaggaagagaacaaaaagctgaactatagcatcgtggaagaactagcaacaagtcctgctaccaagagaggaatttaccaggccctgaaagttgtggaggaactcgtcgactatatcggttacgagccaaagaatattagtatagaaatggcgaggtccgaggaagagaaagtgcgtaaggatagccggaaagactacatcaacaatctgtataagggctgcaaggattctattgaaaactacaaaaagctgaaacatgagttggactcacacgagatcacttcacagcgactgtttttatatttcattcaagaagggaagtgtctctacacgggaacacccctgaatatcgaggatatagaaaaccagagcctttatgagatcgaccacattatccctagatccctgattaaagacgattctatcgacaataaggccttggtactcaaggagtgcaaccaggataaaaaggcatcgtacgttctgccaagcaaatttagaaattccaagcagaaaacctggtggaagcatctaaaagacaacggcctgatgtcagctaagaagttccacaatctcatacgcgaaaaatataacgaggaagatattaatggttttatcaaccggcaactggtggagactagacagatcaccaagcatgtcgccaatattcttaacaatttgtacaaagacacaaacgtgatatacctgaaggctgatttaagtcacaactatagggaaaaatacgacctcttcaagtttcgcgatatcaatgactatcaccatgcccacgatgcatacctggccgctgtccttggggagtataaggagcgattcatgaaacggaagattaacttcgacatggtgaaagaacttaattctaagatcgttgagatggacgaaggcaaacgtagaaacctaaggtttggatacgtgattaatagcctcgatgagaacctgaatgacatcgtattgaagatatccgaaaacctggtcgataatgagaccggcgaggtgttattcgacgcgcatgaatttaacaagcgcgttgaggatactctctatcggaatgacatcctgatttcaagaaaaacagaaatcaggacggggcagttctacaaggagaccatttacaaaaagggaaaaggtactatcccgataaagtttggcatgcccacagatatttatgggggatacagcaacaccaatgcacgaaaacttatgctgatcgaatataacgagtctaagatgaagatcattggcttgcctatggccctcgctgtgcgcaataacgacgccgagatcaacgattacataaaaacacagattaatctgaagaaaaactccactttcaagatcaaaaagtgtagtattccatttgaaaccgagatcatatataataaccaaaatgtcttcattaagggttacagcatcgggcacaaaaactgcgaaatctctaatgcaattcagctaaagatcgccaaagacaagatgaaacattggaagtatgctctgcagtaccttctcaacgataagaaacaatacattgactttgccgagaagtatgtgaatgagatatacgatttcctgatcaacttggacctgtttcccttattcaataaagaactcgacaagattaaaaacaaggtaaatttcgaggatctggcacttgaccagcagaagaaaatcacgaaggaactgtttaaaatgttgcactgtaactccgtgaatgcgaacctctcagagttcggcctgggagatcggatgggcagactaagtgggtataacatcaccgacggaattataatcagcaagtcggttacaggtattagggaatcccgttacgagttttga

SEQ ID NO: 2995 - RNA, 4035 nt, synthetic construct
  misc_feature 1..4035: note = Cas9 variant
  source 1..4035: mol_type = other RNA
atgagccagaacaataacaagatctacaatattggcctggacataggggatgcctccgtgggatgggctgtcgttgacgagcactataacctccttaaaagacatggtaagcacatgtggggctctaggctgttcacccaagcaaatacagccgtggaacggcgctcaagtcgaagcactcgtagaaggtacaacaaacggcgcgagagaatcaggttgttacgggaaattatggaggatatggtactggacgtggatcccacgtttttcatccgcctagcgaatgtctcctttctcgaccaggaagataagaaagactatctgaaggagaactaccattctaattataaccttttcattgataaggactttaatgataaaacctactatgacaagtaccctacaatctaccatctgcgaaaacacttgtgcgagtcgaaggaaaaagaggatccaagactcatatatctggctctgcaccacatcgtgaagtacagggggaacttcctctatgaaggacagaagttttcaatggacgttagcaatattgaggacaaaatgatcgatgtgttacggcagttcaacgagattaatctgtttgaatacgtcgaggaccgtaagaaaatcgatgaagtgcttaacgtattgaaggagccgctgagtaaaaagcataaagccgaaaaggcattcgccctatttgacactaccaaggataacaaagctgcatataaggagctctgtgccgctctggccggcaataaattcaacgttacaaagatgcttaaagaggcggaactgcacgacgaggatgaaaaggacatatcctttaagttctctgatgcaaccttcgacgatgcctttgtggagaaacaacccttgctcggtgactgcgtcgagttcattgacctgttacatgatatctacagctgggtggaactgcagaatattctcgggtccgctcacacttcagagcctagtatcagcgccgcaatgatccagcgctatgaagaccacaagaacgatcttaaactgttgaaggacgtgattagaaaatacctaccaaagaagtactttgaggtcttcagggatgaaaaatctaagaaaaataactattgtaattacataaaccatccctccaagacacctgttgacgagttttataaatacatcaagaagctgattgaaaagatcgatgacccagatgtgaagaccatactcaataaaattgagctggagtcattcatgcttaagcagaacagccggacgaatggagctgtaccctatcaaatgcagctggacgaattgaacaaaatcctcgagaatcagagtgtgtactattctgatctgaaggacaacgaagataaaatccgatccattttaacttttcgcatcccttactacttcggcccactgaatattaccaaggacagacagtttgactggataatcaagaaagagggcaaggagaacgaaaggattctaccgtggaacgccaatgagatcgtcgatgtggacaaaacagcggatgagttcatcaagcggatgcgcaacttttgcacttatttccccgacgaacctgttatggccaaaaatagcctcaccgtgtcgaagtacgaagtcctgaacgagattaataaacttagaataaacgatcacttgatcaaaagggacatgaaggataaaatgctgcatacactctttatggaccacaagtctatttccgcaaatgctatgaaaaagtggctggtgaagaaccaatatttctcaaataccgatgacatcaaaattgaggggttccagaaggaaaacgcctgtagtacgagccttactccatggatcgattttacaaaaatattcggaaagatcaatgagtccaactacgactttattgagaaaatcatttatgatgtaaccgttttcgaagacaagaagatcctgcgtcggcgattgaaaaaggaatacgacctcgatgaggagaaaataaagaaaattctgaagttaaaatattctggttggagcagactgtcaaagaagctactcagtggcatcaaaactaagtacaaagactccacaaggacccccgaaacggtgctggaggtcatggaacgcaccaatatgaaccttatgcaagtgattaatgatgagaagttggggtttaaaaagacaatcgacgatgctaacagcacttctgtctcaggaaagttcagttacgccgaagtgcaggagctggcaggcagccctgccataaaacggggtatctggcaggctctcctgattgttgacgagatcaagaaaattatgaagcatgaaccagcgcacgtgtatatcgagtttgcaagaaacgaagatgagaaagagaggaaggactccttcgtaaatcagatgttaaagctgtacaaagattatgactttgaagatgagaccgaaaaggaggccaacaaacaccttaagggggaagacgctaaatctaagatacgctcggagcgattgaagctctactatacacagatgggaaaatgcatgtacactggcaagagcctggacattgatcggctagacacctatcaagtcgatcatatcgtgccccagtccctgctcaaagacgattcaatcgacaataaggttctggtgcttagttctgagaaccagcgtaaattggatgacctggtcattccgagctccatcagaaataagatgtacggcttctgggaaaagttatttaacaataaaattatatcacctaagaaattctacagcctcatcaagacagagtttaacgaaaaagatcaggagaggttcattaatcgccaaatcgtggaaacccggcagattactaagcacgtagcccagatcatagacaaccattatgagaatacgaaagtggttacagtcagagcagatctgtctcaccagttcagggagcgataccacatctataagaaccgcgacattaatgattttcatcacgcccatgacgcttacatcgccaccattcttgggacttatatcggacaccggttcgaatccctggacgcaaagtacatatatggtgagtacaaaagaatttttaggaaccaaaagaataaaggcaaggaaatgaaaaagaacaacgatgggttcatcttgaatagtatgcgtaacatctacgcggacaaggataccggagagattgtgtgggaccccaattatatagatcgcatcaaaaagtgtttttactataaagactgcttcgtgacaaagaaactcgaagagaacaatggcacctttttcaacgtcactgttctgccaaatgatacaaacagcgacaaggataatacgctagctaccgtgcctgtgaacaagtaccggtctaatgtaaacaaatatggtgggttttccggcgtcaattcattcattgtggccatcaagggcaaaaagaaaaagggaaagaaagttattgaggtgaacaagctgactgggatccccctcatgtacaaaaatgcagacgaagagataaagatcaactatctgaaacaggccgaagatcttgaggaggtccagattggaaaggaaatcttgaaaaatcagctgattgagaaggacggtggcttatactacatcgtggctccaacagaaataattaacgccaagcaactcatcctgaacgagagtcagaccaaacttgtttgtgaaatctataaggcaatgaaatacaagaattatgataacctggacagcgagaaaattatcgacctatacagactcctgataaataagatggagttgtattaccccgaatataggaagcagctggtgaaaaagtttgaggatcgatacgaacaattaaaagtaatttcgatcgaggaaaagtgcaacattatcaaacagatactcgctacactgcattgtaattcctctattgggaagatcatgtacagcgacttcaagatctcaactaccattggacggcttaacggccgcacgatcagtctggatgacatttccttcatagccgagtctcctaccggtatgtatagcaaaaagtacaaattgtga

SEQ ID NO: 2996 - RNA, 4035 nt, synthetic construct
  misc_feature 1..4035: note = Cas9 variant
  source 1..4035: mol_type = other RNA
atgaagaaaaccaacccctacatcctgagcctcgacattggcacagcctccatagggtatgcttgcatggatcttgacttcaatatcctgaagtaccacgataaagacgcaattggagtgttgacttttgagggtgccgatacggcggctgaaagaaggggcttccggacctctcgccgacgtaagaacagaaggatcaaacggttagggctgctacaggaggtcctcgcccctctggttaagaatccaaactattaccaacttctgaatttgcataagtggaaaaactcaaatgaagactttaagcaccgcagtctcagcgaggtgctgaaaattctgggaaagaacccgaaaacatatcccactatctaccatctccagcaggatatacagaatcaccctgaaaagaagttcgagccagagttaatctttctggcactttatcatttggtaaaatacagaggccacttcctgtttaacaatctatccttcgacaagggtaaaaccgtggataacgaagcccaactctctgagctgcttgaacagtaccagtcgattaatccctatgaggactcaatcagcaacaaggatattaatgtcatcgtggacacactgaaagatgaccagttgaccaggaacgacaagagtaaagagctcaagcggaacgtttccaagactcacgctgaactgtttaaaatgttagtggggctgaagttcaaacaatctatactctttgagaatatggaaaacgcagaggatattaaggaaagcgccacaggatccgacgctatctcacttagtgatgactactatgagaatctgagcgagttcttgaccgatgaacagctaaactttattgagtctgccaatacgttcttcatgggcatcatgctggaccgcatcctcaaaggcgcgacttccatttcagcagccaaggtccgagattacaagatatttaaaaaccagctgaagatcattaaagacatcgtgtatcagaataagtacgataaatatcatgagttctttgtaaccagcaaggaggacatgagagcttaccaagaaaaccctgatgccaagacattcgggaaacttagtaagtttgaccagtacctgatacacccaaaagaccagtatgcaaagttgatgaaagatctcaagggaattgttcccaagaaatacactgaggtgctgaatttaatcgacgagcaaaagttcctggtcgtgcagaacaccacagataatgcttctatcccttatcagaacaatgtgtttgaagccgagaacattctaaggaatcagcaaaaatactatccagaaatcaccgaggaaatgattggtaaggtcataaacctcatctccttccggattccgtactatgttggccccctgacgaacaaaaatgggcagagcgactttgcgtggatgatccgtaagtcggatgagcagactcttccttggaacttcgacaaagtgatcgataagtctaagtccgccgagaaatttattcgcagaatgacatcaaagtgtacctacttgctggaagaggacgtactcccaaaacatagtctgctttaccaggaaatggaggtgctgaatgagttgaacaatgtccaactcaggggagaaaacgagcccaagcaccggatacaccgactggatcctaaagtgaagcagttcatctatcataatttatttcagaagaaaaagaacgttactcacaaagacctgattacactactccagaatagcgaacatcgcaacaccctgaataagacgtccggccaaaaacttaaggtgttcggtacccagaacgattctaagttcgcaagcaaattgtcaacatacaatgacatgaaggctatctttgggagtgtcgagaacaaaagacagatgattgaagaactggtgctctggatcactatattcgaggataaggccatcctgaaacagaagattggagaaaagtatccaaatatcaccgagaaacaattaaaccagattgtaaagctgaactactccggctggggcaggcttagcgaaaaattgctcacaaaggaggttaatgggcggtctctgatcgacctaatgtattcaactgaaaacaattttatggagataattaccgacaaaacactgggattcgattgctttatcaagaacagtaataaagtgaagaacgctaagattagctacaaagacgtcgccgagctccgcacctcccccgcactgaagaaaggtatctggaatgccataaagatggtgagagaaatctctgatcttttcggcgctccggagaaaattatcattgaatttgcgactgaggaccaggtcaaggggaagaggcaaaaatcgcgtagcgaattgtgggatgacctggtgaagaaaaacaatttaaagcggaacaaaaagttcaagggactctttgaggagctgaaagcatatcctgatcttgacttctccaatcccaagctgtggttgtacatccaccagaacggcaaatgtatgtacacgaagaaaccaatagatctcgaacgactgatgtcagacacaaataaccagctatatgagattgatcatatcctgcctagaacctttgttaaggacgatagtatcaataacaaggtgctcgtaattcagtctgccaaccagaaaaagagcggtgacaaaatgcccctggaaatcttcgacaatcacgtccttgtgccattttggaagatgttgtacgagaacgatctgatttcctcaagcaaattatctaagctcatgaagaaagagttcaatgacctggataaggaagggttcatacaaaggcagcttgttgagactcgccagatcatttcccacgtgagtgactttctgaccgaagagtatcccagcacaaccgtcgtgcctatgaaagctaacgtagtgtctgaactacggagaaagttcgatatcccaaaaattaggcaactcaatgactggcatcacgccgttgatgcatacctgaacggctttgtctatcaggccgctcgcgtgttctacccgaaggtgaatttgtttgagttcaactttaaatgggagaaggtccgagaaaagtggcggcagctgggagagttcactgaaaataacaaaaagcgtgagtttttcttatttaaaagaatggaaaattatgttaacgagcatggcgaggggatgatctccaagctcatattcgacctggataatttcaaatttaactactcaaggaaggtggaaagtacagagagcgccttctacaagcagtcggcattttcccccaaaaatacgaccgcgcaatatgactctgataagaacaaaactgctatctacaaggaaatgaaaaataagcgcggaattgtggtaagctatacatacgtcaagaaagaccaggagcttatcggttatggcgtgttcaacgaaaccgtttttgagtacgtgaacaatgccgacgtcgatatgaacacacgggcactgaagattgtgagaaaagccttccctaagttggacatcaaaaaggctcagtatctcttttcaataaataagggggatgccctgctagttaacggacacccattcctgtttgtgagtgcaaaagagaggattaatggcaagcaacttgagttcgacatcaacatgcagcgacgcctcaaaaaggctctgcggccctacaataaaatgactgaacaggaaaaggtaggtgtctacaaccagtttgccgagaaagtggtgcaagagtatgaaaattccttgggggcgaagaccagaaacgagaagctggaattaatcaggaatcagttcaacgagtctgataaaagcaatgaagccctcattcagtgcatactggaggtccttaagatgacgaaagtttccgctgagcgttcagtgaagctgaaaatccgctggggcagccagacccctaacacattgattgacatcaataacaaggcaaagattatgtacaacagtatcactggactcaaacaaacccggctgaagtctatatataaactagccgaatccaagaatgagctgtga

SEQ ID NO: 2997 - RNA, 4035 nt, synthetic construct
  misc_feature 1..4035: note = Cas9 variant
  source 1..4035: mol_type = other RNA
atgaacaagaattactatatcggcctggacatggggaccaacagcgtgggatgggccgtcacagatcaggagtacaatctcattaaacttaagggtactcacgcttggggcgcaagaatattccaagaagccaaagacaagaaagggacgagggcgatccggtcctctcgccgacgtatggatagaaggaagtatcggattcatctgttgaaccagttatttgctcaggagatccaggccattgactcaaccttctttatccgcctggcatacagtgcctattgggaagttgataagaaagacaagggaataggcagaaatatcctattcaaaacaaagcaagaggaaagccagttttacaaaaagtatcccactatttggcacctcaggaagtccctgcttgagaaccagcctgatgctttctctgacctgcggtacgtgtacttggcatttcatcacatcatgaaatatcgcggtaatttcctccatgagggggaaattaagaccaacgagctgcaggtacaacagatcgaacagctgaatcagtttctcataaacaaatacaaggagatttatgataatgacgtggaggaacgaacattcatcgccaaccaccaaattgatgctttaaaagagatcctgcttaataagaacaccaataaaactacaaaggaaaaggagatcaaaaagttgtttgactacgccgattgcgaatcgctggagccatatatttcatgtttcagcaaactagcggtcggaggcaagtttgacctcagtaaactgggctacgaggggaacatacagttctccgacccgtctttcgaagagaaggcaagcatccttcaggatgactttagactgattgccatcgctaaggaaatgtatgatttcgtgatattgaacgacctcctgaaagatcaacccaatttatccaccgccatggttcacgtgtacgagacgcataggcaggacctgaagaaactcaaggatattatcatcgacattgatgcaaacaaaggacttcagaataacgaccggtggtactttaagctgttcaaggataaaaatgctcctaagaactattcagcctttatccacaaaaatagtaaccagaagcgtccaagcattgacgagttcaatgacgaaatcaaaaagatattgattgagcatcgcaacgatgtctctctagaaaagcaagacgatctgaaaatgctctttgagaaggtggaaaataaaactctgcttaagaccatcgcgatccagtccacatcagtaattccccaccagctgcacttggacgagctcgagaaaataatcgataacgccagcactaagtaccctttcctgagtaatattagagacaaattagttctgctatttaccttcagggtgccatattactatggtcccctcaacgataagtctccttactccaatgtcgaacggaagcagtttgcaacagtgaccccatggaacttcgacgagatctttgatgaaaacaaaacgcgagagaagttcatgaaaaagctgactaataactgcacatatcttagcggcgaaaccgtgatgccgaaaaaggctttggcctacgaggactacctgatttatgatcgcctcaatgtcctgcttgttaacggggagtacctgtcgttgcaagaaaaggagaaaatctatcattacctcatatctagacccaagactacactggaccagctgaaaaaggaattagctaaatggcacaatcagtcccctatcgatattatcttctcaaacattcatgaggaaatcccatttgaggccagtagccacgcacatctaatgaagtccttcgacctcgagaagcagaaagaggaactggaaaggtatataacccttgccacgatttacgctgacgataagaaatctttgaaggagctgctcaaaaatgaaagcctgttagacgagaaccaaaagaatgtgatcctgacccttcccacaaagaaatgggcgcctttgtcatataagctcctgcagaacattgtatacactgatgactacggagtggtccacagtatcctagatataatgaaagagaccaatcagaactttcagatggtgctgcacaatgaacaatatcatttcaaggagctcatcgaacaggagaaccagaaatttacacaagaaaagactattgaggacctgatcgaggaaaaacttgagtccattcccagcttgacccagcggtctatccgccagacactgttaataattgatgacatcatcaaggcatcacaccagaaggttccagagaaaattttcatcgaagtgaccagaaataacgatgacaagaggaaaggccaagatggtaaccagctcgcccgtgacaaggagctgaatcggtttcttactaacctgttgaaagatgaaaaggctaatcagttctgtgacgtcagtcagctcctgaaggacctagaggaagtggataaagtaaagctgaaagggaagcatatttacctctattttaaacaactgggaatagacctttacacgggcaagaagatcgttttgaaccagctgttaacaagcaccaaatatgatactgaccacattatcccgcagtccctcattaaggatgactctctggataatcttgtgctggtcgagcgagaagtgaacctaaaagtcaagggcaatcactaccctgtgccctcgagaatccaggacgagcagaaaaagctctggcatttcctgttgcaaaagaaagccataagcgagaagaaatatgggaacctgaccaggacatccaagatcaaattagaagaggttgaagattttgtggcacgccagattaatgtaatcaactactcaaatgtcattatccgggacatactcaagctgaagtacccacacaccgatattatcttcagtaaatctcaatatcctagctttatcagaaagcatcttaaaattgtgaagaacagggacgttaatgacgcccaccatgctgtggatgcctacctgaacgtcgtgtccggaaatttgctctcaactacattcagcaaagcatatatacgcaagaaatacatccagattcaggacggtgagaaggaaacgttcaacatggagaccatcctggagaactattttaagaataacgaaaatcagctaaaaattaagactaactgcctgcgacgggatgcgcttatcacattcaaagtagactacttttctggcgagttctatgggcaaacccgtctccccaagggaaatgaaaacctgataccaatcacattgaatgaggataaccccatgtccgacacttcaaaatacggcggttacaccaatctggctcaggcctatttatttgcagtgagctaccaggaagatggggagatgaagaaggccattctcagagttccttatctgtacgacacgctttataaaaacgattctgacaagctgttgtccaaagtcctcgataatccaaaggctaccaacatccagattctgaggaaaatccacctaaatcaaaagatacgcttcaacgacggcatttacctgctttatacaaatgagaaggatcggaacaaatacaagatggcctaccagaattatatcgacaacgactacctctattacctgcactgggcaaacaaacatttggaagagttactggataatcaggaaaagcagacttttatctataacagtaaaaatgaccaattcgaggtgagtaaggctaagaacaaagagatttttcagtacctcctgcagaagaccaaagccaaggtgtatgatacatgtaattacatcgtcaaagcgagagaaactaacatagagattttcgaacagcttaccctgaaggagcaaatcacgatgattaatcagtggatcaaaatgatgagcagggactgcgaaaaggttaagtttgatgcccgattcacaaacttctcgaattgtttgctacgcctgtccaacaatataaacccgaaagactctattaccatcatctacgagagccccactggactctttaagcacgaggtgaaaatttga

SEQ ID NO: 2998 - RNA, 4035 nt, synthetic construct
  misc_feature 1..4035: note = Cas9 variant
  source 1..4035: mol_type = other RNA
atgaagaaaaccaacccctacatcctgagcctcgacattggcacagcctccatagggtatgcttgcatggatcttgacttcaatatcctgaagtaccacgataaagacgcaattggagtgttgacttttgagggtgccgatacggcggctgaaagaaggggcttccggacctctcgccgacgtaagaacagaaggatcaaacggttagggctgctacaggaggtcctcgcccctctggttaagaatccaaactattaccaacttctgaatttgcataagtggaaaaactcaaatgaagactttaagcaccgcagtctcagcgaggtgctgaaaacactgggaaagaacccgaaaacttatcccaccatttaccatctccagcaggatatccagaatcaccctgaaaagaagttcgagccagagttaatatttctggcactttatcatttggtaaaatacagaggccacttcctgtttaacaatctatccttcgacaagggtaaaacagtggataacgaagcccaactctctgagctgcttgaacagtaccagtcgatcaatccctatgaggggtcaatttttaacaaggacatcaaagtcattgtggataccctgaaggacgatcagttgactaggaatgacaaaagcaaggagctcaagcggaacgttagtaaaacacacgctgaactgttcaagatgttagtgggactgaaatttaagcaatccatcctcttcgagaacatggaaaatgtcgaggacataaaagaatctgcaaccggcagcgatgccatttccctttcagacgattactatgagaacctgagtgagtttttgacggacgaacagctaaatttcatcgagagcgctaacactttctttatgggcattatgctggatcgcatcctcaagggggccacctctatctccgcggcaaaggtgcgagactacaaaattttcaagaatcagctgaaacttataaaggatatcgtatatcagaacaaatacgacaagtatcatgaatttttcgttacatcaaaggaggatatgagagcctaccaagaaaatcctgacgctaaaacttttggaaagctgagcaaattcgatcagtacttgattcacccaaaggaccagtatgccaaactcatgaaggacctgaagggtatcgtgcccaaaaagtacaccgaggtcttaaacctgatagatgagcaaaaatttctagtggtgcagaatacaaccgacaacgcaagtattccttatcagaataacgtcttcgaagctgagaatatcctcaggaaccagcaaaagtactatccagaaatcacggaggaaatgattggcaaagttatcaatctgatttcttttcggataccgtactatgtggggccccttactaacaagaacggacagtccgatttcgcctggatgatccgtaaaagcgacgagcaggcgttgccttggaattttgataaggtaattgacaagtcgaaatctgccgagaagttcatccgcagaatgacatccaaatgtacctacctgctcgaagaggatgtgctgccaaagcattcacttctgtaccaggaaatggaggtcttgaacgagctcaataacgtgcaactgaggggcgaaaatgagcccaaacaccggatccaccgattagaccctaaggttaagcagtttatttatcataacctgttccagaaaaagaaaaatgtgactcacaaggatctaataacactcctgcagaacagtgaacatcgcaatacccttaacaaaacgagcggtcaaaagttgaaggtcttcgggacccagaatgactccaaatttgcatctaagctgagcacatacaacgatatgaaagctatcttcggatcagtggagaataagagacagatgattgaagaactcgtactgtgggttactatctttgaggacaaagccattttaaagcagaagatcggcgaaaaatatccaaacataaccgagaagcaactgaatcagatcgtgaaacttaactacagtggctgggggaggttgtccgaaaagctcctgacaaaagaggtcaacggacggagcctaattgatctgatgtattctactgaaaataacttcatggagatcattaccgacaagacactcggttttgactgcttcatcaaaaattcaaacaaggtgaagaatgctaaaataagttacaaggatgtcgccgagctgcgcaccagccccgcacttaaaaagggcatttggaacgccatcaaaatggtgagagaaatttccaatttgtttggggctccggagaagatcataatcgagttcgcgactgaggaccaggttaagggaaaaaggcaaaagtctcgttcggaactgtgggatgacttagtgaaaaagaacaatctcaaacggaacaaggagtttaagggcctgttcgaggaaattaaagcatatcctgatcttgactttagcaatcccaagctgtggttgtacatccaccagaacggtaaatgtatgtacacgaagaaaccaattgatctcgagcgactgctatccgacacaaataaccagctgtatgaaatcgatcatatactccctagaaccttcgtaaaggacgattcaattaataacaaggtcctggtgatccagagtgccaaccagaaaaagtctggggacaaaatgccccttgagatctttgataatcacgttttggtgccattctggaagatgctgtacgagaacgacttaattagctcctcaaaactcagcaagctgatgaagaaagagttcaatgaccttgataaggagggctttatccaaaggcagctggtcgaaactcgccagattatatctcacgtgtccgacttcctaaccgaggaatatcccagtacaaccgtagtgcctatgaaagctaacgttgtcagcgagctccggagaaagtttgatatcccaaaaattaggcaactgaatgactggcatcacgccgtggatgcatacttgaacggattcgtgtatcaggccgctcgcgtcttttacccgaaggttaatctgttcgagtttaacttcaaatgggaaaaggtgcgagagaagtggcggcagttaggcgaatttactgagaataacaaaaagcgtgagttctttctcttcaaaagaatggaaaattatgtgaacgagcatggggaaggaatgatctctaagctgattttcgaccttgataattttaaattcaactactccaggaaggtagagtcaacagaaagtgccttttacaagcagagcgcattctcgcccaaaaatacgaccgcgcaatatgactccgataagaacaaaactgctatctacaaggagatgaaaaataagcgcggtatagtcgtgtcttatacatacgttaagaaagaccaggaactgatcggctatggggtgtttaacgagaccgtcttcgagtacgtgaacaatgccgatgttgacatgaacacacgggcattgaagattgtgagaaaagcctttcctaagctcgacatcaaaaaggtacagtatctgttcagcattaataagggagatactctactggtcaacggccacccatttcttttcgtgtcagcttacgaaaggatcaatggtaaacaactcgagtttgacatagccatgcagcgaaagattaaacaggcactgagtccctacaacaatatgaccgaacaggagaaggtggagttctataaccaatttgctgaaaaagtcatcgaggagttccgcaattccatcgggttgcagtctcgggatagaaaggttaacctgattaaaaatttattcaacaatacggaaaagagcaacgactccatgacccagtcaatactcgaagtgctgaagatgacaaaagtaagcgccgaaaggagtaaggagcttaaaatccgttggaatggccagactcctaacacctttattgatacaaagaacaatgcggaaatccaatacaaatctattactggactgaagaccacgaagccaaaatccatcttcaagttggccgagagcaaaaacgaactctga

SEQ ID NO: 2999 - RNA, 4038 nt, synthetic construct
  misc_feature 1..4038: note = Cas9 variant
  source 1..4038: mol_type = other RNA
atgaagaaaccctacagcatcggcctggacattgggaccaactccgtgggatgggccgtcgttacagatgactataaggtgcctgctaaaaagatgaaagtactcggtaatactgataagtctcacataaagaaaaaccttctgggcgcattgttattcgactcagggaatacggccgaggatagaaggctgaagcggaccgcgcgccgacgttacacaagaaggcggaaccgcatcctatatctccaggaaatttttagtgaggaaatgggaaaagtggacgatagcttctttcatagactggaggactccttccttgtcactgaagataagaggggcgagcggcacccaatctttggtaatctggaggaagaggtgaaataccatgaaaacttcccgaccatttatcacttgcgccaatacctcgctgacaatcccgagaagacagatctgcgactggtttatctcgccttagcacatatcataaagtttgggggacacttcctgatcgagggcaaatttgacaccagaaacaatgatgtgcagaggcttttccaggaatttttggccgtctacgacaacactttcgaaaattcttcgctgcaggaacaaaacgtgcaggtagaggaaattctaacagacaagatctcaaaaagcgctaagaaagatcgggttctcaagctgtttcctaatgagaaaagtaacggccgtttcgcagagttccttaagctgattgtggggaatcaggccgactttaagaaacacttcgaattggaggaaaaggctccactccagttttccaaagatatctacgaggaggagctggaggtcttactggcccaaataggagacaactatgcggaactcttcctttctgcaaagaaactgtacgatagcattttgctatccggtatcctgaccgtgacggacgtgtcaactaaggcacccctcagtgctagcatgattcagcgctataacgagcatcagatggatctggcccagcttaagcaatttatcagacagaaactgtctgacaagtacaatgaagtcttctccgatgtttcaaaagacggctatgcagggtacatcgatggaaagaccaaccaggaggctttttataaatacttgaagggcctcctgaataagattgaaggtagcgggtacttcttagacaaaatagagagggaggactttctgcggaagcaacgaacattcgataacggaagtatccctcaccagattcatctacaggaaatgcgcgccatcataagaaggcaggcggagttttatccattcctcgccgacaatcaagatcggattgagaaaatcctgacttttcgcatcccctactatgtgggccctcttgcaagaggcaagtctgacttcgcttggttgtccaggaaaagcgccgataagattaccccatggaacttcgacgaaatcgtagataaggagtcgtctgtggaggcttttattaatcgtatgacaaactacgacctgtatctcccgaatcagaaagtcctgcccaagcactcccttctgtacgaaaaattcaccgtgtataacgaattgacgaaggttaaatacaagactgagcaggggaaaacagcctttttcgatgcaaatatgaagcaggaaatatttgacggagtgttcaaggtctaccggaaagtgaccaaggataaactcatggactttctggagaaggagttcgatgaatttcgaatcgtagacttaactggtctggacaaagagaacaaggccttcaatgcttcatatggcacataccacgatctaagaaagattctcgacaaagattttctggacaacagtaagaatgagaaaatccttgaagatatcgttttgaccctgaccctcttcgaagacagggagatgattcgcaagcggctgaaaaactatagcgatttactgacgaaggagcaacttaagaaattggaaagaaggcattacacagggtggggacgcctctccgcggagctgatacacggcatccgaaacaaggaatctcggaaaactattctagactatctgatcgatgacggtaatagcaaccgtaattttatgcagctcattaacgatgacgcactgtcattcaaggaggaaatcgccaaagctcaggtgataggggagaccgataatcttaaccaggtcgtgagtgacatcgccggctcccctgcaattaagaagggaatcttgcaaagcctgaaaattgtcgacgagttagtgaagatcatgggccatcagccagaaaatatagttgtggagatggccagagaaaaccagttcacaaatcaggggaggcgcaactctcaacagcggctcaaaggactgactgattcaattaaggagtttggtagtcagatccttaaagagcaccccgtagaaaatagccaactgcagaacgacagattgttcctctactatctgcagaatggcagggatatgtacaccggggaggaactagacattgattacctgtcccagtatgacatcgatcatataatccctcaggcttttattaaggacaactctatcgataatcgagtcctcacatcgagcaaagagaaccgcggaaagtccgacgatgtgccatcaaagaacgttgtgcggaaaatgaagagttactggtctaaactgcttagcgccaagttgattacccaaagaaaattcgacaatctgactaaggcagaaaggggcggtttaacggacgatgacaaggcggggtttatcaaacgtcagctcgtcgagacacgccagataaccaagcacgtggctcggattctggatgagagattccacactgaaaccgacgagaacaataaaaagatcaggcaagtaaaaatcgtgacacttaagtccaacctggtttcaaattttcgaaaggagttcgaactatataaagtccgggaaattaacgattaccatcacgcccatgacgcatatctcaatgccgtgatcggcaaggctctgttgggagtgtacccccagctggagccggagtttgtctatggcgattaccctcacttccacgggcataaagaaaacaaggccaccgccaaaaagtttttctacagcaatattatgaacttctttaagaaagacgatgttcgcactgacaagaatggagagataatctggaaaaaggatgaacacatttctaacatcaaaaaggtgttatcctatccccaggtgaatattgtaaagaaagtcgaggaacagacaggtggcttcagtaaggagagcatcctcccaaaagggaactctgacaagctgatacctagaaaaacgaagaaattttactgggataccaagaagtatggaggcttcgactcccccatcgtggcttactcaattcttgttatcgccgacattgagaaaggtaagagtaaaaagctgaaaactgtgaaggcgttggtcggggtgacaatcatggaaaagatgacctttgagagggatccagttgccttcctcgaacggaaaggctatcgaaatgtgcaagaggagaacataattaagctgcccaaatacagcctatttaagctggaaaacggaagaaaacgccttctcgcttcggcaagggagctgcagaagggcaatgaaatcgtattgcctaaccatctggggacattactctatcacgccaagaatatccataaagtcgacgagccaaagcacctggattacgtggacaaacacaaggatgagttcaaagaacttctggacgtggtctccaacttttctaagaagtacactttggctgagggaaatctcgagaaaattaaggaactgtatgcccagaacaatggcgaagatctaaaagagctggcaagctcattcataaaccttctcacctttacggcgatcggtgccccggctaccttcaagtttttcgacaaaaatattgatcgtaagcggtacacaagtactaccgaaatcctgaacgccacattgattcatcaatccatcactgggttatatgagaccagaatagacctgtctaaactcggaggcgattga

SEQ ID NO: 3000 - RNA, 4038 nt, synthetic construct
  misc_feature 1..4038: note = Cas9 variant
  source 1..4038: mol_type = other RNA
atggagaactacaatatcggcctggacattgggaccacaagcgtgggatgggccgtcgttaacgatgctactaataaggtgatgagaaaaggtggcaaggcactctggggagtaaggcttttcgaccccgccgtgacggcggaagatcggcgcgctaaacgagggacccgtagaaggtatgaccggcgcagagagaggataaagctgttgcaggatgaatttaaagacgagatcaacaaggtcgattccaatttctttttaaagctggaagagtctaaatacacatcaaaggacattaaaaacaagactgtgctaatcagtatggaggaagagaaagccattaagaagtataatcaagaataccctaccatctatcacctccggcagaaactgatgaacagcaatgagcagatggatatacgccttgtttacctggcaatccatcacattatcaagtatcgaggcaacttcatttacgagggtaattccttttctgtgaacaatttgaacatcgacaataaactcaaggaaatattcctgtcgctgtcagaggatgtcgacgaactcgatattagcgaggaatgcatcaacaacattaattacaaacagttagccaacatctttaatgagcaaagtaagaacgacctgaaagtgaaacttacatccgagttgacctcttatagcctgaataagaacttcatctccgaattttgtaaactaattatagggaataagttctcagctaaaaagctctttaacctggagactgacaatgatgtaagtcttagcttcgacggaacagattttgaagacaaagcaggcgatctggagtctttgctcaacgactacctggaagttttagagcagctgaaggagctctatgatatggtgttccttaagaaaatcttcggcgggtccaaggaaaccacgatttcaggactgatggtcgagagatacaatcagcataaaaaggacttgaaactactgaaggatacttttagcagtgacaggaagatctataacaaaatattccggtctaagaaagatattaaggacgacaaagatatgtgcctctacgacctgtatatccacaataaacttgaaaccacagattttctgaaggagatcaaaaagtacgtgaacactgacaatttcattatcaccgatgaagactttttgaaacgtctcgagaacaacgaggtgctgccacgcattacatccaaggaaaatggtaaatacccgtatcagttaaacaaggatgagctggtcagcataatcgaacatcaaggcaaacactaccccttcctactcaataagaccgacgatgggatttataagctggttagacttttggagtttaggatcccttacttcgtgggaccactggtatcgaaagacatgtctgagaacgcctggatgctccggaatgaaggcatgcagggtgtgcacatcacgccctataactttaagaaagtcattaatctggataagactgctgagatattcatcaaacgaatgatttcccattgtacataccttctggacgaagaggccttgcctaacaattcaatcctctatagtgaatttaaggtgctgaacgagttaaagcagattaaagttaatggggagcacctgaccaaggatgaacagcataaaatcatagaggaactattcatgaagactagcggaacaatcaccgagaacaaatttcgcgagttcctcctgaatacgcttgactacaacttctacgaaaatgagttgaagattaccggctattccgcggactgcaagtttgcaaacaacatgcaatcttacatcgatttctttggcgaaaatgggattttcgagggaacaagctataacactaatgacgccgaaaagatcatagagtggattaccatctttgatgacaaggatattctgaaaagaaaggtggaaaacgagtacccagagctcaaatcaaatcaggtcaagaacatcctgaataagaaatatagtggttggggcaggttatcccggaagctgcttttggacctccgcgtgctggataaagaaacagacatacccaagagcatcatggatctaatgtacgagactgacgaaaacttcatgcagattatcaataacgataaatataattttcaaaagctgattgctaaagagaacaagatcgagaatacctctaacgacctctcatacgatgtagttgaaaatctggccacaagtcctgcaaccaagagagggatataccaggctcttaaagtggtcaaggagattactacgtatatgggatacgaaccgaaaaacatcatggtggagatggccaggggcgacgaaaagaaaatccgtaaggacgatcggaagaaatatttgcagaagctgtacgacaacattaaagatgaggtcgacagcaattataagaacttaaagaaggagctcgcgaaggaagagaaaatcgatacagacaagctgtacctttattacctgcaggaaggtaaatgtttgtactgcgggaagccgattaatgtggatgacctcaacaccaaaaattccctgtatgagatagatcacatcctaccccgaactctgattaaggacaactcttgggataatagagttctcgtgtgtaggggctgcaaccaaaagaaagccgcatcgctggtacttcctaaggagttccgcaatgactacaccaaaagcatctggattcggttgaagaacaataaactgatgtccaacaagaagttttataatttaacaagaaaatcatacagtgaagaggacatcaagggattcataaacaggcagctcgtcgaaacccgccagatcactaaacacgtggctaatattctgaactgtttttatccaaagacaaaaatcgtttaccttaaggccaatatttctcatagctatcgagataaatacgacctgttcaagtttcgggatatcaacgactaccaccatgctcacgatgcctatctagcagccacgctcggctcctaccaggagaagtatctgcattacgacttggattataacaaaataaatgagttcaacgaaaagctgattaaaaatgaagactacaagcgtttacactatgggatcgtggtcaactcactcgatgaggagttccaaagcgcttttgcggaaatcgcacccagactgattaatgaggaaaccggagagcttctgttcaacgccaaaaagtttaatgacttggtggaggatactctctacaggaacgacatactgatctctcgcaagacagaaattcggaccggtaaactatacaaggagacaatctataaaagaggcaaggggaatattaaaatcaaggaaaacatgcctactgagacctacggaggctattccaatatggaaacgagttacctgacccttgtaaagtatggtaacaaaacaaagctcatagggatcccaatgagcattgctaataacaaagatgtgaaggttaaactggacttcatcaaggagcacttggacctgaagtctttagataatattgtcatcctcaaagacaacataccctacgatgtgtccattaactataagaatcaggacgtgtacgtcaaaggctactcaactgccaacaagaattgcgagctgagtaacgcacatcagcttaaaatcaagaaagatatgatgaagaagtgtaaatatgttctgaataaggtgtacaaaaacaagtatgacgatatcaccaatatggacattgaaaacgccatcacatttataaattacttgttcgagattaaaatcgaatttccactcttcagcaaggagattactaagatccaggataacataaatctgaccgaatgctcgtttgagcaactagctaacattatcaaacagctgcttatcatttatcactgcaattccaagaacggaaatctcaaagagttcggcctgtctgacaggatcgggcgattgagcggagccaacgtgacgggtggcgattttattttcacatcagtaaccgggttaaaggagaaaactgcaagttacgacggagaatga

SEQ ID NO: 3001 - RNA, 4038 nt, synthetic construct
  misc_feature 1..4038: note = Cas9 variant
  source 1..4038: mol_type = other RNA
atggtggagaagtacggcatcgggctggacattggaaccagcacactcggttggacttccgtcgatgaaaacggcaaaatacagagacttaaggggcaaacggccctgggaaccaggttgttcaatgagggccagacagctgaagaacggcgcggttttcgaactacccgtagaaggatccagcggcgcagatggaggttacggctgctacgcgaaattttcgacgagcccatcgggtctgttgatgcaggatttttcgcccgacagaaaatgtcaagtctcagccctcaagacgatagatttgaggacacatataggctgttcaacaatcagaccgataaggcgtttcacgacgaatacccaactacatatcatcttcggcaggctctgatgaactccgatcgtcagttcgacattcgcgagatctacttggccatacaccatatcgtgaaatatagaggcaattttctcaggtctggcaagccggcagatttcaagaccgggaaactggacctgaaggaaaaatttgaggagattaacgccgattggcaaacgctcatctcggaagacgctccccagttacctgtagacgatctgactaccattaaggcagtgcttgtcgacggatcacggagccgaagtgatcgccagagaggtttggtgaaactgtggatggccaatgagacagttgaaaagaactggaagccagtgatgactgagctagctaaagccatcctcggcctgaagaccaaactttacctgttgacagggctcgacctgcccaaggaagatcagaaagcgtggaccttctccttagacacgctggaggatcaccaaggagacatagatagctttttcgacgatcatgcacagcagctcattgacaggcttgccgagctgcgggctatgatccaattgactgaaattatcccttctggcctaaatttctcccagtcaatggtccagcgctatgaggcccacagaagtcacctggaaatgtacaagcagtacgcactcgaccaaacagatccaaaaaggaccaaggctctgcgtgccgcgtataacgcctacatcgaccagcatgagattgcagatgacttttatactgctgtgaagcgggtaacaaaagatgaccagagcgaaaccgccgaggagataaatcgacttatcggtctggaacagttcatgcccaagcaaagaacgaaagagaacggggttattccttaccaggtgcaccagcaggaattggatcaaatcatagctcatcagaagaaatattacccatttctcggaaccgagaatccggtcattgaccacagggaatctcagccctatatgctggatgagttagtgtccttccgcgtgccttactacgtcggcccaatggttgccgcaaaccccgagctgaagacaactgaaaatccttttgcctggatgatccggaaggctcagggcgagatcaccccatggaacttcgacgaaaaagtggatagaaaggggtcagcgacagcatttattgagaggatgaaaactaccgacacatatctactcggagaggatgtactgccccaacagagccttttgtaccagcgcttcatggtgctgaacgaactcaataacatccgaattgacgacgagctgcttaccactaatcaaaagcagtgggtctttgatcgggtgttcaaaggtaagggcacgataagtgccaagcacttgcaggacgctttgaaacatcacggggaaacagatggactcccgaagatctctggcctggccgaccctaccaaatttaactccgcattaactagctatcgtgatttccagaagtggctgcccaatgacattgatagaaaagacaggaccgccgatatcgagacaatcattaactggtcgaccgtttttgaagacactcatatattcgtggagaagctaaaggagatcgaatggctcacagctgatcaacgccggagaattgcctctaataggtaccgaggttgggggcgcctgtccaaacaccttttgacggagatcaaggacgaacagggcctgtcaattatggatcagctctggcggacccagcataacttcatgcaaatcgtccacgagccagactatgcaaaacagatagaagcggctaatactgtgggaatggccaagcaggacatcggcacagtaattaacgatctgtacaccagtcctcagaataaaaaggcaatcagacaagttttagccgtggtcaaagacattcagaacgctcaccatggggtggcccccagctggatctttatggaggcagctaggggagccgatcagaatccacaacgttcccgccagcggcagagacagctgcaagacctttatgcgaagacagccgctgatttggtcgacactgaggtgcagcaggaactcaccgataagataaaagacaaggcaaacttcacggataggctgatgctatactttctgcagaatggtcaagacatgtactctaaagagaagctcaacattgatcgactgagcgaatatgacatcgaccacattcttccccaggccttgatcaaagatgactcactggataaccgggttttagtgcatcagagtataaatcgcaacaagtccgacaccttcgctagcgagaagtacggcgccaaaatgcagggggcatggcaccaatggagagcggccggactcatctctgctaggaagctgcggaatcttgaaatgcgacctgatgagatttcaaaatatgccacaggctttatcagacgccagctggtagagactaggcaggtcattaagttggtgaccgaaatcctcagtcaccagtacaacccagaggaaacaaaactggttagcgtgaaggcaggtctatcccatgagctgcgtcgggaggctgggctcccgaagctgagagaccttaatgattatcaccatgccatagacgcatacttggccgctaggattggcacttatctgttaaaacgctacccccgactcgaaagattctttgtctacggacaattccagacctctcggctggatcttaggcgctttaacttcatccacgacctggtgaagtcgaaacagggcgtaatcgtggatagcgacacgggggagattctatgggatcgtcaaaaggacatcgactatattaaacatctcatgggactgaagcacttgctggttacacacgaagtctacgattccgcggccgagatgtatgcacagaccatatttaaggcttcagacaatgatagtaaagtgttaatccctactaagaacgacagaccaacagccatttacggtggctataccaaacggaggaatgggtacctcgccatcctgaagattactgagaaaaaggctgagacctatcgcgtggtcggagttcccacactttacatgtctcagctggcaacggcccgaagccattccgtggaggcggaaaaagctctgctcaagtcactgatggcccctgagatcctaagcgaatctaaggtggtatccttcgaggtcgtggttagtcacgtgcatctgaaccagcttgtcagagataccgtgtttggcccagcacactacttcggtctcgggcccttccggtatgttaggaattttcatcaactggtgttgccgttcaaagaccaggaaatactggtaaagcgcactcctacagatgaggagttaaacaccgtctttgaagacatctgctggcaagtggagaattacttcgccgtgtttgatattaacggcttcagaaatgctctcaaaaagagcatcgacaaatttgaacagctgccaattgagaacgtcttcaaggataagaaacttgttacacagggaaagaaagaagtgctggcatttgtaatgcagggcttgcacgccaacgcgtcttataggaatctcaaggtgtccctggggatcaaaactcccctaggacagctgcagcttaccaagttcatgctctcacgggacgctgagctgatagatgagagtcctacgggcttgtttcgtcgcattcgaagattaaaggacctgtga

SEQ ID NO: 3002 - RNA, 4038 nt, synthetic construct
  misc_feature 1..4038: note = Cas9 variant
  source 1..4038: mol_type = other RNA
atgggcaacaagctgagaaatgtggacgattactatctcgggcttgacatcggaaccgagagcgtcggttgggccgttacagataaatactatgtgattcccaagttcaaaggcaacgctatgtggggagtacacctgtttgacgaaggggagacttccgtgaagaggcggggcttccgctctgcacgacgtagaacgcagaggaaacgggaacgcttggccttactggaggcgctatttgatgaagagatatgcaagaaggactgtaccttctttagaaggctccatgagtcagatctgtggcctgaagacaaaagtggtgatgacaagtacgctgtcttcgccgatgagaattatacagacaaagattttcacaaggaatacccaactatctatcatcttcggtacgagctgattaaaaacaaggagccgcacgacgtgaagttggttttcctcgcactgcatcacatcattaaaaatcgcgggcactttctgttcgacagcctctcctctgccgaagattttaactcggcttacgagaccatgtgctcatatttaagcgacaatgaaatccaactgaactgtagtgatatagagcagttcaaggcaatccttaaagaccgaagacagggaaagattgaaaagacaaagaatttggcctccctgtttggcatcaccaaaaagtctgatcccgtgagctacgctgtcatggccgtgctatccggctcaactgtaaagatgtgcgacctcttcggggatgacgagctgaaaacagttgagaagaacaatattagtttcgcgagcggatatgaagagaacgaagagatctacgcatctgtgcttggtgataggtttgaactggtcaaaatattgaaggccgtgtatgactgggctgtgctcgccgatattctggacggcaaaaagtacatctccgaggcaaaggtcgctgtttatgagaaacataagaatgacttaaaaaccctgaagaaatacgtgaagacgtacctccctgaaaagtataacgagattttcaaaatctcagatgggaagaaagacaattacgtagcctatagcggacacatcaaggaaagtggcaaaactggtgagcttaagaagacctgtaactctgaaaacttttgcgcgtacctgaaaaagacattggggaaaaatgccgatctatcctataaggagatgttcgacgagattgaaaacaaaacttttatgccaaaacaggtgaccaaaagcaatggagtcgtgcccatgcaagttaacgaggaagaactgaaggcaatactcgataatgctaaggactacctgtcgttccttaactcttgtgatgagaatggcgtgtccgtctatgacaaaatcattaagatctttgaataccggataccttactatgtgggcccactgaacacacataccgaaaattcatggttgaaacgtaaggatggggtaaaaatttacccctggaacttcgacgatgttgtggacatcgatagtagcgccgaaaagtttatcaataacctcacgtccaagtgcacttatctgcctgagtgtgacgtcattccaaaatgctctttactgtacagcaagttcacagtgctaaatgaaatcaacaatctcaaactgaacggagaggacattccggtcgagcttaagcagggtatatataaagatttgtttatgacccgcagaaaggtgactgttaagcagatcaaagactacctgaaggctaggggctgttatgataacaatgacgtgctctcagggattgatacaaccgtaaaaagttcccttaagagctacttcgactttaaaggattcgaatctctgacgttcgatgacaaggagtcaatcatcgccagtagcgtcatttttggcgatgacaagaaactgttgaagaaacggctcaagaaactgttccccgaaaagttaaccgatgaggacataaagaagatctgcaagctgaaatacacaggttggtcccgactatctaaggaatttctctgcgatgtggagttcacttataaaaagaccggggaggttatgaacgtgattacagcactgtgggaaactaattacaaccttatgcagatcttgtattcggaggacttttgttgcgacggcgatgagaaaaagaatctgaacgacaagctcgatgagctgagctacaccggagaccaacactccttacgcaaagccgtcgatgctctgtatgtgtcacctaaggtaaaaagaccaattcttagggcgttgctcatcgcaaaggaaatagagaaaatccaggagcggccccctaagaagattttcgtggaagttgcccgcggcatcgacaatagagaggaaaggcaccgtgatagtcggaaaaaccgactgatggagctatacaagaattgtaaaaaggaggctgaaaaattttgcccatatttcgacgccctgtctaagaagctcagcgatgaggacgaatccaaactgagaagggataaactttacttttactatattcagttggggaaatgtatgtacacaggagaggaaatctcactgggtgagttaatgaacggcaatgggcgcttcgacatagaccatatttatccccggagcaagatcaaagatgactctctcaccaacaaggtcctggtgaataagactgtgaacaataacaaaacgaacgtctacccgattgatgcagccatccagtccaagatgagtccttattggcaaatgcttagaagctctggactgatatccgaggaaacatacaaaaggttgacccgcaagactcccctcaccgacgatgagctgtcagcttttgttagtcgacagctaacagaaacccagcaaagcactaaagccgtggcacacatcctggagcagctctatccaaagcctaaaacagaaattgtgtacgtaaaggcggctctggtccatgccttccggcagtcgaatgacatgcttaagtgccgtgaggtgaacgatttgcaccatgcaaaagacgcctacctgaatatcgttgtgggcaacgcttataatgtcaaggtgacgcacaacaaagttaattttattaagggtttacagaacaatgataaagggtacaccgtgaaccccgagaagttcttctcccacgacatcccaggcgcctggtctgtaaaggatagcatgaatactgtcagaaggtttatgaacaaaaataacatacgctatacacggttccccagaaagaaacaaggaggcctctttaagattaatcctctgaaaaaggggaacggacaggtgccacttaaggcatcaggtgctaggagttgtatcgaaaaatacggcgggtatgacaaggccacctccgcgtacttctcttatgtggagtacacagataaaaagggaaaagccgtccgacagatgtttccggttaacctgtacgaagtgaaggagtatgaagctgacatgcagggcttcgtaactagccgcatcgcagaggcctccaatgtgaagattctaatcccctgcgtcaaatacgacgcttgtatttcatttgatggttgccggatgttcataaccaagaaaacggggaacagaatcggctataagcctggaatgcaactcgtgctgggctacaaatatgagaagtacattaggaatatcgaaaactatttgaccaaacataaggaccgtgagattatcccacgcgataatataagcgccgaagagaacatcgagctgtacgacattttaacagggaagatgctcaatactgttctgagtgtgaaattttctggaatcggcaagaaacttgaaaagcggagagagaaattcgtcctgtgttcccccgaggagcagtgctgcgtgttgaacgaaattctcaagatcctgcacgcaaatgttctaagcggtgatctgtcgcttataggggagtcacctaacaccggaacaatgaagactaatgcgaaattttctgagattaaggacgtgcatagtatcaaactcatcaaccagtccgtcaccggcctgttcgaacaggagattgatttgctgaagtga

SEQ ID NO: 3003 - RNA, 4038 nt, synthetic construct
  misc_feature 1..4038: note = Cas9 variant
  source 1..4038: mol_type = other RNA
atgggcaagccctacagcatcgggctggacattggaaccaactccgtgggttgggccgtcgttacagatgactataaagtgcctgctaagaaaatgaaggtactcggcaatactgataaacagtctataaagaagaaccttctgggggcattgttattcgactcaggagagacggccgaagcgaccagactgaaaaggacagctcggcgccgatacactcgtagaaagaataggctacggtatctccaagagatctttaccggcgaaatgaacaaagtggatgagaatttctttcagcgcctggacgatagtttccttgtcgacgaagataagagaggtgagcaccatccaatttttgggaacatcgccgcagaggtgaaataccacgacgatttcccgacaatttatcatctgaggcggcacttggccgacaccagcaagaaggctgatctccgcctggtttacctggcactcgcccatatgatcaaatttcgaggacacttcttatatgaaggcgacctgaaggctgagaatactgacgtgcaggccctttttaaagatttcgtcgaagagtacgacaagacaatagaggaatcccacttgtctgagatcaccgtggatgcgctgtcgattctaacggaaaaagtatcaaagagcagtagactcgagaacctgatcgcacattaccccactgaaaagaaaaataccctttttggcaacctgattgccttgtccctcgacctgcaccctaatttcaagacaaactttcagttatctgaggatgctaaactgcaattcagcaaggacacttatgaggaagatctcgaggggttccttggagaagttggtgacgagtacgccgatctgtttgcatccgctaaaaatttgtatgacgccatcctactgtcaggcatactcaccgtggatgacaacagtacaaaggcgccactgagcgcctctatggtcaaaaggtacgaagaacatcagaaggaccttaagaaactgaaggatttcattaaagtgaatgcacccgaccagtataacgctatctttaaggataaaaacaagaaggggtacgcctcctatattgagtcaggagtgaaacaggacgaattttacaagtacttgaaaggcatcctcctgaagatcaatggtagcggggatttcttagacaaaattgatcgggaggacttcctgcgtaagcaacgcacctttgataacggaagtatacctcaccagatccacctacaggaaatgcatgctattctcagaaggcagggcgagcactatccattcctgaaggaaaatcaagacaaaatcgagaagatacttacgtttcggattccctactatgtcggccctttggcccgaaaagggtctcgcttcgcatgggccgagtacaaggctgatgaaaagatcactccatggaactttgacgatatcctggacaaagagaaatccgcggaaaagttcattacaagaatgaccctcaatgacctgtatcttccggaggagaaggttctgcccaaacatagccctttgtacgaagcatttactgtgtataacgagctcacaaaggtaaaatacgtgaatgaacagggagaggccaagttcttcgataccaacatgaaacaggaaatctttgaccacgtcttcaaggagaataggaaggtgacgaaagataagctgttaaactacctgaataaagagtttgaagagttccggattgttaacctaaccggtctcgacaaggaaaataaggcttttaactcgtctctgggcacatatcatgatcttcgcaaaatattggacaagtccttcctggatgacaaagccaatgagaagactatcgaagatattatccaaaccctcacactgtttgaggacagagagatgatcaggcagcgtttacagaaatactcagatattttcactaaggcacagctgaaaaagttggaacggcgacactataccgggtggggaagacttagttacaagctcataaacggcatcaggaacaaagagaataagaaaacaattctggactatctaatcgatgacggttacgccaaccgcaattttatgcaactgattaacgacgatgctctcagcttcaaggaagagatcgcccgggcacagataatcgacgatgtggacgatattgcgaatgtcgtgcacgacctgccagggtcccccgctatcaaaaagggcattcttcagtctgtaaaaatcgttgatgaattggtgaaggtcatgggacataaccctgccaatataattatcgagatggcaagagagaaccagaccactgacaagggcaggcgcaatagccaacagcgactgaaattactccaggattcactgaagaaccttgacaatccagtgaacattaaaaatgtcgaaaaccagcaactgcagaatgatcggttgtttctctattacatccagaacgggaaggacatgtacacgggagagacactggacataaacaatctaagtcagtatgatatcgaccacattatcccccaagccttcattaaagataactccctggacaatcgtgtgctcaccagaagcgataagaacaggggtaagtctgacgatgttccgtcaatcgaagtggtacatgagatgaaaagtttttggagcaagctgctttccgtcaaattgataactcagcgcaagttcgacaatctgaccaaagctgagcggggcgggttaacagaagaggataaggccggattcattaagagacagctcgtggaaaccaggcaaatcactaaacacgttgcacagatcctggacgagcgatttaacacagagttcgatggcaataagcgccggattagaaacgtgaaaatcattacgcttaagtctaatctggtctcgaactttaggaaagagttcgagctatacaaggtgcgtgaaataaatgactatcaccatgctcacgatgcctacctcaacgcggtagtgggtaatgccctgttgctgaagtatcctcagttagagcccgaatttgtttacggggagtatccaaaatacaacagctaccgctcccggaagtcagctaccgaaaaattcctcttttatagtaatatcctgagattctttaagaaagaggacattcagactaacgaggacggcgaaatcgcatggaacaaggagaagcatattaaaatccttaggaaggtcctgtcttaccctcaagtgaatatagtgaaaaagacagaggaacagaccggaggcttcagcaaagaatccatcttgcccaagggggagtcagataaactcattccacgaaagacaaagaacagctattgggaccccaaaaagtacggaggttttgattctcctgtcgttgcctattccatcctggtgttcgctgacgtggagaaaggcaagagtaaaaagctacggaaggtacaggatatggtcgggattactatcatggaaaagaaacgcttcgagaaaaatccagtggactttctggaacagagaggatacaggaacgttcggcttgagaagataattaaactcccgaagtatagcctgttcgagttggaaaataagcgaagacgcctgttagcctctgcaaaagagctccaaaagggcaacgaactggtgatcccccagaggtttaccacgcttctgtaccactcctaccgtatcgagaaagattatgaacctgagcatcgggagtacgtcgaaaagcacaaagacgagttcaaggaattgctcgagtatatttcagtgtttagtagaaagtacgttctggcggataataacctaaccaaaatagaaatgctgttcagcaagaataaagacgccgaggtgtcgtcccttgctaagtcttttatcagcctcctgacattcactgcctttggtgcaccagctgccttcaactttttcggggagaatattgataggaaacgctatacctcagtaacagaatgcttgaacgcaactttaatccaccagagtattaccggcctgtacgagacgcgaatcgacctctccaagctgggagaagattga

SEQ ID NO: 3004 - RNA, 4038 nt, synthetic construct
  misc_feature 1..4038: note = Cas9 variant
  source 1..4038: mol_type = other RNA
atggaccagaagtacagcatcggcctggatattgggaccaactccgtgggatgggccgtcgttacagacgattataaagtgcccgctaagaaaatgaaggtactcggtaatactgacaaacaatctataaagaagaaccttctgggcgcattgttattcgattcaggggagacggccgaagcgaccagactgaaaaggacagctcggcgccgatacactcgtagaaggaatcggctacgctatctccaggagatctttgccgaagagatgaacaaggtggacgaaaatttctttcagagactggatgacagtttccttgtcgatgaggacaaaaggggagagcggcaccctatttttggcaacatcgcagccgaagtgaagtaccatgatgacttcccaaccatttatcaccttcgcaaacatttggctgatatcagccagaaggcagacctccgactggtttacctggccctcgctcacatgataaagtttagaggtcatttcttaatcgaggggcaactgaaagccgaaaatacaaacgtgcaggcgctttttaaggacttcgtcgaggtgtatgataaaaccgtagaggaatcccacttgtctgagatgactgttgacgcactgtcgattctaacagaaaaggtgtcaaaaagcaggcggctcgagaatctgatcgcccactacccggctgaaaagaaaaacaccctttttggaaatctgattgccttgagtctcggcctgcagcccaacttcaagacgaattttcagttatccgaggatgcaaagctgcaattctctaaagacacttacgaggaagatctcgagggccttctgggggaaatcggagacgagtatgctgatttgttcgccagcgcgaagaacctatacgacgccatactgctctccggtattctgaccgtcgatgacaattcaacaaaagcacctcttagtgctagcatggtgaagcgttatgaagaacatcagaaagatctgaagaagttgaaagactttatcaaggtgaacgccccagaccagtacaacgctattttcaaagataagaataaaaagggctatgccgggtacatcgagaacggagtcaagcaggacgaattttataaatacctcaagggcatcctgttacaaattaatggttctggggatttcctggacaaaatagatcgcgaggactttctaagaaagcagaggactttcgataacggatccatcccccaccagattcatctccaagaaatgcacgcaatcctgcggcgacaggaggaacactacccttttcttaaagagaatcaggacaagatagagaagattttgaccttccgcatcccatattacgttggccccctggccagaaaaggctcaaggtttgcttgggcggaatataaggcagatgagaaaatcacaccttggaacttcgacgatattctcgacaaggagaaaagcgccgagaagtttatcacccggatgacgctgaatgatctttacctgccagaggaaaaagtgttgccgaagcatagtctcctgtatgagactttcacagtatacaacgaattaaccaaggtgaaatatgtcaatgagcagggggaagctaagtttttcgacgccaacatgaaacaagagattttcgaccacgtgtttaaggagaatcgcaaagttactaaggataagctgctaaactacctcaataaagagttcgaagaatttagaatagtgaacctgacaggacttgacaaggagaataaagcattcaactcttccttgggtacctaccatgatctgaggaagatcctcgacaagagctttctggatgacaaagccaacgaaaagacgattgaggatatcatccagaccttaacactgttcgaggaccgtgaaatgattcggcagcgacttcagaaatattcggatatatttactaaggctcaattgaaaaagctcgagagaaggcactacaccggctgggggcgcctgtcttataaactaatcaatggcattcggaacaaggaaaataagaaaacaatcctggactacctcattgatgacggatatgccaacagaaatttcatgcagctgatcaacgatgacgcactttcctttaaggaggaaatagcgagggctcagatcattggtgacgtcgatgacatcgccaatgtggtacatgatttgcccgggagccctgcaattaaaaagggcatcctgcagagtgttaaaatagtggacgagttagtcaaggtgatgggacacaacccagccaatattatcattgagatggctcgcgaaaaccaaatgactgataaaggccgacggaatagccagcagcgtctcaagctgcttcaggactccctgaagaacttggataatcccgtcaacatcaaaaatgtggagaaccaacagctccagaacgacagactgttcctatactatatacaaaatgggaaggatatgtacaccggagaaacactggacatcaacaatctctctcagtacgatattgaccacatcattcctcaggcctttatcaaagacaacagcctggataatagggttcttacccgctcagacaagaaccggggtaaaagtgatgacgtgccatccatagaggtagtccatgagatgaagtcattctggtctaagttgctgtcagtgaaattaattactcagagaaagtttgataatctcacgaaagcagaaaggggcgggctgacagaggaagacaaggctggattcatcaaacgacaacttgttgagacccgccagatcactaagcacgtggcccagattctggatgaacggttcaacaccgagtttgacggcaataagagaaggatccgtaacgtcaaaattataacactaaagagtaatctcgtgagcaacttccgcaaagagtttgaactgtataaggtacgggagatcaatgattaccatcacgcgcacgacgcctatttgaacgctgtggttggtaatgcactgttactcaaatacccccagctggaaccggagttcgtctatggggaataccctaagtataactcctacagatctaggaagtcggccaccgagaaatttcttttctacagcaacattctgcgatttttcaagaaagaggatatccaaactaatgaagacggcgagattgcttggaacaaggaaaaacatatcaagatattgcggaaggtgctctcctatccccaggtgaatatcgtcaaaaagacagaggaacagacgggaggcttttcaaaagagagtattctgccaaagggggagtctgataaactaatccctcgcaagaccaaaaacagctactggaatcccaagaagtatggaggtttcgactccccagttgtggcctactcaattctggtgtttgcagacgtagaaaaaggcaagagcaaaaagctgagaaaagtccaggatatggtggggatcactataatggagaagaagaggttcgaaaaacaccccgttgacttcctcgagcaacggggatatcgaaacgtgagactggagaagattatcaaattgcctaagtactctctgtttgaattagagaataaacgcaggcgtctcctggcgtccgcccgggaacttcagaagggcaacgagctggtcatcccacagagattcacaaccttgctctatcatagttaccaaattgaaaagaattacgagccggagcacagggaatatgtggagaaacataaggatgaatttaaagagctgctagaatacataagcgttttctctcgcaagtatgtgctggctgacaacaatcttacaaaaatcgagatgctcttttccaagaacaaggatgccgaggtatcaagtctggcaaagagcttcatttcgttgttaacttttaccgctttcggtgcccccgcagcctttaatttctttggggaaaacatcgaccgaaaaagatacacgtccgtcaccgagtgcctgaatgctacactcattcaccagtctatcactggcctgtatgaaacccggatagatcttagcaaactgggagaggactga

SEQ ID NO: 3005 - RNA, 4038 nt, synthetic construct
  misc_feature 1..4038: note = Cas9 variant
  source 1..4038: mol_type = other RNA
atgaagaaagagtacagcatcggcctggacattgggaccaactccgtgggatgggccgtcataacagatgactataaggttcccgctaaaaagatgaaagtgctcggtaatactgataagcagtctatcaagaaaaaccttctgggcgcattgttattcgactcaggggaaacggccgaggcgaccagactgaagaggacagctcggcgccgatacactcgtagaaagaataggctacggtatctccaagaaatttttaccgaggaaatgaacaaggtagatgagaatttctttcagcgcctggacgatagtttccttgtggaggaagacaaacagggaagcaagtaccctatctttggcacactgaaggaggaaaaagagtatcacaagaaattcaagaccatttaccatttgagagaggaactcgccaactccaaagagaaggcagatctgaggctggtctatctcgccttagctcacatgatcaaatttcggggtcatttcctgtacgaaggggaccttaaggcagagaatactgatgtgcaggccttgtttaaggacttcgttgaagagtacgataaaacaatagaggaatctcacctgtcggagatcaccgtggacgctctatcaattctcacggaaaaggtcagcaaaagttcccgcctggagaaccttatcgcccattatccaactgaaaagaaaaataccctgtttggaaacttgattgcgctctctctgggcttacaaccgaatttcaagacaaactttcagctgagcgaggacgcaaagctccagttctccaaagatacttacgaggaagaccttgaggaactgttgggcgagatcggggatgaatatgccgacctattcgcttcagccaagaatctgtacgatgcaatactcctgagtggtattcttgctgtggacgataacaccacaaaagcgcccctgagcgcctctatggtaaagcgatatgaggagcaccagaaagacttgaagaagctcaaagattttatcaaggttaatgcccctgaccaatacaacgcaattttcaaagataagaacaaaaagggatatgctggctacatcgaatccggggtggagcaggacgaattttacaagtatctgaaaggaatcttactgaagattaatggctcaggtgacttcctagataaaatagactgcgaggattttctcagaaagcagaggaccttcgacaacgggagcatcccacaccagattcatctgcaagagatgcacgccatccttcggcgtcagggagaacattacccctttttgaaagagaatcaggataagatagagaaaattctgacgttccgcatcccttattacgtcggcccactcgctagaaagggcagtaggtttgcctgggcagaatataaggccgacgagaaaatcactccctggaacttcgatgacattctggataaggaaaaatctgctgagaagtttatcacacggatgacccttaatgacctgtacttgcctgaagagaaagtgctcccaaagcactccccgctgtatgaaactttcacagtgtacaacgagttaaccaaggtcaaatacgttaatgaacaaggggaggcgaagtttttcgatacgaacatgaaacaggagattttcgaccacgtgtttaaggaaaatcgaaaagtaaccaaggataagctgctaaactatctcaataaagagttcgaagagtttcgcatagtgaacctgacaggacttgacaaggaaaataaagcattcaacagctcgttgggtacttaccatgacctgagaaagatcctcgataaatcttttctggacgataaggccaatgagaagaccattgaggacatcatccagacattaactctgttcgaagatagggagatgattcggcagcgccttcaaaaatattccgacatatttaccaaggctcagttgaaaaagctcgaaagaaggcactacacaggctgggggcgtctgtcatataaactaatcaacggcattcggaacaaggagaataaaaagaccatcctggattacctcattgacgatggatatgccaaccgaaatttcatgcagctgatcaacgacgatgcacttagttttaaggaggaaatagccagagctcagatcattggtgacgtcgatgacatcgccaatgtggttcatgacttgcccgggagccctgcaattaaaaagggcatcctgcaatccgtgaaaatagtcgatgagttagtgaaggtaatgggacacaacccagcgaatattatcattgaaatggctagggagaaccagactacggacaaaggccgccgtaattctcagcagagactcaagctgcttcaagatagcctgaagaacttggacaatcccgttaacatcaaaaatgtggaaaaccagcagctccagaatgataggctgttcctatactacatacaaaacgggaaggacatgtatacaggagagaccctggatatcaacaatctctcacagtacgacattgatcatatcattcctcaggcctttatcaaagacaacagtctggataatcgcgtccttactcgatccgacaagaaccggggtaaaagcgacgatgtgccatctatagaggtcgtgcacgaaatgaagtcattctggagtaagttgctgagcgttaaattaattacccaacgtaagtttgacaatctcacaaaagcagagagaggcgggctgaccgaagaggataaggccggattcatcaaaaggcagcttgtggaaactcgccagatcacaaagcacgtagctcagattctggacgagcggttcaacacggagtttgatggcgcccaaagaaggatccgaaatgtcaagattataaccctaaaatccaacctcgtgtctaatttccgcaaggaatttgagctgtataaagttcgggaaatcaacgactaccatcacgcacatgatgcttatttgaatgccgtggtcggtaacgcgctgttactcaagtacccccagctggagccggagttcgtgtatggggaataccctaaatacaattcgtatagaagcaggaagtccgccactgagaagtttcttttctactcaaacattctgcggtttttcaaaaaggaagacatccagacaaatgaggatggcgaaattgcttggaacaaagagaagcacatcaaaatattgcgcaaggtactcagttatccccaggtgaacatcgttaaaaagaccgaggaacaaacaggaggcttttctaaggagagcattctgccaaaaggggaatccgacaagctaatccctcggaaaactaaaaattcatactggaaccccaaaaagtatggaggtttcgatagcccagtcgtggcatactctattctggtgtttgccgacgtcgagaagggcaaatccaagaaacttagaaaggttcaggatatggtggggatcaccataatggagaaaaagaggttcgaaaagaatcccgtggacttcctcgagcagcgaggatatcggaacgtacgcctggagaaaattatcaagttgcctaaatacagtctgtttgaattagaaaataagagaaggcggctcctggctagcgcccgagagcttcagaaaggcaacgaactggtcatcccacaaagattcacgaccttgctctaccactcttatcagattgagaagaattacgagccggaacatcgcgagtatgtggaaaagcacaaagacgagtttaaggaactgctagagtacatatccgttttctcaaggaaatatgtgctggcagataacaatcttacaaagatcgagatgctctttagtaaaaacaaggacgcggaagtcagctcgctggccaaatccttcatttctttgttaacttttaccgctttcggtgcccccgcagcttttaatttctttggggagaacatcgatcgtaagcggtacacaagcgtgactgaatgtctgaatgccaccctcattcatcagtcaatcacgggcctgtatgagacaagaatagaccttagtaagctgggagaggattga

SEQ ID NO: 3006 - RNA, 4041 nt, synthetic construct
  misc_feature 1..4041: note = Cas9 variant
  source 1..4041: mol_type = other RNA
atgaaccagaccaagaattacgacatcggcctggatattggggtgggaagcgtcggttggacaataactgactcccaatctcagaaagttctcaaggtgaaaggcaagcaggggatcggagtacaccttttcaacgagggccagacggccgaagagagaaggcaatttcggaccaatcgccgacgtctgaaaagaaggaagtggcggttgcgcttactgagagaactattcgatgagcccatttcaagtatcgaccctgaatttttcgctaggctcaagtattttaacgagagctccaaagatccaaagaataaaggttaccagccgcagctgcatgacgatcttaaggacgtggatttctatcggcagtaccccacaatttatcatctgcgccacgcattgatgactcaaaaagagaagtttgacatccgagatatatacctcgccatccaccatattgtcaagtatagagggcacttcctgatgaacggacactcttcgtcatttagcgtggcgcagaccgactggaaagctgatctgacaaaactcttcgaattaatccaggagaccaggactaatctggactttagtttcgaccttacagaaattgataccatcaaatccttgctgtttgacaagaacctatctcggaatgatcgtcagaaagagatagttggcctcattaacaataacagccaactggacaagaaagataaggcccttacgaagcagctggtggagtccgtcgtgaaaggcatcgtagggatgaagactcgcaccgacattttgctcggatacgaagttgataataaagagcagtcaaaggcatggaacttcagtatcgacgaactggatgaccaaatggccacaatcgatcctgctttaagccaaaattctcaggcacatgacattataactctgatccagaaactctacatgaccgtgcagcttgcccagattgtcccagagggtcagtccgtgtcagaaatgatgatcaacagatataacctgtacgctgagcagttgcaacagctaaaggactataagaaaataaatctggagacaggcctcctgcttagggaagcctacgatgagctgatgaccaaggcgttgacggcagcccccgggaaaactattcacgacacattctataacaaggtgaaaaagatcctcaaggatcaggacaataaacaggctctgagcatcaagcaagccattgaagatagtaactacttaatccctctgcggattaaatctaatggagtcataccatatcagctacatcagcgagagctcgacgcaatcattgaaaaccagaaggagttttaccccttcctggctacccctaatccagttgatggccaccaagaggcccttccgtacaaattggacgaactgatcggttttaaggtgccctattacgtagggcctatggtggatccagaggtcgactccgatcagaacttcgcgtggatggtgcgcaaggaaaaaggagagatcactccctggaattttcacaacaaggttgacattacacagagcgccgataatttcataaaaagaatgaagaccacggacacctatctcatcggcaaagacgtgctgcctcaaaactcgcttctgtaccagaggtatacagtcttgaatgaactcaacggcattaaggtggcaaataaaaagctgactatcgagcagaagcagcggttatacgatcaactgtttaaaaagaaaaagaccgtaaagaagcaggacattctaaacaacctcgttgctgccggggagatccatgaagatgacaatctgacaggactttctaacggtactaccttcaataacaatttgggctcctatatagattactgcaagatcattgggcaggacaaactggaggatgcttcaaagcaggccgacatcgaacgcattatcgagtggagtacaacctttgaggatgcaaacatattcctcactaaactggccgaaattaattggttaacggaggaccaaagacagaagctgagccagatcaggtaccgtggatggggccagttttccaaaacacttttgaccgatattaaggacaacaaggataattctatcatagacaacctcatgagcactaaaaaggtgttcatgcaaatcattaatgacaccacaatcaaacagaagattgatgactataaccagtaccacctgaatcatgctgatctaaaagacaccatcgcgaacctgtttacttcaccacaaaataagcgggcaataaaccagacactcctggtcattgaagatatcatcaacgccgtgggtcacaagcccaatcgaattttcatcgagagtgctaaagacaacagaaatgccaagaaccagcttacgcagtccaggttgaaacgcattgtcaagcaattcgaagataataaacagcatgtggaccagagcgtttatgaggagctgaagcagttagatgacgggtctcacgcatcaatagatgaccggctcctgctttactttctgcaaaacggcaaagacatgtataccggacagccgatcgatattagtcagttgagcacttcccagtaccacatcgaccatattctccctcaagccaaggtgatggataatgctctggacaacagagtacttgtctcttcgaaggccaatacagaaaagagcgataggttcctgtccgagatcccccagtttcagcagcgctcactctgggcagaactggagcgaatgggcttccttaccaaggcgaaaaaggaacggttgctgatgacaagtgacgagtttaaacaaaactctgtgcgtttcatagctagacagttagttgagactaggcagatcattaagctcgtgaatcaactgatcattcaggaacacccagaggtcaagctagtgaacatcaaagccgatctgaccaatgcatttcgcaagaaattcaactttgtaaagaatcggaacgccaacgactatcatcacgctttcgatgcctacctaacgagcctcatagggtcccacctgttgaaatcacatcctaagtgggaacccctgtttgtgtacagcgactatgataagattaaattcgacaatgcaccacagggagttaacatcatgaaggagtttgaacagtctaaattagctgatgagaatggtgagatcatttggaacaaggacgaaatgatggcctacctcgagagactgtataattccaggcaaatacttatcaccaaaaaggtctacgcgcgacacggcaacctgttcaagcagacaattttcaaagccggggaaagtgacaatttgatccccgtgaagaacaatcgcagcgatattgctatctatggaggctacaaatctaaacaggtgtcctattacgcactcatatcactgcataacaaaaagcggcagaagaggctagtcgccgtttacctgatcgacattcaaaaacttcagaatctcaacgagagtgattattttaagactctgcacaccatcattaaagagagacataatatcaagcctgagttcgacatattggctgataaaatttaccagaaccagctgatcatcgacaataagaacggtagcaatcgtccatttcgcattgaaggggatttcaaaaacgaccggcaattatatctcccgctgcagtaccagagatggcttgcctcgaaggaacccacagatgagaagctgaacaggatctttgaccacatatgtgaacaattggcagattatttccctctctttgcgggcaatgcctgcgacaaactgctagataaccgagacaagttctaccagctgtccattaaatctgagtttaatgacaagggaaaacttatcgctgagggcaagctcagcgtgattgataagctgttggtggccatgcacgcagactcacggaacagtaatttagctgtaatcgggctgtcctctagctggggacgcttcaaactccatggtggcaacgaagccatagggacttccgtccagctgattcaccagtcaccaaccggactttttaagagaatccaaaggttcaattga

SEQ ID NO: 3007 - RNA, 4041 nt, synthetic construct
  misc_feature 1..4041: note = Cas9 variant
  source 1..4041: mol_type = other RNA
atgctgagcgccggcgtgatgctcggggacgtctccgctcttaagtcttcaagaaacagtctgttccagaaaagcaagaaattgatcgaaaattcctcttcggatttaaccaaggttgactactcaaaaatgagggaaattctgctaagcatacggaacatcgcaattcgctttttcaataacgaggattttaaggaaagtgactattacaaggagttccccacaatctggcacctccgaaagaatctgatggaatccgataagaaagccgacattcgtcttgtgtatctggcgttgcataacatcgtaaagtacagaggaaattttctccaagagaacaataaagatctgagggctgccaacgcaaatgccggtgctgcagccatagacctgtctaacgctctcgaggaatatttcagcttacacgaggatgaatccgccctgacttgcgtgcctaatgtcgcggaccttcagatgacgttggagcagccaggcctgcggaacggggagcgcctagatagaatcgtggcagccctcaatatgccggacagggctcgggccaagctgtttgcaaaggcttgtattggacagaaagttgagttctcaaaacttgccctgggcatggagaaacaagaaggtaccaacgcgtacatctgggatgacgacaagtatgatgagttggtggccctctgccccgaagactttttccctgtcctggagacactgaaaaacgcatacagtgcttacgtgctgagcgatctccttgccgggaagctgtctatttccgcttcattgatcgacagctatgagcagcatcagaatgatctaaaaatagtaaaggaactggttcgcgagtacctcggacagaaggaatatggccgactgtttagaggcccaaaattcgccaacggggactacaattttaacaaggtggcaaaacccagttatacttcttacattcttggagagtccctgtgtaataagcaaggtaccacaagggaagagttggtcaaagagctcaagcgggtgttcgatgactgcagcgccatccaggctgataagcgttatcagaaaattaagcagcgcctggaagacgatcctaaattcttaatcaagcagaaaaccagagcgaacggcgcaatcccataccagctgcacctagaggaaatgcatcagattatagagaagcaagggaagtactatccctttctcgtggaacagcaggacctgatcgagaaacttgtctcgtctaggattccttactatgttggaccattgaatggcggtcacgacccgaaccacccctaccctactaatccaatcgatcccaagcggaaattcgcctggtccgtgcgaaagcctgggatggagcatgaaaaagcatatccatggaacgtagacgaggtgatagattcagaagagacagccgagcgctttattagaaggatgaccggaacgtgtacttacctgtatggcgaacccgtcgtgccgcggtgcagtctcctgtacgaggagttctgtgttcttaatgaactgaacggcgcacgctggggcgaaggaaatggtgacacccacagatttgatagctccgacaggacagagatcttggagcaactcttcaagaagcgtaaacgggtgactcataaggccatcgctacctggctggaaattaaccacggcgtcacaaatgtgaaaatctctgggacccaagccgagaacgcatttgaaagcaagttatcaagttacaacgatttctgcaatctgctaggagtagacggcctcgaggatgtttgtcctctgacgaaagacgatattgaacagataatcctttgggtgactgtctttgaggacaagaaattgctgctccagaagctgcagcgagcgttcggtgataagttatccgagaaacaaattgctagcatcatgagaaagccctatgccgggtggggcaggctgtcttcaaaacttttgacaggaatcaagcgcgaaaccccatttggccggattagtatactcgacgtgatgagagacggggatcctaggcccggacaccatctggacgcaatgaacttcatggagatcctacgcgaaaaagattttggtttccaggaccgaattgatgagatcaataaggaacggactaaggagagcggcctgctcctgtccgtcgaggaccttccagggtctcccgccttgcgtagatcggtgaaccaggctatgcacattctgaaagaaatcgttagcatagccggaaaggagccttccaggatcgtgattgaagtaacacgcgatccagacgaggagaaacggggccatagaaccgatacgaggtacaagcagttatcagaagcactcgctgccatcaaaaccgacattgtccaattcgatagttctctgcttgcggagctgaaggaacgaaaggacagcttggattccgagcgcctcatgctgtattttcagcagtgcggtaaatcactatacagcgggaagccgctggacatcaatcggctctctgaatatcaggtggaccacataattccccaatgttacatcaaagatgactccctggataacaaggcccttgttttcgctagtgagaatcagattaaattggacagcctgttactcgataagtctatcataagatcccagaaggggaggtggcaagagctgcatcgtgcaggacttatctcaaacaaaaagtttcgcaatctgacatgcactgaaattagtgaccggatgatgaaaggcttcatcaacagacagctagtggagaccagccagattgtcaagtttgtgaggcagatgtgcgaacaacgatatgagtcgtccgaagtaatctctctccgggccagcctgtcacacaatttgcgcgatagatgtgggttcataaaatgcagggagctgaacgactaccaccatgctcacgatgcctacttagcatgtcagattgcgcggtttatcggaatccgatatcctagatggcaggacggtattagtcgcgagttcatcaataagtacattaaacagctcgtgaagaagggcaaatcctctgggaagtttttcgccggaaaaagcggctttataatcgattccttcatgcatgacggttttgacagggaaacaggggagattttccgtgatggctgggacgctactttcgaaatcacccggatgagaagggttctgggatataaggattgctttattacacgcatgccagaggaacaaaccggcgcctactgggaggagactatctattcaccccttgacgctaaaaacgggaagaatctgcagatacctttgaagcagagcggaaaagaaggctacctcgatccaaagaaatatggtgggacgaacacagctttcaacgcctactttttcgcatttgtcgccaaggacgctcgaggaagagataaatacttctttgagggcgtgcccgtgtatctggcgaagcagctaaatgaacaaccgcagatcctggtcgacttcgccaacagtattgcagctaccaagaaatgttctactgccaagatccttcggtccaaagttcctctcaggcagaagtttctgttggatggtaccagcttctacctgggcgggcgcacaggaaataaaaacgtgattttatcgggcgtggagtttgcctgcgggatcgacatggctaagatgatagataccgcaattaagcacccagaggaactctcacaaaaagagctgatctctatcattcagatgcttgccgacactatagaacgtaatagtgatagacaggcgtccctgatcaacttccggaggttcgacgacaagttgcgcaatattgatgctatcgccgcaagccgaattatcaaaaacctcttaaattctatgaacggagtaaagcagagctgtgacctatccgatctgggcggttcaaaacaaagtgggtttatgcagagcaatatagccacacttttcgagagaatcacgtggtgctattcttccattaccggaatgtttgaacagcgggtctcattcgaggacctcaagaacggcatctga

SEQ ID NO: 3008 - RNA, 4041 nt, synthetic construct
  misc_feature 1..4041: note = Cas9 variant
  source 1..4041: mol_type = other RNA
atgaagaaaagaaacagggaggaatactatgtgggcctggacatcgggaccagctccgtcggatgggccgttgctacacccgattaccggattcctaagttccgcggtcacaaaatgtggggctctcgactctttgcagaggggaagcgtgccgcggaaagaaggcagttccggactaatcgcagaaggcttgctcggcgccgagacagactgcaaatattggaggaattatttgccgaggagatggcaaaagtggataacacgttctttatgaggctgaaggaatcaaagttctttctagaggacaaaaccgtaaaggaaaaacatatcctcttcagtacagataagtttgacgccgatcggttctataaagacaatccaactatttaccacgtgcgtaagcgcctgatggaggaggaaccgcaggatatcagagagctttttctggctgtccatcacattttgaagtataggggacatttcctctttgcaggcagcctggaacagaacggtgactccatcgaggaactggtgcggaccctcttcgggaaacagggattagccatactggatgacacaatcgattctaatgagatggttaacattcttaagaataacgagaaaaccaagtcggaccgcaaaaaggctgtgcaagaattgtggaatcccctgaaagacaaggtcaagaaagcccaggcggcagagatggccggcgtggtactaggcctcaactcagatatcagcaagctgttcgacaatagtgattacaaagaccttaagattaacttttcctctggggattatgacgaaaaacgagatgactacgctaatagcatcggagatgacatagttctgttggatactatgaaggccctctacgacacactgattttatcccagatcctgcagggtaagcaatcaattagtgaggcaaaagtggaagactataacacccacaaggagcagctcagagctcttaaagccatcctgaagcctcacaaaaggttgtacaatgagatgttccgggaaaacaacaagaaggatctaagcaattatgtcgcgtacatctcttcctattcagagggcaaacgcgtgaacagagaagggttttacaagtatgtgcaggccgtcctgaaacaggttgacgatagcgacagtaagcaagcaattctcgaggctataaggctggaaacgttccttccactgttgcgtgtgaaagataatgccgtaatcccccatcagattcaccaggctgagctcgaggccatcctggaaactgcacggaagaagtacaaatttttaaacgacgtgtctgagggagtctccgtgaaggataaaataattcaactgttcacctttcgaatcccttactatgttggcccactaaatccccatagcggtgaaacagtggccgacagaaagcaggggactggatgggtcgtgaggaaacagcgcggcaaggtatacccttggaacttcgctgatatggttgacgtgaaagcgtcggcagaggcctttatcaccaatctcacaaacaagtgcacctatctgattggcgaggatgtccttccaaagcggtctttgctgtactccgagttcatgctcctgaatgagcttaacatgatcaaatatgacgggcacgaactgccggtggagattaagagattgtacatagaacaggtctttaaacaagagcacaagaaacagacgaagggaagggtgctcgatttcctgaagcgcaatggtttaatcactggctcagctacagccgttattaccgggatggacgacagtatcaaaggagatctgcagagctatcgagacatggtgcggatctttggcactggtttcgatcattccatggcagagcgtattataagatgggtaacactattcggggaagccaaggacatcctcgagaacaaaattagggaagtctacggcaattctatcagcgattcacagatgcgcgctattaagaaactgaagtacgccgactggggacggcttagtcaagcatttttcatcaagataatcggctgtgataaatccggggtggagagaaacattattacctgcttgagggaaagctctcagaatctgatggagatcctctcagaccagggaacgtatatcaagcagataaaagcgtggaaccaccaacataccacaaacatgatggatactctggactaccagttagttgatgacctgtatgtggctcccagtgtcaagcgaagcatttggcagtccctttgtatcgtggaggaattggtaaaaattatgggtcaggcccctaagaagatctttgtggaggttacccgcacaaatcaagcagagaaaactaagaaagattctcggaagaaaagactcgtcgaactgtacaccgccataggcaaggaaggggctgcctggaaaaaggagatcgagaagcaccaggcaggagacttcaggcgtaaaaagctatatctgtactatacacagatgggccgctgcatgtactcgcatgaaccaattgctatggacgccctctttaccagcgagtacgatatcgaccacatttatccccaatccctgactaaagatgactcatgggataaccttgtgttggtgaagagtcagctgaataaagaaaagtctgaccagtaccctttacggccagcgatcagagagaagaacaaagcctattggcagtacctctgtagggctggtttcataagcgagaagaaatatgaacgactgatgcggacgacagagcttaccgcagaagaactgtccgggtttattgcccgccaattggtcgaaacttcacaggctaccaaggccgttatcggcctcctggagagaatctacaaacacacagatatttgcttcgtgaaggcagagaccgtgagccagtttaggcatcagcacaatttcatcaagattcgggaactaaacaattatcatcacgcgaaagacgcctacctgaacatagtagtcggaaatgtgtaccacgagaagtttactaaaaacccccgagagttcatcgctagatctacagaacgcaggccgtataatctcaaccgtatgtacgattttgacctgcttaagcaaggccgggttatttggcaagtgcctaaatccttggaaacggtccaggccatgatgaagagtaatgatgtgagaatcaccaagaaactgttagttcagaagggggagctctatgacgcaactattacaaaagctcataagaccaaagagggaatgtacttccccctgaagggtgccgacgcaaggcttcgcgatgtgcaccgatatggcgggtacgaaaagatcaaaatagcctattacagcgtattctcttgttgcgagaaggcttccgacacaatccatactctgattatcccaattcctgtctacgcggccggactactccagaccgaagcagatctgacggcttatgcctggcagaccaaacagaagacaaaacccatcaaggacatatactcaatgattactccaatctataaaaagttgtgtatcaacaccgtggtgaagattgatggctttaaatacttcctgggtgggagaacagaggactatatatgcttataccccgccatccctgtcgttctcgatgaacaagctgcagcctatctgaaggcggtgagtaaagtaggccgggctgacgatgtggagaatactgcccaggcaattgaccttatcaccgccgaggctaacgaagcattttacgatgtcctgttgaagaaaatggaggccaagattttcgtgaaggcgtaccaggaaagggttgagaaactcgctagcgagacggcccgcgaacgttttagaaagctgtcgatcggagcacagtgttcctgcctactggagatacttaacctcctggccaataacaaaacaacctctaatttgaagaaatggctgggcgtgactatgagccggaggaagcaaccaatggacttaacaaagctcgaagagtgcatcgtctatgaaacctcaattactgggctgtacgagaaagctgtgagtcttctgtga

SEQ ID NO: 3009 - RNA, 4041 nt, synthetic construct
  misc_feature 1..4041: note = Cas9 variant
  source 1..4041: mol_type = other RNA
atggtggagcactacgccatcggcttcgacattgggaccggaagcacaggttttgctggcgtcgatcccaacgggaagctggttagaatgaggggcaaaaatgtgtatggagtataccggttcaagggtggggaagcagccgcggaccgccgaggatttcgtactacgagaaggcggataaaacgcagaaagtggaggctccggttccttaaatcctttttcgagccttatatcgctccaattgatccggaatttttcctgcgccagaagtactctgccgactcacccttggatcctaagggcatccgagcagacaaaggcttactgagtgatatgagcgaccaagagtttcatgccaagtatccaaccatttaccacctaagatatcagctcatgcatgagaaaaggcagttcgatgtgcgggaaatctacctggctatgcaccatataatcaagtaccgtgggcactttcttattgaggacggagcagataacttcgacgccaaacagatcgatttcttcgaccaattccagcgcatggctgccgtcacagcgggtctgcccgaattggagactctcgtggttcctgacgaaacccagtccgatgcatttaagagagtgctgttcgacgagtctcagacaaagtcggataggcaaaaagtcctggcctcacagctcttagacattcaggataatcagagcaaggctatcaaagactttatagccgcactgaccaaggctgtggtaggcatgaaagccaaccttgcgactttgacaagtaccgccattgagtccacggataagaatgactggactaaaccactggggcaactagatgacttcctcctgaagcacgaagaggatcttgacgaagacggatatgcactgatcgatgctgccaaccagatgtactctgctgccgttttggcagccctcgtgcccgagggcatgggttttagcgaagctatgatggcgcggtatgcacagcataagaaacaactggccttatacaagcaggtcattgcttccctgcctgacaaaacccagcgacacgagctcaaggatgcctatgcagactacatcgagcatgccgctcagaatccacgcgatgccttctataaaagagtgacaaaggtgcttgaaggggtcgactcagcagatgcgaggactgttatgaccgctatcagtcacgacgagtttctgttgaagcaacggacactaagcaacggaaaaattccgtaccagatgcagcagcacgaatttgatgccataatcgagaatcaaaaggcatactatccctggctggccacccctaacccagtggaagctgacgccaaacgcctcccctactatctggatgagcttattggctttagagtaccttactatgtgggcccaatggtcacggagaagcagtctcagttcgcatggatgatcaggaaagctgacggggaactgactccctggaatttcttcgatgtggttgaccgtgagaagacagccaaccggtttatacagcgaatgcaaaccactgacaagtacattttgggagaagatgtgctcccgaaacattccatcctgtatcagcagttcgaggtcttaaatgaactgaacaatatcagagtggagaagcaccctctaacaaccgagcagaaacaattcatttaccagaggctctttgtagaccagcaacgcaagacgatcaccaaaaagaacctgcaggatacacttgttgcgatgggtgaatttgacaaggcccccgatattggcgggttggctaaagaggacgtgatgatgtcaagcctggcaacttttgccgattacagtaagatactcccagaagctatctctgaccctacccggcagaacgatattgaggacatcatcgcctggtccacaattttcgaggatactcagatatttttcgacaaactgaagaccgtcgattggcttacaacccaacagagaaaaaggctggcaagcatccgctatactggatggggcaagttgtcgaaacgactcctgcagcagattcccacgtctaagcatacaaatgtgatggcggccttatgggctacctccgacaactttatgcaaatcctgcaggacgaacagttccaggagggtctatacgatgccaatcggctcccagaagagactctgacccccgacgaacaagtcgagaagattcttgatgaggcatatttgagtcctgctgacaaaaagggggcccgtaaagtgatcaaggttatgaacgatatagtgagagcaaatcacggcgtactgccagaacaggtctttctcgagtcagccgacgatccgcagaaaaacaagaggcgcagcgtgtcccggtctaagcaactggaagagaaatacagacaggctgcgcagagcttcatcgacgaagccgttaaggaggagttaaatgcacagattgtgaactcagctgaatttaatgataggctggtcctttatttcacacaaaacggacgagacatgtacaccggcaaacgcttggatatcgagaatctcgggagttatcagattgaccatatcctgccccagtccctagtgaaggacgatagcctggacaaccgggccctcactgccagagatataaatgctgaaatgtctaaccagtttgtatcagagaggttcggactgggtcctcgtgcattctggcaacagcttaaaaataacggcttgattagtgggcgcaagtttcggaacctggtgatgcagagagacgaaatcgataagtacgccccaggattcattaataggcagttagttgagacacgacaaatcataaaaacggtcgagcagatcattcaccggctctggcccgacatccagattgtgaccatcaaggcgaacctgactcaccaggtgcgcagcgaacttggctttcctaaagtcagagagctgaatgattaccatcacgctttcgacgccttgctcgcagccaggataggtcaatatctgctagaacattacgctgggctgaagccatttttcacatatggcgagtttaaacggggagataccaagaagtacggcacaactaacttcctccgaagactgaccaaagacaataaggataaaaagggggagcttttgcccgaagtttccgactggattgattctatcgactcgatctataactacaaaaagattccggtggtgtgggagaatacgaccaacatgagcgcactgtttgaccagacaatctatcctcgcccagatagggacactaccaaacgtaagttaattcccacaaagctcgataaacctactgacatatacggaggttactcctcagccaagaccgcgtatatggctgtaatgcgggtccagacgaaaaagggcacagaataccccgtgttcaatatcccagttagtattgcctctcaactgaacagaatcaccgatcagactatgcttaaacaacaggtgaagcagtttattatcaatgcagagcagagcgcctccaagaaaaagctgtatgaatcaggggacgtcatactaagcagggtggctctcggacagcgcttcacagataaaaactacggcgaggttttcctgatctctaatatggaggtgcagaaccctcaatccttgtggctgggtcgagccagtcagcagagattaacccgggaacccgaggggaatgaaaagccagagactagcctcgcagacatttatcagcaaatcctgaaacaggtagataggtactttcttgctttcaacattcgccagcaacgtcagaagctgttgggcaccctcgaccagtttacatctctgccggtcggaagagtgaacgaacagacgcggaccgatcaaaatcagaggtccatcatagcccgcgtgatgattgtcctaggcaaggggtcacgagaggagaaattccctgaatttggactgagtgcgcttggcagactcgttcggactggtgggatcacactgagcgaggacgcccagatcatttatcagtcgcccaccggattgttcgaaaggcgcgtggcactgaaggatttatga

SEQ ID NO: 3010 - RNA, 4041 nt, synthetic construct
  misc_feature 1..4041: note = Cas9 variant
  source 1..4041: mol_type = other RNA
atggccaagatcctgggcctcgaccttgggaccaacagcattggatgggctgtggtcgatatagagaataacaatgagttcacactgatcgagaaaggtgttagaatttttcaggaaggcgtgaagatcgagaaagggattgaaggatccaaggcagccgagaggactacgtaccggtctgcgcgccgaatcaaatatcgtagaaagttgaggaagatacaattactgggcgtactatcagagaacggttactgccccttcctcagtaaagacgaactggatagctggcggtataagaaagtgtaccctaccaataagtcctttcttaactggcagaaaacaaatgagatccagctggaaaacccatatttctaccgcgctttgctcgtcgagaagaagctgaatctgaacattgaggaagacagatttaaaatcgggagggccttctatcacctcgcacagcggcgcggatttttatctaatcgaatggagggcactaaggaaaacgatggcaccgtgattaaatcgatcacagagatatcaaccgccaagggggacaaaactctgggacaatacttctacgaaagatataagaaaggtgagaagattagggatacatacacccatcgggaggaacactatcttgaggaatttgttcgtatctgtgagttccagcagttggacaataagtttgctgaaaaagtgcgcaaggcaattttctaccagagaccgctgaaaagccaaaagggcctaatcgggaaatgcgtctttgagcccaagaagagtaggtgttccgtgtctcggcctgagttcgaagagtatcgaatgctctgcttcctgaacaatatcaaaattaagacgccaagcgatgaaaaccttcgctttctgactgacaacgagaaagaaaagttgaaaccccagttctttagaaagtccaaggatcatttcgactttgaggatctcgtaaaacagctggcccctaagaatcagttcaaattttacaagtcaagggacatattaccaggaaactggctgttcaattatagtatgaacaccacagttagcggctgtcccatctctgctcggctcaaagacctttttggtgagaatttcatggatattaagtttgactacatccgcgaaaaggatgggaaaaagtccgtgatagacattcacgatatctggcatgtcctgttcacttacgactcagaggaaaaattgaaggagtttgccagaaacaggctaaatctggatgacatcaaaattaaggagttccaacgtatccagctcaaaaaggaatatgcggcactgagccttaaggccattcggaaaatactgcctttcttgcgagagggactcatctacagtcacgctgtgtttattgccaacatggaaaccgcaatcccatctgagatctggaataactatacaaatagaaacattataaagaatgaaatctacaacattatctccaatcagaccgaggataaacaagtggtcgacattgttaacggcatcataaagagctcgaggatcgagaactctgtgtggtccaatgaagctgtagagttctttaaaaaggatctgaactcaaagattaaaaattattacggcatcaagacgtataacgacttcccggaagagaaaaagattcgcatcgaaacttacgcctttaatttattcaaacagcagatgatgaagaactttgggcggggagagttcgcggccgtgcagagaatagacgagaggctgaagctatttctcacagataatttcaacattgaccccatcctgcttaaaaagatttaccaccctagtgcaatcgaagtctatcaaccacccgtgcgcaaaaatgatggtaagttgtacctgggcagccctatggtttcctctatacgaaacccaatggctatgcgggccctccatcagctgcgtaaacttatcaatgagctgattagaaaggaattgatcgacagcaacaccaaggtgaatattgagatggctagggaactcatgaacgccaatgagcgcaaagcatatcagaactggcagaacgatcgggagaagatcagaaaagaatacgccctgaagataaaacaacacttagacgtcgataaggagccctcagacgtggatattctgaaatatcagctatgggaagaacagaatcataagtgcatctacactgggaaggagatcaacattagtgactttctcggatccaatccgaaattcgatatcgaacacacaattcctaggagcatatcttttgacaactcacagagtaataagaccctgtgtgagaactatttcaatcgaagcgtaaagaagaaccgcatccccgctgcgcttccaaatcacggcgaaattatcgagcggttggaaaactggaaactgaagtacgaggagctcgaaaagcaaattcagtacgcagttagacaggccaaaggtgctggggataaggactccaaagacagggccatccagaagcgtcataaactgaagttcgagtatgattactggaagaataaatatgaccgctttgtgatggaagatgtccctgagggcttcaagaactctcaattagtggacacgggaataatcaccaaatactcgcggatgtatctgaatacactttttgataaggtctacactgtgaaaggcaacaccgttgcagacttcagaaagttgtgggggattcaggatgaatatgagaagaaagccagggtgaatcacagccatcactgcgtagacgctatcacaattgcctgtatcactaagtccaactacgagaacctcgcaaaattttaccatgattgggaggagctgcacgtcaagggaatagaccagctacccccaatgaataaaccctggaagaccttcacagaagatattaaggcgatccaatatgagatcctggtgtcacactacacccctgacaacctcccaaaacagagtaagaaaattctgcgaaagaaaggtcggatacagaagaatgaaaacggcaatccgatctatcttaaaggggatactgttcgcggatctttgcatcagcaaacgttttacggcgctattgagaagacagaggtgaacaagaaaggtgaacccgagaaggtcatcaaatatgtggtaagaaagagcctggacgtgttagacgattcctcagttaaaaatattgtcgacgatatcgtgaaggaaatagtgcagaacgccaggatcaaggagaaagacttcattaaggagctcgaaatccagaaacggaagctggcaaaagccgaggaaaataaggtcgttcagattcaagctgagatcgataaacttaacaaacaggtggccgacctgtacaccatgcctaataagaacgggaatccaatacccattaaaaaggtgcgaatctttcagactagcgtaaccaaccctatccacttgaaacagcaaagagataagtctcagaagacatccaaaccacataaggagttctattacgcagctaatgacagtaactacatgatggccatttatgaaggcaaagatgagaagggaaaagtcaagcgcgactttaaactcctgaataacctagaagcgggcgagttcttcaagtacagcgtgcacaaggatctgaaagaaaagaacctcgagaatatcaggaacgttatacccgacaaagtgtctgccgggaagattgaaatcccgctgaaagctattatcaagaccggaactatggtcatactttgggaaaattcccctgacgaggtgtgggatttgacaatttcagaagttgacaagcgtctgtataaagtggtaggtatgagtgtcaaccggatcaagagcgatgtgaaaacgtttgagttcggcaatatcgtgttaagacacaacaaggaagcatcgccagccaccctcctgaaaattcaggacggggagtttaagtccgatgaaaattacatcgctcaaaggaaactttctcataaccagttcaatgccctggtcgagggagttgactttagcctatcagtgctcggcgagattaagcgcctgaagtga

SEQ ID NO: 3011 - RNA, 4044 nt, synthetic construct
  misc_feature 1..4044: note = Cas9 variant
  source 1..4044: mol_type = other RNA
atgggcgaggacgggaagcccgtgagagtcaaaggaaagaccgccatcggtgctaggctgttccaggaaggccacgttgcagccgatcggcgcatgtttcgaacaactcgtagaaggctcaaccggcgcaaatggagacttaagctgttggacgagattttcgatccttacataacgccagtggacagcacctttttcgcgaggttaaaacaatccaatctgtctccgaaggattcacggaaggaatttaaagggagtatgctattccccgacctcacagataagcagtatcatgaggactaccctactatctatcatctgcgccgagctcttatgaccgaagataaaaagtttgacattagaatggtatacctggccatccaccacattgtgaaatataggggaaacttcttgaatagcgcaacagtcgatacctttaaggcctccaaggtggacttcaaaaagtcttttaaccagctcaatgagctgtactcggctatcaacccagaggatgcattccaggttgacatgaataaatcagacgaaactggccggctgtttctcgatagcagtatacgtaagttcgacaaacaaaagcagatctccaaattaattcccgtggtcgtggaggataaggaagccaagaaactgaacggtaagatcgctcttgagattacaaaagccatcttggggtataagtctaaactgaatgtagttacccagacggagcctgaagacccaaagaagtgggcggtgaaattcgatgacgaggatatagacagcaagctaaacgatattctccccgaaatggacgagaatcagcaatccatcgtcgaaattatccaggatctgtactcacaggtgactcttaaccagatcgtgcctaatggaatgagtctgagcgactctatgattaaaaagtacaacgaccatcacgagcacttgaaactctataagaagctgatagataatatctccgacaccaaaaagcgctcagcattaaaaacagcctacgataagtatgtcggcgacgatggcaaaactattgagcaagacgaattttacagcaacgttaagaagaacctggatgacagtgatctctctaaacagatcgctgaccttatagaggccgaaaagttcatgccaaaacagagaacctcccaaaatggggtgattccgcatcagctgcaccagagggagttggatgaaatcatcgagcatcagagcaagtattacccctggtttgcagaggctaaccctaataaacacgacctacacctggccaagtataaaattgaagaactcgtagcgttccggatcccatactacgtgggacccatgattacacctgaagatcaagagaagtcgtctcagaccatatttgcctggatgaagcgaaaagaaccaggtcagatcacgccctggaacttcgacgagaaggtcgaccgcatggagtccgcaaatagatttattaaaaggatgactacaaaggatacctatctgatcggcgaagacgtgcttccggatcagtcactgttgtacgagaaattcaaggttctcaacgaactgaatatggtgcgggtcaacgaccatcctttaaaggtgagtgagaaacaagctatctatcgcgatctgtttgagaatcagaagagaattagcgtaaagaacctacagaattacgttaagtccaaatctgggctccccactggaccaaagataagcggcctgtcagaccctgatcacttcaacagttcccttggtacatataatgactttaagaaaatgttcggggataaggtggacgatcccgacttgcaggatgactttgaaaagatgatcgagtggagcaccattttcgaagacaagaaaatcctgagggccaagctcgatgaggtcgcttggctgtctgacacgcaaaagaacgagttcaaagagattcgttaccagggatggggccggctttcaaagaaactgttgaccggcatcgtggatgggaatggacagcgaataatcgacgagctctggaacacaaacaagaattttatgcagattcaaagtgatgacagcttcgccaaaagaatccatgaagcaaacgccaatcagatgaaggctactgatgtcgaggacgtgctggcggatgcatatacctccccacagaacaaaaaggccattaggcaagttgtgaaggtagtcgacgatatccagaaagctatgggtggcgtggcccccaagtttatatctattgagttcacacgctcggaagaccggaatcctagaaggactatcagccgccagcgacagttagaaaacaccctgaaagacacagcacaagccctagttaagtccattaatccagatatcctctcagagctggacaacgctagtaaatctaagaaggggcttaccgatcggttgtacctgtactttactcagctcggaaaagacatgtatacgggcaagccgataaatatcgatgagattagcaactacgacatcgatcacattttcccccaggcctttatcaaagacgattccctgaataaccgtgtgttagtctcaaaggcaggtaataacgggaaaagcgcgaatgtgcctctgaaacttttcggcgctaagatgggaggctattggaaacagttggccgacgcagggctcataggacaaagaaagctgaaaaacctacagacaaacccagataccatttctaagtttgccatgcatggtttcatcaggcgccagctggtagaaacttcccaggtgatcaaactcgttgctaatattctgggcgacaagtaccggaacgatgacaccaagatcattgagataacagccagaatgaatcaccaaatgagggacgaatttgggttcatcaaaaaccgagagattaatgattatcaccatgcatttgacgcttaccttaccgccttcttgggacactatctgtaccatcgctacatcaagttacggccctatttcgtctacggcgattttaaaaagttcagagaagacaaagtgactatgaggaactttaatttcctccacgatctgacagacgataagcaggagcgtattgcggacacggagaccggtgaagtgatctgggatcgcaagcggagtatacagcaacttagagacgtctatcactacaaatttatgctgatcagccaggaggttttctctttgaacaaggaaatgtttaaacagaaactcttccctgccactctggctaaaaagtccaaactaattcagatcaagaaggataaaccagtggacatttatgggggctactcaaataacacagatgcatatctgaccgtggtaaagctcaaaggaagtaaggaggacaaatacaagatcgtcggcgtgcccatgagggccctggacaatcttaagcatgctgagaaagaaagcccgcaatcgtacacagccgagttgcgaaaggcactggaacctcagtttactaaaataaagaaaaaccggaagaccggggaggtttccaaggtggtcacgaatttcgatattgtgttaggacgcctcttttatagacagatggttatcgacggttctgagaaaagcctgatcgcgtcaagtgtgtaccagtataacgccaagcaacttgtactgtccgatcaggctattaggaccatatctgaccaggaaggcatcgatgagttcgaactaagctcccagtacgacaaagtctatgatgagattgtgcaaaaggtggaaaaactcctgccaatcttccagcaccggcattttcaggagcgattgaataacgggaagtcactgttcgtcaacttacccgttcacgacgtgtacgaaggaaataagctcgagcaggtaggcaaaaagcatattatcaacagcatactgggtgggatccacgccaatgcagatagacctgacattgatctttttggcatcaaaaacctgggacaattcagttctacatccggcattaatttgagctcggacgctatcatatgctatcagtcacccactgggctctttgagcgcagggtggtcctgaaggacctatga

SEQ ID NO: 3012 - RNA, 4044 nt, synthetic construct
  misc_feature 1..4044: note = Cas9 variant
  source 1..4044: mol_type = other RNA
atgaccaagagagaggaaccctacaacgtgggcctggacatcgggagctcctctgtcggatgggccgttgtggataataactatcacctccttaatattaaaaagaacaatctgtggggtgctaggttgttcaaagaggcagaaacagcccaggtaactcggggccatcgctcaatgcgacgtagatacaggcggcgcagaaacaggttaaattggctggacgagctatttgcggatgaactcgctaagatagaccctagtttcctgcttcggatgaaaaacagctgggtgtccaagaaggagtctacgcgcaaacgagatccatataatctgtttatcgacgagaagtacaacgatgtcgactatttcaatcaatacccgaccatttttcacttgagaaaagaactcatcacagaggataagaaagtggacattaggctgatctatctggccatacataacatcattaagtaccgggggaatttcactctcgaaaaccagaattttgatatctcgcagttatcaagcaacttcagtcagcaaatttccgactttttcgcactgttttctgatttcggagttatcatgcccgaggactttgaccctgataagataagcgacattcttttgaacccaaatctgtccccctcaggcaaagtgagtgaggccatcgctaccattagccctaagacaaacgtcaaagcaaagatcaaaatcattctactcctgcttgtgggtaataacggggatctgaagaaattgttcgacctcgaaaccactgagaagatagccgtaaagctgtcttcccgtcacatcgattcagaattaccaattatcctgagcgagctcaatgaacagcaggagaacataattacaatcgctaatagtatcttcggatctattatccttaaagactttctgggcgatgagacctccattagcgccgcgaaggttatatcgttcgaagaccataaacaggatttgcaaaagctaaaaacgatgtggcgcgagacttctaacaaggaagcagtgaaggccggcaaaaaggcttacgaggactatatcgggcacgaagattccgagaccttttacaaaaagattaaaaagttcctggagaaggcccagcccgtcgacctcgcaaataaagctctggccgaaatcgagcttgaaaactatctgcctaagcagagaaataggaacaatacagtgatcccataccagttgaacgagaatgaactcattgcgatactggaccaccaagagaaatattacccgtttttaaaggagaaccgggataaaatcctgtcactactcactttccgcattccctattacgtgggacctctgcaggacagtaacaataaccgatttagctggatgaccagaaaggcctccggtgcaatcaggccatggaatttctctgaaaaggtcaacgttgagcagagctcaaatgattttattaaacggatgcgcagtacagacacctaccttatcggcgaacccgtgttgcctaagaaatccctgatatatcaatgctacgaggtactcagcgagctgaacaatacgagagtgaaggatgggtcttcaaacccaaaaaggcttgacgtcactatcaagcagcgtatttataatgaaatcttcaaaaaccagaagagtgtgagcgttaaggtgctgcagaattggttgattaaagagtcctactttaagtctcccgaaatctcgggactcgctgataaaaagaaatatctgagctccttatcaacatacatagacttcaagaagatttttggccaacggttcgtcgatgacccggtgaacagtcctcagctggaggaactagccgagtggctcaccctgttcgaggataaaaagatccttttgattaaactgcaaaattctaagtatagctacgaccaggctactatcaacaaactctccacaatgcgataccagggtaccgggaagctgtcaaagaaattactggtagatcttaagacgaccaaaaagagcataggaaaatctggcgccgaatccttgagtatcctcgacctgatgtggagcacaaaggacaattttatgcagattatccatgatgcagactatactttcgagcagcagattaaggaatttaactacgataccgaggacgaactaacacccctggagaaagttgccaacctccacggctctccagctctgaagagagggcttaatcaatccatcaaagtggtcgcggatatagtgaagttcatgggacatgaccctgagaaaatttttatcgagttcactaggtcagatgactttagtaagttgaccatcagccgctatcggagaattaaaaagcagtacctggaaatcgcaaaggccattaaaaagatacccgctgagttcaaagatatcaaggaatatcagacacagttagaagagaacaaaggtaagctcgcctcggagaggctgatgctttactttctgcaatgtggccactccttgtattctaataagccaattgacctcaacatgatcaatagctcaaaataccacgtcgatcatattctgccccagagttacatcaaggacgattccctagaaaacaaagcactggtgctcgcctctgagaatgaaaacaagatagacaatatgctgatcagccacgacattatcgctaccaaccttcctcgctggcaggccttgaaagatcaaaatctgatggggtccaagaagttcgcagacttaactcgaacgacagttaccgagaaccagaaaaagggatttattcagcggcagctcgtgcaaacttcacagatcgtaaagaatataaccctgattcttaacgatctgtataagaatacaagctgcatcgagacccgtgcgactctaagttctgagttcagaaaggctttttccaacttcgacgaaacaacgtaccattatcagttcccagaatttgtcaagaacagggatgtgaatgacttccaccatgcccaggatgcatttctcgcctgtgttatcggcgagtaccaactgaagaaatatccgaaggacaacttgcgcctggtgtacgatcagtatagcaaattcttagactcgctcaagaaagatacccggaagaagaatggtagaatgcccaggtacactcagaacgggtttattataggctcaatgttcaatggaaaaacatacgtcgacgacaacggcgaaatcatttgggatcagaagatcaaagagtctattcgaaagacctttaattatcaccaattcaacgtggtacgccagacaatcgagcagcacgggaaactgtttaatgacactatacaacctcatagtgatcggtacaaacttatcccactgaaaaccaacagagaccccgctatttatggaggttacaataacgataataacgcctattccgtggttttggacgtcgatggcaagaagaaaatcaatgggattcctatcaggatagcaaaccagctcaagagcgacgaactggatctatctagctggctggagaataacattaaacacaagaaaccaatgacgatccttatcgacaaggtgcccaagtaccagcgtattatcaacgaagagaccggagatctcctgataacatccgctaatgaagtgattaacaatgtccagttgttcctgccgtcaatgtatactgccttaatcagtctcctggacagcaccaaaacagagatgtactctaaacttctgtccaactacgaggcgaatattttgatcgatatatatgactacctcctgactaaactaaagaacaattatcctctgtaccgcaaagaatgggccaaacttgctgagcatcgggacgattttattgaatcagacctcgttacccaagcaagtacgctgcagcagttgatcaagttcatgcacgccgatccaagcaacgtgaatttaaagttcggcaactttaagggtaatagattcgggaggaaaaacggcaatatcaagctgtccaaaacagactttatttatgagtctcccaccggactcttcaagtcgatcaagcacattgattga

SEQ ID NO: 3013 - RNA, 4044 nt, synthetic construct
  misc_feature 1..4044: note = Cas9 variant
  source 1..4044: mol_type = other RNA
atgaaaagcgagaaaaagtactatatcggcctggacgtggggaccaactccgtcggatgggccgttacagatgagttctacaatattctcagagctaaaggtaaggacctttggggcgtgaggctgtttgagaaagcaaagactgccgcggatacgcggaccttccgctctgggcgacgtagaaacgacaggaagggaatgcggttgcagatattacgcgaaatctttgaggatgaaattaaaaaggtagacaaagatttctatgacagactggatgagtcaaagttttgggctgaggacaaaaaggtgagtggcaagtacagcctattcaatgataaaaacttttccgacaagcaatatttcgaaaaatttcccacaatcttccacctcaggaagtacctgatggaggaacatggtaaagtcgatattcggtattactttcttgccatcaatcagatgatgaagcgccgagggcacttcctgatagacggacagatctctcatgtgactgacgataaacctttgaaggagcagctcattctgctgatcaacgacctcttaaagattgagctggaagaggaacttatggattcgatctttgagatattggcagacgttaatgaaaagagaaccgataagaaaaacaatctgaaggagctaattaaaggccaagacttcaacaagcaggagggcaatatcctcaactcaattttcgaaagcatcgtgacagggaaggccaaaatcaagaatattataagtgatgaggacatcctggaaaagattaaggaggataacaaagaagactttgtccttaccggagattcctacgaggagaatctgcagtatttcgaagaggtgttgcaggaaaacatcactctctttaacacactgaagtctacctacgacttcgtaatattacaaagcattctgaagggtaaatccacgctctcagacgctcaggttgagaggtatgatgaacacaagaaagaccttgagatcctgaagaaagtgatcaagaagtacgatgaggacggcaaattgtttaagcaggtcttcaaagaagataatgggaacggatatgtgagttacattggctattacctaaataagaacaaaaagatcactgccaaaaagaagattagcaatatagagtttaccaaatacgtgaagggtatcctggaaaaacagtgcgactgtgaggatgaggcagtcaagtatctcctggggaaaattgaacaagagaacttccttctgaagcagatctcttccatcaattcagttattccacatcagatacacttgtttgaactcgacaagatcctggagaacttagctaaaaattacccgagcttcaacaataagaaagaagagtttacaaagattgagaaaatccggaagactttcacctttcgtattccctattacgtgggacctctgaacgattatcacaagaataacggcggcaatgcctggatcttccgcaacaaaggggaaaagataagaccatggaacttcgagaaaatcgtagacctacataagagtgaagaggaatttattaaaaggatgctcaatcaatgcacatacctgcccgaggagaccgtgcttcctaagtcttccatcttgtatagcgaatacatggtcctgaacgagctcaataacctgcggattaagggaaaaccacttgatacggacgtgaagctgaaattgatcgaagaactcttcaagaaaaagactaaagttacactgaagtcgatacgagattacatgattcgcaataactttgcggacaaggaagacttcgataattctgagaaaaacttagagatcgtgtccaatatgaagtcatatattgactttaacaatatcctgggtgataaattcgaactagagatggtcgaagacctcatagagaagatcaccattcacactggcaacaaaacactgcttaagaagtacatcgaggaaacctatcccgatttgagtagctcccagattcagaaaatcataaatctgaagtacaaagactgggggagactctctaggaagctgttagatggaattaaaggccggaacaagacggacgatgtgaataccgtaatcaactttatgcgcaacagctcagacaatctgatgcagatcattgagggtaagaactatagtttcaatgaatacatcgataaccttaggaaaaagtatattcctcaagagatatcctacgaagttgtggagaatttgtacgtcagcccatctgtgaaaaagatgatctggcaggtcattagagtgacagaggaaatcactaaagttatggggtatgacccggataagatttttatcgagatggcaaagtcagaagaggagaaaaagaccacaataagtcgtaaaaacaagctcctggacctatacaaagccatcaagaaggacgaacgggatagccagtatgagaaactgctcactggcctgaataaacttgacgaatccgagttgcgatctaaaaagctgtacttatattacacccagatgggaagagatatgtatacaggcgagaaaattgacctcgataagctgttcgactcgacccattacgataaagaccacatcattccccaaagcatgaagaaggatgactccatcataaacaatcttgtgctggtaaacaaaaatgctaaccagactacgaaggggaatatttaccctgtcccatcaagtatcaggaacaatcccgatatctataactactggaaatatttgatggaaaaggaatttatttctaaagagaagtacaaccgcctcatacggaatacacctctgaccaacgaggaactaggagtgttcatcaatagacagctggttgagactaggcagagcaccaaggccattaaagaactctttgagaagttctatcaaaaatccaagatcattccagtgaaagcatcactggctagcgaccttcgcaaggacatgaacacattgaagtctcgagaggtcaatgatctgcaccatgcccacgacgcgttcttaaacatcgtggccggtgatgtatggaatcgggaatttacctccaaccccataaattacgtgaacgagaatcgtgaaggcgacaaagttaagtatagtctcagcaaatacttcactagaccgaggaagtctaaagggaaggtcatctggacacctgagaagggacgcaaactgattgtggatacgcttaacaagccctccgtgctgatctcaaatgaaagtcatgtcaaaaagggcgagctatttaacgcaaccattagcggtaaaaaggactacaaaaaggggaagatctatctcccactgaaaaaggatgaccggttgaaagatgtttcgaagtacggcggatataaagctataaatggcgccttctttttcctggtggagcacactaagtccaagaaaagaattaggtctatcgaattatttcctctccatctgcttagcaagttctacgaggacaaaaacacagtgctggattatgctatcaatgtattgcagctccaggaccccaagattatcatagataaaattaactaccgaaccgaaatcattatcgacaacttttcatatctgataagtacaaagtccaatgacgggtctattactgtcaagccaaacgagcagatgtactggcgcgtggatgaaatcagcaatctgaaaaagatcgagaacaaatacaagaaagacgccattctaaccgaggaagatcggaagatcatggagtcctatattgacaagatataccaacagttcaaagcaggaaagtataaaaatagaaggacgaccgatacaatcattgaaaagtacgagatcatcgaccttgatactctcgacaacaaacagctgtatcaattgctggttgcctttatttcattaagctacaagaccagtaataacgctgtggatttcacagtcataggtctcggcactgaatgtgggaaaccccgtatcaccaatctgcctgacaacacgtatcttgtgtacaagtctattacaggaatctacgagaagcgcattcggatcaaatga

SEQ ID NO: 3014 - RNA, 4047 nt, synthetic construct
  misc_feature 1..4047: note = Cas9 variant
  source 1..4047: mol_type = other RNA
atgaagaaaccctacaccatcgccctggacattggcacaaacagcgtggggtgggtcgttgtgactgatgactatagagtacctacgaagaaaatgaaggtgctcggaaataccgagaggaaaacaataaagaagaaccttatcggtgctctgttgttcgattccggcgacactgcagaagggacccggttaaaacgcacagcccgacgtagatacaccaggcggaagaatcgcctgagatatctaaaagagatttttactgaagagatggcgaaggtcgatgacggattctttcagaggctcgaagattctttctacgtgctggaggacaaagagggcaacaagcacccaatctttgctaatcttgccgatgaagttgcatatcataagaaatacccgacaatttatcaccttcggaaggagttggtggacaacccccaaaaagccgatctccgcctgatctacctggctgtcgcacatataatcaagttccgaggtcactttctcattgaagggaccttatcaagtaaaaataacaatctgcaaaagagcttcgaccatcttgtggatacgtacaacttgctgtttgaggagcagagactactcactgaaggaatcaatgccaaagagctgctttccgctgccctgtctaagtcgaagaggttggaaaacctcatttcactgatccctggccagaaaaagaccggcatattcgggaatattatcgcgttaagcctgggactcacaccaaactttaaagcaaatttcggtcttagtaaggacgtaaaactgcagttggccaaggacacttatgctgatgacctagattccctgctcgcccagattggcgaccagtacgcagatctgtttcttgctgccaagaacctgtctgacgcgatcttgctcagcgatatcctgaccgagtccgacgaaattacacgggcccccttatcagcaagtatggttaaacgttatcgcgagcaccacaaggatctggtgaccctaaaaacgctcataaaggaccagctgcctgagaaataccaagaaatcttccttgataagactaagaacgggtatgctggatacattgagggccaggtcagccaggaagagttctataaatacttgaagccaatcctggccagactcgacggttctgaacccctgcttctgaaaatagacagggaggatttcttgcggaagcagcgaacattcgacaatgggtccattcctcatcaaatccacctcgaggaactgcatgctatcttacgcagacaggaggtgttttacccattcctgaaagataacaggaagaagattgaatcactactcacctttcggatcccgtattacgtgggacccctggcccgcggccacagcagattcgcatgggtcaaaaggaagtttgacggcgccattcgtccttggaatttcgaggaaatagttgatgaggaggctagtgcgcagatctttattgagaaaatgactaagaacgacctttatttgccaaatgaaaaagtgctgcccaagcactctctcctgtacgaaacattcaccgtatataacgagttaacgaaagtgaagtacgcaaccgaggggatgacacggcctcaatttctgtccgccgatcagaagcaggctatcgtcgaccttttgttcaaaactaatcgaaaggtgaccgttaaacagctcaaggaaaactattttaaaaagatcgagtgctgggatagcgtggaaattacaggagtcgaggactcgttcaatgcctctctgggtacttaccatgatctactgaagataatccaagacaaagatttcctcgacaacccagacaatcagaagattatcgaagatattatcctgacccttacattgtttgaggacaaaaagatgatatccaaaagactggatcagtacgcacacttattcgacaaggtggtactcaacaagctggagaggcatcactataccggctgggggcgcctttcaggaaaactgatcaatggcattcgggataagcagagtggtaaaactatcttggactttctcaaggccgatgggttcgctaacagaaattttatgcaactgattcatgacagcgaactatccttcatcgatgagatagccaaagcacaggttattggcaagacggaatactctaaggacctggtgggaaacctcgcgggcagccccgctatcaaaaaggggatttcacagacaatcaaaatagtcgatgagctggtgaagatcatgggatatcttccgcagcaaattgtcatcgaaatggccagggagaaccagaccactgcacagggtattaaaaatgcccgccagcgaatgcggaagttggaggaaaccgctaaaaagctgggcagtaacatcttaaaggagcaccctgtggacaattcccaactccagaacgataaacgttacctgtattaccttcagaatgggaaggacatgtatacaggagacgatctggacatagattacctaagctcttacgacattgatcacatcatcccccaatcatttattaaaaacaatagtatcgacaacaaggttctcaccagccagggcgccaatagaggtaaactggataacgtgccatccgaagcaattgtaaggaagatgaaggggtattggcagtctttgctgcgcgctggcgccatatcgaaacagaagttcgacaatttaactaaagcggagcggggaggcctcacacaagtcgataaggccgggtttatccagagacagctggtggaaacgaggcagattaccaaacatgttgctcaaatccttgacagccgattcaacactgagtttgatgaccacaataagcgcattcggaaggtgcatatcataacactgaaatccaagttggtctcagacttcagaaaagagtttggactctacaagatcagggatattaaccactatcaccatgcacacgacgcctacctgaatgctgtggtagccaaagcaatcctaggtaagtatcctcagctggcgcccgaatttgtgtacggcgattatccaaagtacaacagtttcaaagagcgtcagaaggccacccagaaaatgctgttttactctaacattctcaagttctttaaagaccaagaaagcctgcatgttaattccgatggggaggagatctggaacgctaataagcacttgcccataattaagaacgtcctgtcaatccctcaggtgaatatcgtgaaaaagacagaagtccagactggaggcttctataaagagagcattttatctaagggtaactccgacaaactcataccacgcaagaataactgggatacccggaaatacgggggctttgacagtccgacggttgcctatagcgtgctggtgatcgcaaagatggaaaagggaaaagctaaggtacttaaacccgtcaaggagatggtgggcattaccatcatggaaagaacagccttcgaggagaatcctgttgtgtttctggaagcaagggggtaccgagagattcaagaacatttgatcataaaactcccaaagtattctctgttcgagctagaaaacggacggcgcagactgcttgcctccgcttcagagctccagaagggcaatgagctgtttttgcccgtcgattacatgactttcttatatctggcggcccactaccacgaactcaccggtagtagcgaggacgtgctgaggaaaaagtactttgttgatcggcatcttcactatttcgacgatatcattcagatgatcaacgacttcgcagaacgacatattctggcttcgtccaatttggagaaaatcaaccacacataccataataactctgacctacctgtgaacgaaagagccgagaatataattaacgtatttactttcgtcgccctgggggctccagcagcctttaagttctttgatgcgaccatcgaccgcaaaaggtatacgagcacaaaggaggtgctcaatgctaccctgatccaccagtcagtgactggactttacgaaacacgtattgatttaagtcaactgggcgagaactga

SEQ ID NO: 3015 - RNA, 4047 nt, synthetic construct
  misc_feature 1..4047: note = Cas9 variant
  source 1..4047: mol_type = other RNA
atgaaaagcgagaaaaagtactatatcggcctggacgtggggaccaactccgtcggatgggccgttacagatgagttctacaatattctcagagctaaaggtaaggacctttggggcgtgaggctgtttgaaaaagcaaagactgccgcggatacgcggaccttccgctctgggcgacgtagaaacgacaggaagggagtacggttgcagatattacgcgaaatctttgaggatgaaattaaaaaggtggacaaagatttctatgacagactggatgagtcaaagttttgggctgaggacaaaaaggtcagtggcaagtacagcctattcaatgataaaaacttttccgacaagcaatatttcgaaaaatttcccacaatcttccacctcaggaagtacctgatggaggaacatggtaaagtggatattcggtattactttcttgccatcaatcagatgatgaagcgccgagggcacttcctgatagacggacagatctctcatgttactgacgataaacctttgaagcagcaactcattctgctgatcaacgacctcttaaagattgagctggaggaagagtttatggattcgatcttcgaaatacttgcagacgtgaatgagaaaaagaccgaaaagaagaacattttgaaagagctgatcaatgcccaggatttcaacaagcaggagggcaagattctatactcaatctttgaaagcatcgtcacaggcaaagctaagattaaaaatataatcagtgacgaggatattctcgaaaagatcaaagaggacaacaaggaagatttcgtgctgaccggggactcctatgaggagaatcttcagtactttgaagaggtactgcaagaaaacataactttgttcaatacactcaagtctgcatatgattttgttattctgcagagcatcttaaaaggaaagtccaccctgtcagacgcccaggtggagagatacgacgaacacaaaaaggatctcgagatccttaaaaaggtcattaagaaatatgacgaggatggtaagctgttcaaacaggtgtttaaggaagacaacggcaacgggtacgtgagttatatcggatactacttgaataaaaacaagaaaattacggctaagaagaaaataagcaatatcgagttcactaagtatgtcaaaggcattctagaaaagcaatgcgattgtgaggacgaggatgttaaatacctgctcggtaagatcgaacaggagaactttctgcttaagcagatctcttccattaattcagtgataccacatcaaatccacctgttcgaattggacaaaattctcgagaacctggccaagtattacccgagctttaataacaaaaaggaagagttcaccaaaatcgagaagattaggaagacatttactttccggatcccctattacgtagggcctttaaatgattatcacaaaaacaatggaggcaacgcgtggatattccgtaataagggcgagaaaatccgcccatggaactttgaaaagattgtggacctgcataaaagtgaagaggagttcatcaagagaatgctaaatcagtgcacctacctccccgaagagacagtcctgcctaagtcttccattctttacagcgaatatatggtgttgaacgagctgaacaatctcaggatcaacgggaaaccaatagataccgacgttaagctgaaacttattgaggaactgtttaagaaaaagacgaaagtgactttgaagtcgatccgggattacatgattcgaaataacttcgcagacaaggaagactttgataattctgagaaaaacctcgagatcgtctccaatatgaagtcatatatagacttcaacaatatcctgggagataaatttgaattagagatggtggaagacctgattgagaagatcacaattcacaccggtaacaaaaagctactcaagaaatacatcgaggaaacttatcccgatctgagtagctcccagatacagaagattatcaatcttaaatacaaggactggggccgcttgtctagaaaactgctcgatgggatcacaggaaccaacattgagacgggcgaaatcgacaccgtaattaatttcctgaggaacagctcagataatttaatgcaaataatcggtagtcagaactattcctttaacaatgacattgataagctgcggaagaaatacatccctcaggagattagctacgaagttgtggagaacctttatgtctctccatcagtgaagaaaatgatctggcaggtcatacgcatcacagaggaaattactaaggtgatggggtacgacccggataaaatcttcattgagatggccaagagtgaagagggcaagaaaaccacaatcagcagaaagaataaattgctcgctctgtataaggccattaaaaaggacgaaagggactcccaatacgagaagctactgactggactcaacaaactggatgactctgatcttcgttcgcggaagttgtatctgtactatacccagatgggccgagacatgtacacaggggagaaaatagatttagacaagctctttgatagcacccattacgacaaagatcacatcatcccccagtccatgaagaaagacgattcaattataaataacctggttcttgtgaataagaacgcaaatcagactacgaagggaaacatctatcctgtaccaagttctattagaaataaccccaaaatctacaattattggaagtacctgatggaaaaagagttcattagcaaggaaaaatataacaggttgatccgcaatacacctctcaccaacgaggaactgggtggctttataaaccggcagctagtcgagactagacaatccaccaaggctatcaaggagctgttcgaaaaattctacaagaaatcaaagattatcccagtgaaagccattctcgcgagcgacctgaggaaggacatgaatacacttaagtctcgcgaggttaacgatttgcaccatgcccacgacgcatttctgaatatcgtggctggggatgtctggaaccgagagttcacctccaatcccataaactatgtgaaagaaaatcgggagggagacaaggtaaaatacagtttaagcaagtactttactcgtccgagaaaatctaagggcaaggtgatttggacacctgaaaaaggtaggaagctcatcgttgatacgctgaacaaaccctccgtccttatctcaaatgagagtcatgtgaagaaaggggaactgttcaacgccaccattgctggcaagaaagactataagaagggaaaaatctacctaccactcaagaaagatgaccgcctgcaggatgtgagcaagtatggcgggtacaaagccataaatggagcatttttctttttggtcgagcacactaagtcgaagaaacggattagatccatcgaactgttccctttacatctcctgtctaagttttatgaggacaaaaacacagttcttgattacgccattaatgtgctgcagttgcaagaccccaagatcataattgataaaatcaactataggaccgagatcattatcgacaatttcagctacctcatttcaacaaagagtaacgacggttccataactgtgaagccaaatgaacagatgtactggcgagtagatgagatctctaacctgaaaaagattgaaaacaaatataagaaagacgctatcctaaccgaggaagatcgcaagatcatggagagctacattgacaagatatatcagcaatttaaagcgggcaagtacaaaaatcggagaacgaccgatacaatcattgagaagtatgaaatcattgacctggatactcttgacaacaaacagctctaccagctgttggtcgcattcatctccctgtcatataagaccagcaataacgccgtggatttcacagttatagggttaggaactgagtgtggcaaacccaggatcaccaatctccctgacaacacgtacctggtgtacaagagtattacaggtatctatgaaaagcgtattcgcatcaaatga

SEQ ID NO: 3016 - RNA, 4047 nt, synthetic construct
  misc_feature 1..4047: note = Cas9 variant
  source 1..4047: mol_type = other RNA
atgaaaagcgagaaaaagtactatatcggcctggacgtggggaccaactccgtcggatgggccgttacagatgagttctacaatattctcagagctaaaggtaaggacctttggggcgtgaggctgtttgagaaagcagatactgccgcgaacacgcggatattccgctctgggcgacgtagaaatgacaggaagggaatgcggttgcagatcttacgcgaaatttttgaggatgaaatcaagaaagtagacaaggatttctatgacagactggatgagtcaaaattttgggctgaggacaagaaagtgagtggcaagtacagcctattcaacgataagaatttttccgacaaacaatatttcgaaaagtttcccaccattttccacctcaggaaatacctgatggaggaacatggtaaggtcgatatccggtattactttcttgccataaaccagatgatgaaacgccgagggcacttcctgatcgacggacagatttctcatgtgacagacgataagcctttgaaagagcagctcatcctgctgattaatgacctcttaaagatcgagctggaagaggaacttatggattcgatatttgagattttggcagacgttaacgaaaagagaactgataaaaagaataacctgaaagagctaatcaagggccaagacttcaataaacaggagggcaacattctcaattcaatcttcgaaagcatcgtgaccgggaaggccaagattaaaaacataatcagtgatgaggacattctggaaaagatcaaagaggataataaggaagactttgtccttacaggagattcctacgaggagaacctgcagtatttcgaagaggtgttgcaggaaaacataaccctctttaatactctgaaatctacatacgacttcttaattctgcaaagcatcctcaagggtaagtccaccctttcagacgctcaggtagagaggtatgatgaacacaaaaaggacctggagatcttgaaaaaggttattaaaaagtacgatgaggacggcaagctatttaaacaggtgttcaaggaagataacgggaatggatatgtcagttacatcggctattacctgaacaaaaataagaaaattacggcaaagaaaaagataagcaacatcgagtttactaagtacgtgaaaggtattctcgaaaagcagtgcgactgtgaggatgaggacgtgaaatatctgcttgggaagatcgaacaagagaatttcctgttgaaacagatctcttccattaactcagtcataccacatcagatccacctctttgaactggataagattttagagaatctggccaagaactacccgagcttcaataacaaaaaggaagagtttaccaaaatcgagaagattcggaaaacattcacttttcgtatcccctattacgttggacctctaaatgactatcacaagaacaatggcggcaacgcttggatattccgcaacaagggggaaaagatcagaccatggaatttcgagaagattgtggatctccataaaagtgaagaggaatttatcaagaggatgctgaaccaatgcacctaccttcccgaggagacagtattgcctaaatcttccattctgtatagcgaatacatggtgctcaatgagctgaacaatcttcggatcaacggaaagccactggacaccgatgtcaagttgaaactcatagaagaactgttcaagaaaaagacgaaagtgactttaaagtcgattcgagactacatggttcgcaataactttgccgacaaagaagatttcgacaattctgagaagaacctggagatcgcgtccaatatgaagtcatatattgattttaacaatatcctagaagacaaattcgatgtggagatggtcgaagacctcatagagaagatcacaattcacaccggtaacaaaaagctgcttaaaaagtacatcgaggaaacttatcccgatttgagtagctcccagattcagaagatcataaatctgaaatacaaggactggggcagactctctaggaaactgttagatgggattaagggaacaaagaaggagaccgaaaagacggacaccgtgatcaactttctgcggaacagctcagataatcttatgcagatcattggcagtcaaaactattccttcaatgagtacatcgacaaattgcgcaagaaatatattcctcaggaaataagctacgaggtagttgagaacctctacgtgtctccatcagtcaagaaaatgatctggcaagtgattagagtcacagaagagatcactaaggtgatgggttatgatccggacaagatttttatcgaaatggcaaaaagtgaggaagagaagaaaaccacaataagcaggaagaataaactgctagacctgtacaaggccatcaagaaagatgagcgtgactcccagtatgaaaagctcctgactgggcttaacaaattggatgactctgatctgcggtcgcgaaagttatacctctattacacccagatgggcagagacatgtatacaggagagaaaattgatctggacaaacttttcgatagcacccattacgacaaagatcacatcattccccagtccatgaagaaggacgactcaatcataaataacctggttttggtgaataaaaacgctaatcagactacgaagggcaacatttaccctgtaccaagttctatcaggaataaccccaaaatctataattactggaagtatctcatggaaaaagagtttattagcaaggaaaagtacaaccgcctgatacggaacacacctctaaccaatgaggagctcgggggattcatcaacagacagctggtcgaaactaggcaatccaccaaagccattaaggagctgtttgaaaaattctatcagaagtcaaaaatcattccagtgaaggcaagccttgcttctgatttgcgcaaggacatgaatacactgaaatcccgagaggttaacgatttacaccatgcccacgacgcgttcctcaatatcgtggccggtgatgtctggaaccgggagtttaccagtaatcccataaactacgtgaaggaaaatcgtgagggcgacaaagtaaagtatagcctgtctaaagatttcactagaccgaggaagtccaaggggaaagtgatctggacacctgaaaagggacgcaaacttattgttgacacgctgaacaagccctcagtcctaatcagtaatgagagccatgtgaaaaagggcgaactctttaacgcaaccattgctggtaaaaaggattacaagaaagggaagatctacctgccattgaaaaaggacgatcggctgcaggacgtgtcgaaatatggcggatacaaggccataaatggcgctttctttttcttagtcgagcacactaagtccaaaaagagaattaggtctatcgagctctttcctctgcatcttctgagcaaattctatgaagataagaacacagttttggactacgccatcaatgtgctccagctgcaagaccccaaaattatcatagataagattaactatcgaaccgagatcattatcgacaatttttcatacctaataagtacaaagtccaacgatgggtctattactgtgaaaccaaacgaacagatgtattggcgcgtagacgagatcagcaatctgaagaaaatcgaaaacaagtacaaaaaggatgcaattcttaccgaggaggaccggaagatcatggaatcctacattgataaaatatatcagcaattcaaggccggaaaatacaagaatagaaggacgaccgacacaatcattgagaaatatgaaatcatcgatctcgacactctggataacaagcagttgtaccagctgttagtcgcttttatttcactcagctataaaaccagtaataacgcggtggacttcacagttataggtctgggcactgagtgtgggaagccccgtatcaccaatcttcctgataacacgtacctggtgtataagtctattacaggaatctacgaaaaacgcattcggatcaagtga

SEQ ID NO: 3017 - RNA, 4047 nt, synthetic construct
  misc_feature 1..4047: note = Cas9 variant
  source 1..4047: mol_type = other RNA
atggagaagaactactatctgggcctcgaccttgggagcaattccgtgggatgggccgctaccgatgaagactacaacttcctgagattgaaaggtaagacagcatggggcgccaggatcttttctgaggcgaaagattgcaaggaacggcgcacttatcgatcaaataaacgtagattagctaggcggaagtaccgcctggtcctactcaagcagctgttcgccgaggaaatgacgaaagttgacaagacctttttccttagactggcaaacagtacatattgggaggaggataaaactaaggacagcgatgggaatgaaattggcaaaaacttgatatttaagacccacgaggaagagaagcaatactatacaaaataccccaccatctggcatctcaggaaggccctgattgagaatgacgaagaggctctgtccaacctccggtacgtgtatttagcaatccaccatattgtaaaataccgcggaaatttcctgactgaaggtgagatggggaacgatatccctccaataacaaccatcgaagagattaatcagacgctttctttgctggaggtggactcgtcagaagatgccactgacaagaccacatatatcaaaccggagagctacaacgaactatttactattctcgagaataacaatctgaacaaggtcaaaaagcagcaggaaatcgataaacttttcataagttccaaagagcgatctgagaacattaagaattatatcaacctgtttaaaaccattatcgtgggaggcagcttctccttgaagaaaatcaatgaagacacagaggacatttcagttgattttaccaaggacttcgaaaacagtgaggctgatataagcaaggccctcggcgactcttttaatctggtgttaatcgcgaaaaagtactatgattacattatcctgaaagaactccttgggaagaacaaagagatatccgaggcaatggtccaaatttacgaagaacacaaggacgatctgaagtcattgaaaacgatcctaaaggacctggataataaactcggaaacgacggtaaggatagaatctattacagcgtgttcaaacaggaacccactgagaagttcaaggagacaaattatctgagttttgtacagggcgggaaacttgaggagctgaacaagtacattaaaaagatcttggaaaataacgagaaagacattgacgataaggaaacctataatgccctctacgagaaggcttgtaagggagacctgttcaagaaacaggccaacgcatgcacttctttaatacctcatcaatttcacctgagggagctaaagaaaatcctcgaaaatgctggccggaagtattccttcctgaacgatattagcgacaaaatcatcaagatttttaagttccgtgttccatactactatggtccccttaacaatgagtcgaacgcccactcttgggtggtcaaaaaggaagggcaggagaaagcgaagataacaccttggaatatcaacgaaattatcgataccccaaaaacgcgcgacaactttttcaagaagttgaccaattcctgtacatacctggtgggagagactgtgctccccaaaacctcactgtattacgagaagtatcttgtcctggatagattgaataaaatgcaggttaacggcgactacctcagtgccagcgaaaagaatgatgtgctgaaatttattttatccaggaagacaactaccatcgagcagatacggacatatctgtctaagaacaaaagcaccaaggcaaatgacatctcaattagtaacatcaaagctactgatcctttcaatgccgtatcccatgctttttacggcaagcacccagacctaaacattaatctctgcgaggaactgatcaaattcgccacgatatacgcagatgacaagaaagaacttaagaagtttgtgagctctaacttcaacttgacagacgagttcattaaagagtatctgaataccccgactaacaagtgggggcgactctcacgcaaatttctgtgtggaggtgatcaattagaaatgtactatgtcgacgataatggcatcctgcatagtattcttaacatcttggaggaaaccaatgagaacctccaggagatactgaataacgaaaagtacgggttcaatcagaaaatcgccgactttaacaatacactaaccgctgataagactacagaggaacaaattgaggacatcctggatagcacgcccgcgctcatgagaaggtccattatccagaccctggcagtggttgacgatgtgataaaggccgctggaaaagcccctcagaagattatgatggaagtcactcggacagacggcaaaaaggaggagaccaaatctcgctatgtgcagcttaagaagcaaatcacaaacgataaagtattgacttcggacgaaaagaaagagctgttaaccaatctcgaaaacaagaaaatccagctgaagggtaagcacatttacctttatttcatgcagatggggatcgatttttacacgggcaaaattatggacataaatgacgttatcaacggaaagtacgatattgaccacatcattccacagagcatgatcaaagatgactccctggataacatggtgttggtctcaaaggactataatcaaaaagtgaagaaggatatataccccatctgcgacgagattagaaacaatatgctcgataaatggaagggctattacgcaaggaaaatcattagtgaagagaagtataaccgtctgaaacggaccaaggagctaaatgccgacgaaatcaacgctttcataaatcgacagattaacgtcgtgaattactctaacatccagatcaaaagaatttttgagataaagtatcctgaaacaaagatcattttcagcaaagcctcctttccatcactgctcaggaaggagtacgaaatcgcaaaaatgcgcgatctgaatgacgcgcatcacgctgttgacgcctaccttaacattgtgtgtgggaatatcttgactaccctgtatacagatatattctacatgtttaaggagaaaaaggaggaccataagaacatcagcttcaatatggaaaaacggttaattaactatatcgataagaataacctcaaagacaagattaaaacttcttgcctgagacacgatgcacttatcacctacaagcccgactatgattccggaaagttttacaaagagacgatattcaagaaaagtggtgacaaggaaacaggcctgattccgctacataccaaagggcctatgagcgatactaagaagtatggaggctactctcagctctcccaatcatacatcatcgccgtagagtataaactgaagaacaaaacagtcaagaaattgtgtagggtgcccaccctgtacttaaagcagtataaaaatgacctcaacactattgctaagatcatgatagatgacgagaaggccaccgatattaaagttctgcgcaagatctaccttaatcagaaaattcgatataacggttgctactatctgatctacacaagtaaggaaaaacagaataagtacaagatggcatatcaaaactacttggacaatgactatctcatatacctgaacaaatgtctaaagaaaattgatgagctggacgatggggaacttacgagccaggagttcatcgtgaataaggacggcgataaatttctcatcgacaagaaccacaatctggaaattttcaagtcgatcaaagagcagtataacaagaccatttacgattatactccatacatagtccaatcccgggagatgaaagaagaggactttaataacttgtctctgaagaaacagatcgatacattactcaatatgattaagatcctgagccgttcaaacgaacaggctaagttcgagaccgcctttttcgaaaactttacaaaagtgttccttaagactatgaccatcacgaatgagaaagtatacattgtgaacgagagtccttccggactgtttaagggcaaagaagagttgatatga

SEQ ID NO: 3018 - RNA, 4047 nt, synthetic construct
  misc_feature 1..4047: note = Cas9 variant
  source 1..4047: mol_type = other RNA
atgaagaaattcgaggactactatctgggcctcgatcttgggaccagctccatcggatgggccgtgacaaacgaaaagtacgacattctgagatttaataaaaagttcatgtggggtactcacttgtttgatatgggcaacacggcttctgagaggcggatattccgcacctcacgacgtagattaaaaaggaagaagaatcggatcgaactgctacagacactctttagtgcagagatgagcaaaaaggacttcgggtttttccaacgcctgaaagaatcccagtattttattgaggataagactttcaaaaacaagaataccctttttatggacgagaactacacagatcaggactatcatatggaataccccaccatctatcacctgagaaaggccttgattgataatgaggaatctgcgttcgagatcaggaaactctacctggctatatcgcatatcctgtcacaccggggacattttctcttcgagggcgaattaagcgacaacctggatttcgacgatatttttaatgagttcgtcaagtaccttaacgaagagttgaatatcgactttaaaattaagagtgacgtttccctgcaggccatcaaagaaatactaactgataagatgctcaaccgcaccaaaaagaaggagaaactgtctgagcttctggaagaggaaaagaataaaatttatcaagagatctggaagttgctcgtgggtaacgaagcaaaaatgagcacaattttcgacgataaggagtacgaggaagccaagatcgctttttccaaagggaattatgacgagaaggaagaggaatacgagtcaatcctgggagagaaaattttattcgtacagaaggcaaaagccatatatgattggatgctgctccagaacatccttaaggaagacaagtacctgagttatagcaaagtgaagttgtacaacgagcacaaaaaggatctaaaaattctgaaggacgtcctcaagaatctggataaaaagatctacaaagaaatattttctgagaacggcctttatgaggaatacctgcgaattgagaagaaaaagatcggctccaaagaagagaagacgaaggacatcttgtataatagactcaaaaagattttcgaaaacagggataatatggctatcgaggacattctgaacaaaatagagttagactcatttctgcctaagcagaaaatcaaggataatggggtgattccacggcaagttcaccagaaggaactagagatcatcctcaaaaacgccgaaaagtacttcaaatggctgattgagaaggacgaaactggacttagcgtgagtgagaaaataatgaagatctttaagttcaaaattccgtattacgtcggtccccttaattctaagtccccttttgcgtggatcgagcgtaaagaatatggcaagattctgccatggaacttcgagaatatggtggatatgagcaaaaccgcagaaaagttcatcaagcgcatgacaaacaaatgcacttacctccccgagaaggacgtaatacctaaaaattcgctgctttacaccaagtatatggttctgaacgaattgaataacctcaaaatcagaggggagaagattaaagtggagctgaagcagaagatctacacagaattatttcagaaaaacaagaaaattggaatgaagaccctgatcgagttcctaaaatctcaaaatatagtcgtgacgaaggtggaaattactggcatcgatggtacatttaacacctccctcgggtcatatattgacatgaagaaaatcttcggagaggagaagatagtcaaagatagttacaagaaaatgatcgaagacattatcctgtggattactctttatggcgaggaaaagaagttgatcaaaagcaagatagaggaaaaatacccagagaaggttacacccgaggaaatgaaactgattctcaagctgaagtatagggattggtcccggttatctaaagagtttctgaccgaaatcgagacgatggacgaagagaccggcgagcttatcagcattatcgaaatgttgtggcgaaagaatgagaacattatggaactcctgtcatacaaatacgatttcagtaatcgcataaaggagtataacgggatcaatgaaaaagagaagaacattacatacgaggacctagtgaaggatctgcagatctcccctagcgtgaaaaagatgatttggagagccctcgtaatcgtcaaagaaataaagaaagtgactaataagtctccgaaaaaggtttttatcgagatggctagggacacccagacagaaaagaaacggactgagaagcgcaaagacaagctgcttgagttgtataaaaacattaagaatgatgactcaatcaaggaactggagaaaaacttaaaggataaaaccaatgacgatctcaagagtaaaaagctgtacctttattacctgcaattgggaagatgtatgtatagcggtgaagtgattaggctcgaggacctgatgaacgataatctatacgacatcgatcatatatacccacagtccaagattaaagacgattctttcgacaacacagtcctggtgaagaaacagatcaacgccgataagaccaatgaatatcccatcgacaaatcgattcagaacaagtgcaaggcattttggactagcctcaaagagcgtggcctgatgtccaatacgaagtacgagcggcttacacgaaccgaagggttctcagacgatgagttggctggatttataagtagacaaatcgtagaaactaggcaggccaccaaagttctggcggacttactcaaggtgattttcggctctgatacacgcatcgtctatgtgaaagccggtctgaccagcgactttcggcagaagttcgggatttacaaattcagagagcttaacgattatcaccatgcacacgacggctacctgaatatcgtcactggaaacatatataatacactatttacggataacccttacaatttcatcaaggacaggaagaaagataaccgcacctacaatctcaacaaggtgtttgaacgagagaatgacgtttggaacccagatgtgatgctgtccaaaattgagcggtatatctacaagattcgtcccttgttcactagagcttcatatgaacagaaaggcgggtttagcgaccaaaatatctcttccgagaaggacaagctgaggcctttaaaaagtagcggagtactctctaacataaagtacggtggctatgataaaattaagaactcctacttctttatcgtcgaatatacagagaaaaagaagcgcgtgcggtcaatcgaaaccctgccaatttacatcaaaaagagtataagcacaaaagaggaccttgagaagtactgtaaagaagaactgaagttgcaggaacccaaggttctcgtgtcgaaactgaattataagtccctaatttactctaacgggcacgagtattacatcaatagcaaaactgccgattcaattaccatccagaacggaatacagattatcctgacgaaggagaattatgaaacctacagaaaaatctataagaaccttgagtacctcaaactgatttacaaggacgaaaagatcagggaggagaaaattttggagaagataccgaaaatcctgaagaataacaaaaatgatcgagacttaagtgaggatgaaatttccgagaagttctggaagctctataaagaaatctttgagaagatcaaaattggcatattctctaagtttaaaagcacactgcctatctacattgaagactgcaagaagttgaaagatttcactaccctgaacaattatgctaagtcccgcttcatccaagagattttgaaatgtctcaactcacagcagggtgagtttgacacaaagtacactcataattatagcaaaaagtacaacaccaagctgagtaaatctaagatcctagaaaatgatttctatataatcaaccagtcccccacggggctgtttgagaaaaaggtcttccttgacaaatga

SEQ ID NO: 3019 - RNA, 4047 nt, synthetic construct
  misc_feature 1..4047: note = Cas9 variant
  source 1..4047: mol_type = other RNA
atgggcgaggacgggaagcccctgagagtgaaaggaaagaccgccatcggtgctaggcttttccaggaaggcaaccctgcagccgatcggcgcatgtttcgaacaactcgtagaaggcttaatcggcgcaaatggagactgaagttgttagacgagattttcgatccatacataacgccggtcgacagcacctttttcgcgaggctgaaacaatccaacctatctcccaaggattcacggaaggaatttaaagggagtatgttattccctgacctgacagataagcagtatcaccttgactacccaactatctatcatctgcgccacgctttgatgacccaggataaacagtttgacattcgaatggtttacctcgccatccatcacattgtgaagtatagaggaaatttcctgaacagcacacccgtagattcctttaaagcatctaaggtgaatttcgacgatcaatttaagaaactgaacgagctctacaccgccatcaatcctgaagagtcgttccagataaacttagctaattcagagaagatcggccagcagtttctggacccaagcattaggaaattcgacaagaaaaagcaaatccccaaaattgtccctgtgactatggatgacaaggcagttgataagctcaacggtaaaatcgccagtgaaataattaatgctatcttggggtataagtccaaactggacgtggccgtccagtgcgatccagaggactctaacccgtgggcggtgaagttcgatgacgaagatattgacgcaaaactacagaagatcctccccgagatggatgagaatcagcaaagcatcattggaataatccaggacctgtactcccaggtaacacttaaccaaattgttcctaatggcatgtcactgagtgaaagcatgatcaagaaatacaacgaccatcacgatcacttgaagctctataaaaagctgataggccagatttctgactccaaaaagaagaccgccctcaaaaaggcttacgatcagtatgtggggaacgacggaaaagtcatcgagcaggatgacttttactcaagcgtgaagaaaaatctggatgacagtgaactctctaagcaaatcatggatcttattgacgccgataagttcatgccaaaacagcggacgtcccagaacggtgtgatcccccatcagctgcaccaacgtgagttggacgaaattatagagcatcagagcaagtattacccttggctagcagagtcgaatccaaacaaacacgatctgcacctcgctaagtataaaatcgaagaactggtcgcctttcgcattccctactacgttggcccgatgatcactcctgaagaccagaagaaatctggggcggccgtgttctcctggatgaagagaaaggagcccggacagatcaccccatggaattttgacgaaaaagtagataggatggagtcagcaaacaagttcattaaacggatgacaactaaggacacctatcttataggcgaggatgtgctgcctgacgaaagtttgctctacgagaaatttaaggtcctgaatgaattaaacatggtgcgagttaatggtgatagcctgaaggtggctgacaaacaagccatctatcaggatctattcgagaactacaagcatatttccgtcaaaaagctccagaattatatcaaagggaagacaggactgcccaacaatccagaaatttctggccttagcgaccccgatcagtttaacaattcattgggcacctacaacgacttcaagaaactgtttggggataaggtggacgatcctgacctccaaaacgacttcgagaaaatcgtagagtggagtacggtttttgaagataagaaaatactgcgcgctaaacttaatgagatcacttggctgacagacaagcagaaggatgacttggaatccagcagatatcagggatggggtaggctctctaagaaactgttaaccggcattgtgaacgatcaaggggagcggatcattgacgagctgtggaatactaacaagaatttcatgcagatccagtcagatgacgatttcgccaaacgcatacacgaagcaaacgccgaccagatgaagagtacaaatatggaggatgtcctagctgacgcgtacaccagcccacaaaacaaaaaggcaattagacaggtggtcaaggtggttgacgatatccagaaagccatgggaggcgtggctccgaagtttatttccatcgagttcacgaggtctgaggaccgtaatccccggcgaaccatatcgagacagaggcaactcgaaaacacactgaaagatactgccaagagccttgtaaaatccatgaatcctaacatcttgtcagagctggacaatgcaagtcgctctaagaagggtctcaccgatcggctgtacttatattttacacagctggggaaagacatgtacactggcgagccaattaacatcgatgaaattagcaattatgacatcgatcatatacttccccaggccttcattaaggacgattccttgtcaaacagagtcctcgtgagcaaagctgttaacaatggaaagtctgccaacgtgcctctgaaactatttggcgcaaagatggggcacttctggaagcagctggcggaggctggactcatcaataaacataagctgaaaaaccttcaaaccaatccagacacaatctccaagtttgccatgcacggtttcattaggcgccagttggtcgaaaccagtcaggtgatcaaactggtagcaaacattttaggcgataagtaccgaaatgacgacactaagataatcgagattacggcccggatgaaccaccaaatgcgtgatgaatttgggttcatcaaaaatagagagattaacgactatcatcacgcttttgatgcctacctcacagcattcctgggaaggtatctttaccatcgctacatcaagctgcggccctattttgtgtacggcgacttcaaaaagttcagagaggataaagttaccatgaggaattttaacttcttgcacgacctcactgatgacacccaggctcgaatagccgatacagaaaccggtgaggtcatctgggaccgcgaaactagcattaagcagctgcgggatgtgtatcactacaagtttatgctaatctctcaggaggtgtatacactgagaggggcgatgttcaatcaaacgatttacccggcctcccaggctggcaggaaaaagctcatccctatgaaagcagacaagccagtcgatgtttatggaggctactcagggagtaccgacgcctacatggctatagtgcgtattcatgacaaaaagggagataaatataaggtggtaggtgtccccatgcgcgccctgaaccggcttaatactgcaaagaacgtgagcgacgcgaaatacgatcaggaattgaaggaggttctgacacctcagtttaccaaatcgaagaaaaacagaaagacaggcgagatcactcaaaccgtggaagacttcgaggtcgtgttagggaaggttatgtataggcagctcgtgatcgatggagacaaaaagtttatgctgggctcctctacgtaccagtataatgccaaacagcttgtactgagcgatgaatcaattaagaccctagctagtgagggtaaactcaacgaggcccaagaatccgcagcttacgacaaggtctatgatgagatactggacaaggtgaataaatacttcgccttgtacgatacaaacaagtttcgacagaaactgtctttagggaaggacaaattcgtgggcctccccaatcacaacgtctttgacggaagcaagaagatctcctcaggcaaacgggaaattctgaatgagatccttaacgggctgcatgcaaatgccactttgggaaccctcagcgatattggcttcagtacaccattcggtaagatgcagcagcctcgcgggatcggactgtcttccaacactagcatagaatatgagtcgtttaccggcctattcaaaagaacgatctttctgaaggacctttga

SEQ ID NO: 3020 - RNA, 4047 nt, synthetic construct
  misc_feature 1..4047: note = Cas9 variant
  source 1..4047: mol_type = other RNA
atgaagaaaccctacaccatcgccctggacattggcacaaacagcgtggggtgggtcgttgtgactgatgactatagagtacctacgaagaaaatgaaggtgctcggaaataccgagaggaaaacaataaagaagaaccttatcggtgctctgttgttcgattccggcgacactgcagaagggacccggttaaaacgcacagcccgaccacgttacaccagaaggaagaatcggctgcgctttctaaaagagattttcactgaagagatggcgaaggtcgatgacggatttttccagagactcgaagattctttttatgtgctggaggacaaagagggcaacaagcacccgatcttcgctaatcttgccgatgaagttgcataccataagaaatatcccacaatttaccacctgaggaaggagttggtggacaaccctcaaaaagccgatctccggctgatctatctggctgtcgcacatataatcaagtttcgcggtcacttcctcattgaagggaccttatcaagtaaaaataacaatctgcaaaagagctttgaccatcttgtggatacgtacaacttgctgttcgaggagcagcgactactcactgaaggaatcaatgccaaagagctgctttccgctgccctgtctaagtcgaagagattggaaaacctcatttcactgatcccaggccagaaaaagaccggcatatttgggaatattatcgcgttaagcctgggactcacacccaacttcaaagcaaattttggtcttagtaaggacgtaaaactgcagttggccaaggacacttacgctgatgacctagattccctgctcgcccagattggcgaccagtatgcagatctgttccttgctgccaagaacctgtctgacgcgatcttgctcagcgatatcctgaccgagtccgacgaaattacaagggcccctttatcagcaagtatggttaaacggtaccgtgagcaccacaaggatctggtgaccctaaaaacgctcataaaggaccagctgccagagaaatatcaagaaatcttccttgataagactaagaacgggtacgctggatatattgagggccaggtcagccaggaagagttttacaaatatttgaagcccatcctggcccgcctcgacggttctgaacctctgcttctgaaaatagacagagaggatttcttgaggaagcagcggacatttgacaatgggtccattccacatcaaatccacctcgaggaactgcatgctatcttacgacgccaggaggtgttctacccgtttctgaaagataacagaaagaagattgaatcactactcaccttcaggatcccctactatgtgggacctctggcccggggccacagccgctttgcatgggtcaaaagaaagttcgacggcgccattaggccatggaattttgaggaaatagttgatgaggaggctagtgcgcagatcttcattgagaaaatgactaagaacgacctttacttgcccaatgaaaaagtgctgcctaagcactctctcctgtatgaaacatttaccgtatacaacgagttaacgaaagtgaagtatgcaaccgaggggatgacacgtccacaattcctgtccgccgatcagaagcaggctatcgtcgaccttttgtttaaaactaatcggaaggtgaccgttaaacagctcaaggaaaactacttcaaaaagatcgagtgctgggatagcgtggaaattacaggagtcgaggactcgttcaatgcctctctgggtacttatcatgatctactgaagataatccaagacaaagattttctcgacaaccccgacaatcagaagattatcgaagatattatcctgacccttacattgttcgaggacaaaaagatgatatccaaacgactggatcagtacgcacacttatttgacaaggtggtactcaacaagctggagagacatcactacaccggctgggggaggctttcaggaaaactgatcaatggcattcgcgataagcagagtggtaaaactatcttggacttcctcaaggccgatgggtttgctaaccggaatttcatgcaactgattcatgacagcgaactatcctttatcgatgagatagccaaagcacaggttattggcaagacggaatattctaaggacctggtgggaaacctcgcgggcagcccggctatcaaaaaggggatttcacagacaatcaaaatagtcgatgagctggtgaagatcatgggataccttcctcagcaaattgtcatcgaaatggccagagagaaccagaccactgcacagggtattaaaaatgccaggcagcgcatgcgaaagttggaggaaaccgctaaaaagctgggcagtaacatcttaaaggagcaccccgtggacaattcccaactccagaacgataaacggtatctgtactatcttcagaatgggaaggacatgtacacaggagacgatctggacatagattatctaagctcttacgacattgatcacatcatcccacaatcattcattaaaaacaatagtatcgacaacaaggttctcaccagccagggcgccaatcgtggtaaactggataacgtgccttccgaagcaattgtaagaaagatgaaggggtactggcagtctttgctgagggctggcgccatatcgaaacagaagtttgacaatttaactaaagcggagcgcggaggcctcacacaagtcgataaggccgggttcatccagctgcagcttgtggaaacgcggcagattaccaaacatgttgctcaaatcctggacagcagatttaacactgagttcgatgaccacaataagaggattcgaaaggtgcatatcataacattgaaatccaagctcgtctcagactttcgcaaagagttcggactgtataagatccgggatattaaccactaccaccatgcacacgacgcctatctaaatgctgtggtagccaaagcaatcctgggtaagtacccccagcttgcgccagagttcgtgtatggcgattaccccaagtataacagttttaaagaaagacagaaggccacccagaaaacactcttctactctaacattctgaagtttttcaaagaccaagaaagcctgcatgttaattccgatggggaggagatctggaacgctaataagcacttgcctataattaagaacgtcttatcaatcccacaggtgaatatcgtgaaaaagactgaagtccagaccggaggcttttacaaagagagcattctctctaagggtaactccgacaaactgataccgaggaagaataactgggatacgcgtaaatatgggggcttcgacagtcccaccgttgcctacagcgtgcttgtgatcgcaaagatggaaaagggaaaagctaaggtactgaaacctgtcaaggagatggtgggcattacaatcatggaacgcattgcctttgaggagaatccagttgtgttcttggaagcaaaagggtatcgggagatccaagaacatctcataatcaagctgcccaagtactctctatttgagctggaaaacggaagaaggcgacttctcgcctccgcttcagagctgcagaaaggcaatgagttgttcttacctgtcgattatatgacttttctgtacctcgcggcccactatcacgaactgaccggtagtagcgaggacgtgcttcggaagaaatacttcgttgaacgccatctgcactacttcgatgacattatccagatgattaacgattttgcagagagacatatcttggcttcgtccaatctagaaaagataaaccacacatatcataataactctgacctgccagtgaacgagagggccgagaatattatcaacgtattcacttttgtcgccctcggggctcccgcagccttcaaatttttcgacgcgaccatcgatcggaagcgatacacgagcacaaaggaagtgctgaatgctacccttattcaccagtcagtgactggattatatgagacaagaatcgacctgagtcaactcggcgaaaactga

SEQ ID NO: 3021 - RNA, 4050 nt, synthetic construct
  misc_feature 1..4050: note = Cas9 variant
  source 1..4050: mol_type = other RNA
atgaagcagaaattctacgtgggcctggacatggggaccgccagcgtcggatgggctgttacagatgacaagtataacatcattaaaagacacggtaaggcactctggggcgtgaggctttttaaaactgccaatacggcggaggaacggcgcatattccgagctgcccgtagaaggacccaacggcgcaagcagagaatggagctgttgcaggaaatctttggggatgagatttccaagacagacatcggattctaccagaggatgaaagaatctaagtattggtttgaggataaacgggacattaacggcaagcaacccgagttaccttacgcactgttcgtagatgacggttttactgataaagactatcatgaacagttcccaaccatctttcacctacgcaatgtgctcgtcaacgagtggacacagaagtacgatatacgactggtgtatcttgccatccatcacattatcaagcatagagggcacttcctgtttgaaggaaagaagatgtcagaggttaccgacttcggcagtgcttttgaggcattctgcaaagtggccagcgataatgacattgaaatcactgtcgacgaggaaaagttgaaagatatagaggacctcctgaagtccaggcagaaatctaagacagctaagaaacaagaactgggcaagattatcgccggggcggataaacagaagaaagcactcgccgctttagtgaccggatgtatggtaaagctgtcggagattttcgccgacaagtcacttgatgacggtgagcggaacaaaatcagctttgcagatagtaattacgacgaatacatcgctaacgttgaggaaacgttggccgagcgtttcctgctaattgcggccggcaaggcactctatgattgggctgtgctgtccgacatacttgaagggtctacttacatcagcgaggccaaagtcaagatttataaaaagcacggagatgacctgcgcaagttgaaaggcctcctgaagaccagaccggacgagtacaaattaatctttggtctgcccgaaaagcaggctaattattccgcctacatagggatggtgaaaaagaacggaaagaaagtgcctattgataagaaatgcacaaaggcagacttctattcatttctcaaaaagactcttaataaaatcaacttcgaggatgaaaaggagagggaaatcgccgagagtattatcaatgagattgaaaacgagacctttctgccaaagcaggtcataagcgacaatggcgttatcccctaccaattgcatgaagctgagctagatcggattctgaaaaacgcggcactctactatcctttcctgtctgagaaggacgatgaaggctacacaaacatggacaaaatcaaggccatctttaaattccgcattccatattacgtggggccccttaatacctatcactccgataagggaggtaactcatgggctgtacgaaagcaggacggcaaaatatacccttggaattttgagagcaagatcgatgccggggaaagtgcaagaaaattcattggaaggatgacgaacaagtgtacttatctgatcggcaaagacgtgttgccaaaggagtctctcctgtactccaagtttatggtcttaaatgaactgaacaatctacggattgatggtgagaaagtgagcgttgagatcaagcaggccgtgtacgaaaacgtcttcaaaaagtatcaacgcgtgacagggaaaaaggtaaaggacttcctcataagatcgggcatcattggaagggagcaggaactgtctggctttgaccagaatttcaaatcctcacttaaggcttaccatgatatcaaacagattgccggggacatcaacttgagtcaaaatcagaaggaggatataattaaagaaatcaccgtttttgcagacagccagaagatgctgaaaaagcgtctcaagattaaatatccggagctgtccgataaacaggtgactaaacttgcggctaagaaatacacaggatggggtcggctgtctcgagagttcttggaagaggtcgaaagcgtgaacaaggagaccggcgaagtcctcaatatcatatcagccctgtgggagacgaacgagaatttaatgcaactgctaagtaacaagtatgactacctctccgaaatcaaaagactgaacgatgaggcagaagacaagagcgaggtggttacctatgatgacgtgcagaaactttacgtatctcccgccgtcaagaggcctgtgtggcagacattgaaaattgttgaggaaatctcaaagattatggggagtaagccagagcgcatctttgtggaaatggctcgggagcccggacagaaaggcgatgtcaaggtgagcagaaaatccaggctgctcgaaaagtacaaatattgcaagaaggaggcccctgagatatacgaaaatctggtaaaagaggacgataacaagttacgctctgacaaactgttcctttattacactcaaatgggtcgatgtatgtattcgaatgaagtgattgacatcgaggatttgtttaccaaccggtacgacatcgatcacatttatccacagagcaaggttatggacgattccctcgacaatcgtgtcctggtgaaaagagaactaaactcaaataagacagatgtgttccccgtcccgaaggagtacatggacaaagcaaagactctgtgggatatgctcaaaaagaaagacctgatcagtaaggagaaataccacaggcttacccgccgggatgggttttctgaaaacgagttgagcggcttcattgctagacagctggttgaaacaaggcagtccaccaaggccgtgactcaattactcacgaaggcgtatcctgagtcagaaatagtgtacgccaaagctaatgcagtaagcgagtttcgacataagttcggatttacaaaagtccgctctatcaacgactatcaccatgccaaggacgcttacctgaatattgtggttggcaacacctattacgtgaaattcactaaggatgccgcatggttcatccggaataaccccgggagaacctataatcttaagaaaatgtttgagcagggaacagtctccaggggtggcgaaaccgcgtgggtgagtggggaggacggaactattttcacagttaagcgtgtgatgggcaaaaacaacatcctgtttacgcgcaaggcctacgaagtacggggtgggttgttcgatcagcaaataatgaaaaagggcaagggacagatcccagtcaaaaataacagcgaggacgatagactctgcgctaccgagaagtacggcgcctataataaagcatctggggcttactttatgctggtggaatccgaggacaagaaaggaaacaagattaggactctagagttcgtgcctgtctatctggccaaggaactcgaaaaatcagaggatgcagccatccgatactgtgttgagaagctggaacttaaaaatcccgacgtgcgggtacgcaagattaaaatggatagtttgtttaacgtggacggcttcagaatgcacctgagcggtaggacagggaagcagttaatctttaaatgcgctgagcagctcgtcctggatgaagagtcgcaaaagatacttaagaaaaccgcgaaggtgttcgccgactataaagaaaataagaacattaaaatctccgataagatcgagctgacagacgagatgctaattaagctctacgaactgttttataaaaagttgaaagacactgtttacaatatacggctgtctacccaggtgaagacgttagagagcggaaaagaaaagttcgagaagctctcactgcttgataaatgtctggtcatcgaagagattttgcatctcttccagtgccagagtgtggcagctaacctgtcctctatcggcggtgccgccaccgctggcattctagttctgaataacgagatcagccgatgtgggaaggtggaaataatcaatcaatccattacaggattttacgagcaggtcatcgaccttaaaaacatttga

SEQ ID NO: 3022 - RNA, 4050 nt, synthetic construct
  misc_feature 1..4050: note = Cas9 variant
  source 1..4050: mol_type = other RNA
atgcagaagtactatctgggcctcgacatcgggaccaacagcgtgggatgggccgtcacagatgagaattacaacctttgcaaattcggtggcaagagaatgtgggggattaggctgtttgacggagctcaaactgcagaagaacggcgcatgaatcgatccaaccgtagaaggttgtctcggcagaaacagcgcatagatttactgcaggaactattcgccaaggagatcgcgaaagttgaccccacgtttttcattagactcaatgaatcaaggctgtatatggaggataagagtaccggcacaaagtttcctcttttcgctgacccaggttacactgataaagagtattacaaggaatatccgaccatctaccatctgcggcaagagttgattaaaaaccccgaaagccacgacatccgcctcgtgtacctggcctgtcaccatatactgaagaatcgagggcactttctcatcaacggatccttctctgatttaaagaatctgtcgtttgtatgcagagagatgcttgacgcattcaacgagttgtcaaagtatcagctgatgattagcgatatcgacgccctagaaaagattctcagtgataggaaacagcagaagtccgctaaagtgaaggagctggtccaaatctttgaatgtgtgcctcgggaggacaaatctgacgcaaagatatgcaaagaaattcttagcaatctgtgtaagttcttggttggcgccaagggcaacatcacacgtctctttgataccgacttcgatgagatggagacttcctcattcagttttggggacagcaaatacgaagattctctgttaccatccctggaggaaaattatcccgactacgctaacgtgattcagaagatcaaagccatgtatgattggtcagtcctcgtggagatcatggcgggagaaaattaccttagcttcgcaaaggtaaacgcctataaaaagcataaggagaacctgagtattttgaaatctctaatgaagaaatactgcacacctgacgtttaccagcgctttttctatgagaccgatgaaaagtccagctacggtaattatataggcgctatccacaacaatgggcactcgcatacgatgaaaaagtgtgacgaggaaactttttacaagtctctgtccaaaattctcgataagctggtggtccagaaaaccgaccaagacacacttgagatcctgaagaaagaagccaagaaccagactttgctcccactggcaagaaccaaggctaatggagtgatacccaaccagattcacatccaagagttaagggccatcctggataatgcgaaaacatatctatcattcctcaacgaggccgacgaatacggcaccattgcagagaagatcattcggatagctaaatttaagatcccttattacgccggtccactgagtacgcgacataaagaacagggggctaatacttggattgtgcgcaagcaggagggaagaatctacccgtggaacttcgaggaaatggtcgatcttgagaggagcaataacgaatttatccggcgcatgacaaataaatgcacctatttgattggcgaggacgttctgcccaagaactccctcctgtactctaagttcatggtgcttaatgaactgaacaacttgaaaataagaggccacaagatcagcgtagagctcaaacaggagctgtataaggaattattttgtaaaaaggccaaggtgactgggaaagcactgctagtctacctcaagaaaaaggatgccgagctgacacttgaagacatttcaggattcgatgctgactttaaaagttccttgagcatctatattgatttcaagaatcacatcctgagggagcaaatagacgatggtaagtaccagtctatcgtggaaaacattatcaaatggaagaccattttcgacgttgattcaaaaatgatcgagaagctcatagcgcgtgagtatcctaatatgtttagtagcgaacagattaaaaagatctgccggctgaagtgtcgaggctgggggaacttctcctctagatttttaaatggaatacagggcgagaacacggaaaccaaagagtgcttcacaatcatagaagcactgtggaagactaattacaaccttatgcaattgctctcgaaacagtttaccttcaaggacgccatcgactgcattaatgctgataaagtgggtaagatcgacaaagtcacatacgagaacactgtgaaggatctggtagttagcccagccaataagagggcaatttggcagaccgtgcagatcacagaggaaattaaaaaggtcatgaaatgtgagcccgaaaagatttttgtggagatggcccgcgggggcgagaaagaaaagaagcggaccatctccagaaaagagaggctactgaagctctatatggactacaaagatgaaaaccgcgactggatcaaggagattgaatcacgagatgagcaagacttcactaatcggaaactgtatctttactatacgcagatcggacgttgcatgtacagtggcgaggaaatttctttggaggaactgatgcagaagaacagcaagtgggataaagaccatatatatcctcagtccaagatcaaagatgactcattagataatctcgtcctggctagaaaggacattaacaacaataaaagcaacaaacttctgccaacagggatccaagacaagatgaaaaagtactggaaaatgttgctcaagtacggatttatttctaaaaagaagtatgataggctgatgcgcaccgaggacttctccgatgaggagctaagtggttttatcgcccggcagatagtggagactagacagagctctaaagcagttgcggaactgctcgagcacctgaatgaacataccgagatcgtgtacgtaaaggctgaacttgtctccgacttcaggcacgataacaatatgttgaaatcacgacgcattaacgactatcatcacgccaaggatgcatttctgaatatcgtggttggcaacgtgtacaatgccaaattcacagctaacccccggaattggattaagaaaaacagaaataccaactatagtatcaggcgtgtcttcgactacactgtgaagcgcgggagcacaatagtatggcaaggagtgaaggatggcggtcactcgattgacgggatcaaaaagacgatggcccggaatgatatcttatataccgagagaacttactgtgagcagggcgaactctttaacgcaacactgattaaaaagggaaacccgaatgctataggccttaaaaaggggctggaccctatgaagtacggaggttattcctctcccaaaaccagcgccttcgcgtttatcgagttcgacggcaagaaagggaggcagaaccatctagttgaaattccagtctacatcgccaatattgctgcacgacagcctgagtatatcaagaaccacctcgaggagaaaaagggataccaaaatgtgatagtgaagaaatatcccatccagaagaacgccctgattaaattggatggctacccagctcggctgcgcggtgccaatgaaaagtcaatcacactcaaaaacgcagtccagttagttctgaagcccgaatatcatgagactattagaaatgtggaaaagtaccttgagtacatcgacaaagatgagagtgtgtccaaggcggccaggttttctcacaccgaactggacaaattgtatgatgagctctgcttcaaggctgaaaacagcatatacaaaaagcggcctgccaatcagtccgcaacgctgaaaaacgggcaaaagacctttctagctattacaaatctgaaggagaaagcccaggtaatcaacaatatcattactatgttccgatgtgacgcaaccacaactaccaaccttaagacgatcggcggatcagccaatgctggcgggatgcaggtcaacaaaaacacactcaccagccagaaggtggttctggtgcaccaaagtataactggattgtttggcacagaagaggagctgttatga

SEQ ID NO: 3023 - RNA, 4053 nt, synthetic construct
  misc_feature 1..4053: note = Cas9 variant
  source 1..4053: mol_type = other RNA
atgaagaaaccctacagcatcggcctggacattgggaccaactccgtgggatgggccgtcgttacagatgactataaggtgcctgctaaaaagatgactgtactcggtaatacggataaatctcacataaagaagaaccttctgggcgcattgttattcgactcagggaataccgccgcggatagaaggctgaaacggacagctcgccgacgttacactagaaggcggaaccgcatcctatatctccaggagatttttgccgaagagatgagtaaggtggacgatagcttctttcatagactggaagactccttccttgtcaccgaggataaaaggggagaacggcacccaatctttggcaatctggaggaggaagtgaagtaccatgagaacttcccgacaatttatcacttgcgccaatacctcgcagacaatcccgaaaaagttgatctgcgactggtgtatctcgccttagctcatatcataaagtttagaggtcacttcctgatcgaggggaagtttgacaccaggaacaatgatgtccagcggcttttccaggagtttttggcagtgtacgacaacactttcgaaaattcttcgctgcaggagcaaaacgtacaggttgaagagattctaacagacaaaatctcaaagagcgccaaaaaggatcgtgtgctcaaactgtttcctaatgaaaagagtaacggacgcttcgctgagttccttaaactgattgtcggcaatcaggccgactttaagaagcacttcgagttggaagagaaaaccccactccagttttccaaggatacgtacgaagaggaactggaggtgttactggcgcaaatcggcgacaactatgcagaactcttcctttctgccaaaaagctgtacgatagcatattgctatccgggattctgactgtgaccgacgtctcaacaaaagctcccctcagtgccagcatgatccagagatataacgaacatcagatggatctggcacagcttaagcaatttattaggcagaagctgtctgacaaatacaatgaggttttctccgatgtgtcaaaggacggatatgctggttacatcgatggcaaaactaaccaggaagccttttataagtacttgaaagggctcctgaataagatcgagggaagcggctacttcttagacaagattgaacgggaggactttctgcgaaaacaacgcaccttcgataacggtagtatacctcaccagatccatctacaggagatgagagcgattatcaggcggcaggccgaattttatccattcctcgcagacaatcaagatcgcatagagaagattctgacatttagaatcccctactatgtagggcctcttgctaggggaaaatctgacttcgcctggttgtcccgtaagagcgctgataaaatcaccccatggaacttcgacgaaattgtggataaggagtcgtctgccgaggcatttatcaatcggatgacgaactacgacctgtatctcccgaatcagaaggtcctgcccaaacactcccttctgtacgaaaagttcactgtgtataacgagttgacaaaagttaagtacaaaaccgaacagggcaagactgcctttttcgatgctaatatgaaacaggagatttttgacggcgtgttcaaggtctaccgaaaggtgacaaaagataagctcatggactttctggaaaaagagttcgatgagtttagaatagtagacttaaccgggctggacaaggaaaacaaagcgttcaatgcatcatatggaacgtaccacgatctaaggaagatcctcgacaaggattttctggacaacagtaaaaatgagaagattcttgaagatatcgttttgaccctgacactcttcgaggaccgcgaaatgatccggaaaagactggagaactatagcgatttactgactaaggagcaagtgaaaaagttggaaaggcgccattacaccggttggggccgactttccgccgagctcattcacgggatacggaacaaggaatctcgtaaaacaatcctggactatctaattgatgacggaaatagcaacagaaattttatgcagctgatcaacgatgacgctctctcattcaaggaggaaattgccaaagcacaggtcatcggcgagactgataatctgaaccaggtggtcagtgacatagccggttcccctgctatcaagaaagggattcttcaatcattgaagatcgtggacgagctggttaagattatgggccatcagccagaaaatatcgtggtagagatggccagggaaaaccagttcaccaatcagggacgccggaactctcaacagagattaaaaggcctcacagattcaataaaggagtttgggagtcagattctgaaagagcaccccgtcgaaaatagccaacttcagaacgacaggctgttcttgtactatctccagaatggacgagatatgtacaccggtgaggaactggacatcgattacctatcccagtatgacattgatcatatcatacctcaagcatttatcaaggacaactctattgataatcgcgtgctgacttcgagcaaagagaaccggggcaagtccgacgatgttccatcagaagacgtggtcaacagaatgaggcccttctggaataaactcctgagttctgggcttatcagccagcgtaagtacaacaatttgacgaagaaagagctgacaccggacgataaggcgggatttattaaacgccagttagtggagacccggcagatcactaagcacgtagctagaatgctcgacgaaaggttcaacaaagagtttgatgacaataacaagcgaatacggcgcgtgaagattgttaccctgaaatccaatcttgtcagcagcttcagaaaggaatttgagctgtataaagtgagggaaatcaacgattaccaccatgcccacgacgcatatctaaatgccgtggtcgttaaggctctcctggtgaaataccctaagttggagcccgagttcgtgtatggcgaatacccaaagtacaactcttatcgggagcgaaaaacagccacccaaaagatgtttttctactccaatatcatgaacatgttcaaaagtaaggtaaaactggcagatgaccagattgtcgaaagacctatgatcgaggtgaatgatgaaactggtgagattgcttgggacaagacaaagcatataacgaccgttaaaaaggtgttaagctatccccaggtcaacatcgtgaaaaaggttgaggaacagactattgggcaaaatggcggactctttgatgacaacccaaaatctcccctggaggtgatcccttccaaacttgtaccactgaagaaagccttgaacccggaaaagtacggcgggtatcagaaacccacaaccgcgtaccctattctcctgatcgtcgatacaaagcagctaataccaatctcagtgatggacaaaaagcgcttcgagcaaaatcccgtgaaatttctgaaggacaagggatatcagcagattgagaaaaacaatttcgtcaaacttcctaagtacactctcgttgatatcggtaacggcattaagaggctgtgggccagtagcaaagaagtgcacaaggggaatcagttggtagtgtcgaagaaatcccaagacctgttataccacgctcatcacctcgataacgactattctaatgagtacgtcaagaaccattatcagcagtttgatatcctgttcaatgaaataaccagcttttcaaagaagtgcaaacttggaaaggagcacattcagaagatcgaagaggcatacagtaaagagcgtgactccgcctctatcgaggagctggctgatggcttcattaagttgctcggttttacgcaactgggggccaccagcccattctcctttctaggcataaaactgaaccagaagcagtatacagggaaaaaggactaccttctcccctgtatggaagcaactctgatccatcagtcaattaccggcttgtatgagacacggatcgatttaagcaagctgggaggagactga

SEQ ID NO: 3024 - RNA, 4053 nt, synthetic construct
  misc_feature 1..4053: note = Cas9 variant
  source 1..4053: mol_type = other RNA
atgggcaagaactactatctggggctcgacatgggaaccagctccgtgggttgggccgtcacagatgagaaatacagaatccttagggctaagggcaaagacctgtggggagttcggttgttctctgaagcaaagactgccgcggagcgccgaacgcaccgtacctcaagaaggcggttagatcgcgaaaaagctagaattgcctgcctgaaggagatgtttgcagaagagataaataagatcgaccccgggttctatcagaggctaaacgatagtaaatactttctcgaggacaagaaagaacatcaaccttatgccattttcgctgatacaggctacactgacaaggagtattacgatgaatacccaaccatctttcatctgcggaaagcacttctgaatattgagaacgacaagaagaaatatgatgtgcgcttggtatacctcgccatcctgaatatgttcaagcaccgaggtcactttctgaacgctaatctcgacgataaaagcgggggaaacttaaaggagtatatagaaatgctgcatcagtccatggtgaatatccttaacattaatttgaaaaacgtcgagatcgaaaagattgagaaaatcctgaagtctacacagtacagcaattcagaaagactagagaacctcctggagctttatgaactgagcaagaataaaaacaagatagagaccgaaattttcaaatttatctgtggcttgaagggcactattagtaaaatctacgtggaggacaagttcgaagacgagtttgccaagatgacactctccttcagggattctaactttgacgagaaaatcattgaaatagaggataatctggacgatgacaagtatgatatgttcttactgatcaaacagattcacgactggagcgttctcgcgaacatcatgaatggggaagagtacctttccgtggcacgggtcaagctgtacgataaacacaagaaggacttggaagtgttgaaaaagtattacaaacaaaactcaatggaggagtataataagatgttccgtcagatgaacgatggaaattacagtgcctatgtaggtagcgttatatacaaagacaactctgtgcgcagaggctgcaagtccaagaaagaagacttttataagaatattctgaacaccatcaaatcatgggaggattgtgaagctaaggagtacatcacgagcgagattgacaaagggaatttcctcccgaagcagatcactgccagtaacggagtcattcccaatcaggtgcataaaaaggaactgaagaaaatacttaagaacgcatctgagtacctgaattttctaaacgaaaaagatgagtccggctataccatcagcgaaaagattgtgaaactcttcgagtttcaaatcccttactatgtcggtccaatcgcttacaacattgggaatgacgagtcgaagcacaggcataacatgtggtctgttcggaaggaaaaaggacccatatatccttggaatttcgagcagaagatcgatattaaaaagtcctcagaaaaatttatccgaaacctgattaatcactgcacatacttaaacgacgaggaagtgctgccaaagaatagtctactctatgagaagttcatggtactgaacgagcttaataaattgaagatcaacggcgagaaaataagcgtggaactgaagcagaatatctttaacgatctcttcaaaaagggcaagaaagtcactaagaaagggctgattaagtaccttaaagaacagggagagatcgacaattgtgaagaggtggagatttccggtatcgatggcgactttaccaacaagctgtctaattacaaaaagttcgccgatatatttggggttcaatcgttgacatatgaacagaccgacattgcggagaacatcattcgctactcaacgatctatggagatagtagaaagttcctcgaagagaggatacgggaggaatactccaacgtgctggacgagaaacagatcaagcgcattttaggcatgaaattcaaggactggggtagactgagcaaagaactactcgagctgtctggggtcgataaggaaactggcgagatcgcctcagtgattagtaggatgtggaatgacaactataatcttatggagttgatcgcaacagaacgttttagctacgcttatgagatagaacaacggtccaagaaactggagaagaccatttctactatcgaatacgaggatctcgacgagctgtacatgtcgacacccgtaaaacgaatggtttggcagaccatcttagtgctgaaggaacttgaggaagtcttgggatgccctccaaaaagaattttcgtggagatggccagggatgtcaacgctccgaaggaccgcaaggatagccggaaaaagaaactcctggaactatataagaattgtaaaaaggaggagggcgactggtccaaggaactgaacgccagagaggaatcagagtttaaaagtaagaaactctacctgtattacatgcagaaggggaggtgcatgtattctggaaaacccatcgatcttaagaatttgctgaacgacaatttatacgatattgaccacatatatcctcgccatttcgtgaaggatgacagcatcgagaacaatctcgttctggtggagaaaaactttaatgcacacaagtccgacaactacccaattgaaaatgaaatccgacagaaaatgcattcaatgtggaagatgcttcgggatggtaacttcattacggaggaaaaatacagccgtctgatcagaaaggaggagtttaccgacgatgaaaaagccaagttcatatctaggcaaatcgtagagacacgccagggcactaaggtcattaccgacttgtttgaacagacattccccgagtccgatatcgtgtatgttaaagctgggaacgtgagtgaatttcggcacaagttcaaactcattaagtgtagaaatgtcaacgactttcatcacgcgaatgatgcatacctgaacatcgtggtaggaaatgtgtattacactaaattcaccaagagcgccctaaacttcataaaggactataaaaagaatcctgagaaaaacaagtaccacatggatcatatgtttcagtatccagtttctaggggcggtgtcgacgcttggattacaaaaggggccgagtccatctcaatggtgcgaaagatgatggcaaagaatacccccatggtgactcgcatgaactacgaaaaacacagtggccaaaagggaggcatcagcgatcagaatatttgctcggccaaaatagctaagaaaaacgtctacctgccgatcaagatgggggacgagaagctcaaaaatgttgaaaagtatggaggttacggctccctgacggccaaatatttctttcttgtggagcatacaattaagaaaaagcggatcagaaccattgaagcataccctatgtatttggacgcgctgaacaaagagaataagttactcaactactgtgtgcaggtactggagtatgatgaacccaagatcataatggagaaaatcaaggtcaaatctcttttcaagattaatgggtactactattacctgaacgctaaaagcgtgaacaggatcatttggggaaatgccactcagctatttctcgaaaacgacatcaatgagtatgttcgtaagatatcaaagaacattgagtgcatcgatatcaatagtgaaaacaatattaaagtgtacgacatcttcatagagaagtattccaacaaactgttttctaatcgcttgggcaacctgaaggaagcaattatccaaaatcggaacaaattcattgagttaaagatcaatgaacagataaacgtcattctcgagctggtgagatacagccaggatggtgtttattccatcaatctttcacagctggggttgagcagtacctacgccatcaacaggacatctaaggagatttccaaaatgaaggaatgcaaactcatcaaccaaagcgtgaccggcctgtacgagaatgaaattgacctactgactgtatga

SEQ ID NO: 3025 - RNA, 4053 nt, synthetic construct
  misc_feature 1..4053: note = Cas9 variant
  source 1..4053: mol_type = other RNA
atgcagcaatactatctgggcgtggacatggggagcgcctccgtcggatgggctgttaccgatgagaagtaccagctcgtgagaaagaagggtaaagacctttggggcgtaaggacattcgatatcgcacagactgccgaagtgcggcgcgtctctcgaacgaaccgtagaaggcagaatcggcgcaagcaaaggattcagatactgcaggagttgttaggggaagaggtgctgaaaatcgacgcgggatttttccacagaatgaaggaatcacggtatgttgctgaggataagcgcaccctagacggcaaacaggtggagctcccctacgccctgtttgtcgatcaaggtttcacagacaaggatttttataaacagttccctactattaaccatcttatcgtgtacctgatgaccacaagtgacaccccagatattcgattggtatatctcgcactgcactactacatgaagaatagagggaactttctgcatagcggagacatcaatgatgttaaagacatacagtccatcctcgaacagttagagaacgtgctgaaggaatatgtcgacgattgggagctttctttgaaggacaaagtggatgccattaaggagatctacaataaagacctgggcaggggcgaacggaagaaggctttcattaacactctaggggtgaagacaaaatcggcaaaggccttttgctcactcatcagcggaggtagtaccaatctggctgagcttttcgatgactccggcctgaaggaatctgagtatgccaaaatagaatttgcgaacgcaaatttcgaggatagcgtcgaggggattcaagccttgctcgaagaccgttttgctgttatcgaggccgcaaagcgcctgtacgattggaaaattttaacggacatcctgggagataacgcttccctcgccgaagcgagagtgaagtcatatgagactcaccatgaacagcttgtagagctgaaaagtttcatcaagaagtacttggacaggaaaatttatcaggacatattcatcaatccgaacattgccaataactaccccgcatacgtgggccacaccaagatcaacggtaaaaagcaagagctagaagtcaaacgggctaagcgaaatgatttttatgcctacataaagaaacaggtgattgaccctatcaagaaaaaggttagcgataaagctgtgctggcccgcctcgcagagatcgaatctctgattgaggtcaacaagtatcttccactgcaggtaaattccgacaacggggtgatcccctaccagattaagttgaatgaactcagaaggatattcaacaatctggagaaccggttacctgttctgaaagagaatcgcgataagatcattaaaacattttcatatagaatcccatactatgtgggacccctaaacggcgtcaataggaacggcaagagcactaattggatggtgcgtaaagaaggggaggaaggaaagatctacccttggaacttcgaggagaaagtcgacctcgaagccagtgctgagaagtttattcggcgaatgaccaataagtgtacatacctggtgaacgaagatgttcttccaaaatattctttgctgtactccaagtatctcgtgctgagcgagcttaacaatctgagattggacggtaggccgctcgaagtatcggtcaaacaagagatatacgagaacgtgttcaagcgcaatcggaaagttaccctgaagaagatcaaaaactatttactgaaggaaggcgtgatttctgagaaagatgaactatccgggctcgcggacgatgtcaagtcaagtctgacggcataccacgactttaaagagaaacttggacatttgactctgacagaagatcagatggagaagatcattctcaatgtgaccctgttcggcgacgacaaaaagttactgaaaaagagacttgccgctttgtatcccaacatcgatgagaaaagcctctccaggatggccacttttaattaccgcgactggggtcgactgtctaagaagttcctaagcgaaataacatcagtagatcaggagaccggggaactgcggacgatcattcagtgcatgtacgagacccaaaacaatctcatgcagctgcttagtgaaccttatcactttgtggaggcaatcgagaaagaaaacccaaaggttgacttggagtccattagctaccgtatcgtcaatgatctgtatgtgtctcccgccgtgaaaagacagatatggcagacattactcgtcattaaggacatcaaacaagttatgaagcatgatcctaaaaggattttcatcgaaatggctcgcgagaagcaggagtcaaagactaccaaaagtcggaaacaggtgctgagcgaagtgtacaaaaacgccgagaagtataaaaatctttttgaaaagctgaactccttgacagaggaacagctcagatctaagaaagtatacctgtatttcactcaactaggcaagtgtatgtacaccaatgacgcaatagatttcgagaacctggtctcggcgaacagcaattacgacatcgatcacatttatccacagtccaaaacaatcgacgattcatttaacaatctcgtgctggttaagaaaggaattaacaatgacaagagtgacaggtaccccatcgataagaacatacgagacgatgagaaagtgaagaccctttggaatactttgctgtctaaaggcttaattacgaaggaaaaattcgagcgcctcatccggagcacaccgttttccgacgaggaactggctgggttcatcgccagacagcttgtcgaaaccaggcaatcaactaaggcagtggccgagattctgagcaactggtttcctgagtctgaaatcgtttattccaaggctaaacacattaccaatttccgtcaggattttgagatactaaaggtgcgcgaactcaacgactgccatcacgcccatgatgcatacctgaatatcgtagtcggaaacgcttatcacacaaaattcaccaatagtccctaccggtttattcagaacaaggccaatcaggagtataacttgagaaaactgttacaaaaggcgaagaaaatcgaaagcaacggtgtgattgcctggatcggccagtctgagaataacccagggactatagctacagtgaagaaagtcatctccaggaatacggttctcatttcacgaatggtgaaggaggtagacggacagctgttcgatcagcaacttatgaaaaagggcaaaggtcaggtgcctatcaagagtagcgacgatcggctgattgacatctcgaagtacgggggctacaacaaagcaaagggagcctattttgtcttcataaaatccgtgcgcagaggcaagaccattaaatcttttgaatacatccccgttcatttggctaagaagttcgactgtaatctcgagctgctaaaagaatatctggagagcgagaaggatcttaacaatgtggaaatcctcatgccaaaagtcatgattaactcactgttcaattacaacgggagtttgataaggatccccggacggtatgacaagaaatccctgttaattaatgtggatgttcctctcctgcttgagtctcagcacatcaagcagctgaaggtgattgaaaaatacatgtataagaaacgagtcagcaagaactccaatatcttgctcactaaatttgcctcagaccaactgaaggatctagacgcactgttcgatgtacttagctacaagctcaacgagaatatatacaacgtgatcaatgacaaatatgataagctggttatttgcagagacaaatttatcagtttggatacagaagtgaagtgtgagatgattttcgagttactgcacctctttcagtgcaactctcagctggcgaacatcaccaaaataggtgccacatccaagttcggcagcatttcgatgtctaaaaatcttaaggaaaacgacaagatgtcaatcatccatcaaagtccatccgggatttttgagcacgaaatcgagctgactgctttgtga

SEQ ID NO: 3026 - RNA, 4053 nt, synthetic construct
  misc_feature 1..4053: note = Cas9 variant
  source 1..4053: mol_type = other RNA
atgaagagaatcctgggcctcgaccttgggaccgccagcattggatgggctctggtgaacgagtccgaaaatgagaaagaaaagtctgagataatcaaattgggtgtcagggttaaccccttaacaactgatgaacagacggacttcgagaagggccggcctctgtcagtgaatgcagatcgcaccctaaaacgaggggcccgtagaaacctccaaaggtttaagcagcggcgcaagaatctgattgagatccttattaaaaagggattcatcacaaacataagtctgttgactgaaatcggcagcaataccacataccagaccctcgagctgagagcgaaatccgtaaaggaaaagattgagaaggaggaatttgctagggtgctgctcactatcaacaagaaacggggttataagtcttcgcgcaaagccaagaatgacgaggaagggtcattaattgatggaatgagcgtcgcaaaagagctgtacgacaacaatcttacagtgggccagtatgtttaccaattgctggaaaagggcgggaaatatatcccagatttctaccgaagtgacctacagaacgagtttgatgtgatatggaatttccagaaggagttttatccgaacattctcaccggagaactgtacaagaaacttcagggtcaaggccagcaaaattccagaaagctgttcttggccatccaccagatttacacggctgagaacaaagggaagagggacactgtcaaaaagcagcattataagtggcggaacgatgcaatcaatacccagctcctgatcgaagaggtggcctacgtattagttgaaattaacaataacctgaataaatctagcggatatctcggcgctatatccgaccgttcaaaggagctttactttaacaaagagacagtgggtgaaaatctgtataagcagatccaagagaacccccagactagcttgaaaaatcaggtcttctaccgccaggattatctagacgaatttgagcaaatttgggaaacccaggccaagttctacagcgagctgacaaaggagctcaaagaagaggtgagagacgtggtcatcttttaccagaggaagctgaaatctcagaagcaccttatatccgaatgcgagttcgagaaacatcacaaggcgattcctaagtcaagcccactgttccaagaatttaaaatctggcagatcttgaacaatattgagttcaagcataaaaagaccaaagaactcaagatcctgagtgaggaattaaaagagacgctgtttgaggaactaaacattcgggggaatttcacttctgatgcagttctcaagtttgtgaagctggacaaaaaggagtgggaacttaactataaaaagggaatagagggcaatcgaacaaacgaagtattgtacaacgtgtatcagaaaatcgccgagtacgagggctatgggttcgattggtccaaaaagagcgctgtcgaaattaaagaggaactgaataccatcttttcggagatcggaattaactctaagatactcgacttcaatcccgaaatctccggtaacgattttgacaaacaggagtcataccaactgtggcaccttctgtatagtgccgaggaagatggcttcttgaagcagaaactccaggacaagtacgggtttaagagcgagtacgcaaatatgctggctaacgtgtccttccagtctgattatggaagtttatcagcccgcgcgattaaaaagatcctgcctaatctaattgccggccacgaatttagtgaggcatgttccctcagcggttacaaccattctaattcactgactaaagaggaacttgctaacagaccattgaaggggaaactggagctcctgaagaagaatagtttaaggaaccccgttgtggaaaagatcctgaatcaaatggtcaaccttgtgaatcaggtaatagagagctatggcgaaatcgacgaggttcggattgagttggcccgcgaactcaagaaatccgctcaggagagagccctgatgacaaccaacatcaacgcatctaagacgaaatacgaatcgttcaggaagctactgcaaaaagatttcggaattaagaatcctacccgtaacgacatcataaagtatcggctctacgaggaactgaaagccaataagtatcacacaatttacactaacaaatacatcccacgagacaaactttttagcaaagagattgatatcgagcatataatcccgaaggctaagttgttcgacgattccttttcaaataaaaccctggcgttcagaaagcccaaccaggacaaaggcaatatgacagcaattgattatatcttaagttaccagtctaaggacattgataactataaaagcaggatcgaaaatctctttaagaacgggaagggagacatatccaaagccaagcgcaataaactgcttatggaggaaaaggatattcctgacggtttcatcgatcgggacctgagaaactcacagtacatcgctaaaaaggccaagcaattgctcgaggaagtgattaggactgtcaataccacaaccggcagcgtgactaacaaactgcgcgatgactgggggctaatcaatgtcatgcaggagctgaacatgccaaagtttaaagcaattgacgagtctctcatagaacagatcgagaagaaagatggaacgttcaagacacgaattaaggactggtccaaacggaacgatcaccgtcaccatgccatggacgctctgaccgtggcctttactagatataatcacatccagtaccttaacaatttgaacgcaaagagtgataaaaagggcgcgatttatggtatccaagaactggagacctacgttaatagcaaagggaagaggaaattcataaagcccatgcataactttcgcgaggaagctaagaaacacatcgaggacattttaatctctttcaaggccaaaaataaggtggtaacaaagaacattaataagatcaagtccaaagatggctttataaagaaagtccagctcacccctcggggacagctgcataaggaaactgtgtacggcaaaattaacgaggttgtggtcaaggaagagaagatcaatgcaaaattcgaccttgagaagatcaacaaagtgacaaagccaatttatagaaatgccctgctaaaaaggctccaggagttcaacggggaacccaagaaggcttttacgggtaaaaattcactgagtaagaacccgatatacttggatgtagcccaaaccaaaactctgcctgaaagcgtgaaggttcagttctttgaggaaaattatacaatccgaaaagagatttcgcccgacttaaagatcgataaaattatcgacaagggaatacagcgcatcctcctgaagcggcttgatgagttcaacggcaaaccaaaggaagcattttccaacctggagaaaaatcctatttggttgaacaaggaaaaagggatcgctattaagagagtcaagatcaaaggagtgaagaatgtggagtctctccacaacaaaagggaccacctgggcaatgaaatactacaaaagggtaaaagcgcccccaacgactacgtctcaaccgggaataaccatcacgttgcgatttatcaggataagaatggcaagctgcaggagaaagtggtgagtttctacgaggccgtagctcgtgtcaacaataaacttccaatcatcgaccaggattttaacaaagacctcggatggaagttcctgtttacaatgaaacaaaatgaaatgttcgtgtttccctccgaggatttcaagcctttggaaactgacctgatggataagaaaaacaattctaagattagcaaaaacttattccgcgttcagaagctcggcaacaaagactatacctttcggcatcacctggagacgaagatcgaggatataaagaaacttagagacttcacctacattaggaagcgaaatccagaatccatcaaaaacattatcaaggtgcggataaatcacctggggaacattgtccatgtgggagagtactga

SEQ ID NO: 3027 - RNA, 4056 nt, synthetic construct
  misc_feature 1..4056: note = Cas9 variant
  source 1..4056: mol_type = other RNA
atgagcaagaaatactatctgggcctcgacatcgggaccaactccgtgggatgggccgtcacagatgagaattacaacctttgcaagtatgctggtaaaagaatgtggggcattaggctgttcgaagggggagagactgcagaacagcggcgcatatctcgatcaaatcgtagaaggttgagtcggaagaaacaacgcatcgacttactgcaggagctatttgccgaagagattgcgaagatggatcccacgttctttatcagactcaacgagagcaggctgcaccttgaagacaagtccaccggcgagaaattccctctgtttcgggataaggactacacagatattcagtattacaaagaatatccaactatgtaccatttgcgcaaggagctcatcgaaaattctaaagttcacgacatacgactggtgtacctggcttgtcatcacatcctcaagaacagaggtcatttcttaattaatgggtcgttttcagatgtaaagaaactgagcagtgtgtgcgaatccatgcttaactctttcaatggaatcagcaagtatcagattgagatcaacgacatagaaaggttggaggaaattctgtccgatcggaaaaagcaaaaatcagtcaaggccaaagagctaatccagatttttgagtgtggcccgtgcgaagacaagaccgatgagaagacatgtaaagcaatcgtgagtaatctctgcaagtggctgaccggccttaaagggaacatcaatagcattttcgacatgcagtttgaagagatagacacttcttccttctcatttacagaacccaagtacgaggataccatcagcgccgctctggaggaaaaatatcctgactacgcagatgttattcagaagatcaaggccgtgtatgactggagtgtcttggtggagataatggctggagaagattacctctctttcgccaaagtaaacgcgtataataagcacaaagagaacctgtgtattttaaaggaagttatccgtaaatactgcgactccgagatctaccacaagttctttaacggtttcgatgagaagaatggctatgggaactacattggaagcatctataaaaatggccattcgtacgcaatgaagaaatgttctacggaagacttttataagactctgggtaaaattctcgataagatacaaccagagaaggaagacgagaacgtgcttgaggaactgaaagtcgaggtgaagaatcagaccttgctacccctggcccgcacaactgctaacgggaccatccctaatcaggtgcacattcaggaactcagagccatcctggataacgcaaagaagtaccttccattcctgaatgaggaagacgagtatggaacagtcgctgagaaaatcatttccatagccaagtttaggatcccctactacgttggccctttgtcaacccggcataaagaacaaggcgcgaacagttggattgtgcgaaagcaggaggggcgcatctatccatggaatttcgaagagatggtagacctcgaacagagcaacaaggagtttattcaaagaatgacgaataaatgcacttacctgatcggagaggatgtgttaccgaagaactccctgctatattctaggtacatggtcctcaatgaactgaacaaccttcggatacgcggtaataaaatcagcgtgaagttgaaacaggagctgtataaggaactcttctgtacaaaggccaaagttaccggcaaggggctgtttaactaccttaaaaaggaggacgaagaactggcattggaggatatttcaggattcgacatcgattttaaaagttccctcactagctatctggacttcaagaagcagattttaggcgaggagatcgaaaaagataagtacaaaggtatagtggagaatattatcaagtggaaaacaatttacgacgatgactctaagatgatgaagaaaatgatcgagagagaatatcccaacgtcttttcaaaggataaaataaagaaaatctgcaggttcaagtacagtgggtggggcaatttcagcctgtcctttctaaacggcattcgtggagctgaccgggagaccggggaatctttcacgatcattgaggccctctggaaaaccaattataacctgatgcagcttttgtcgaagcaatttacattccgagaagagatcgatctgataaatgctgagaaggtgggaaaaattaacaaggtaagctacgacaatactgttaaagacctcatcgtgtcccctgccaacaagagagcaatctggcagaccgtccagattacagaagagatcaaaaaggtgatgaagtgcgaaccagagaggatttttatagaaatggcccgcggtggcgagaaagagaagaaacggactgtctcaagaaaggctaggctgttagaactgtatgcggcatgtaaagatgacgtgcgcgattggaccaaggagatcgaagaccgagaggaacgggagttcaatagtaagaaactttacttgtattacacacagatggggcgttgcatgtactctggagaggaaattaacatcgatgagctcatgcaaaagaatagcaaatgggacattgatcacatctatccccagtccaagataaaagacgattcactggacaacatggttctagccaagaaggtgatcaacaatagcaaacagaacaagctgctctcttccgatattagaatcaaaatgaagaaatactggaatgctctgtataagggcaactttattagtaagaaaaagtacgacaggcttacccgcactgaagatttcacgaatgaggagttgagcggttttatcgaacggcagatagtagagacaagacaatcttccaaagccgtcgcagaactgttaaacaggctctatgagcactcagaaattgtgtacgttaaggccgggctggtgagtgacttccgacatgacaataaacttctgaaaagccgccggatcaacgattatcaccatgctaaagacgcctttttgaatatcgtcgtgggcaacgtatacaatgcaaagttcacctcgaaccctagaaagtggattaaagagaataggggaactaactactccatacgtcgcgtgtttgattataatgttaagcggggcaacaccgtcgtgtggcagggggtggaggacggaggtcactctatcgatgaaattagaaaaacaatggcgaggaacgacatcctctacaccgagtatacttactgtgataagggcgaactgttcaatgctacactaattaaaaaggggaacgacaaggccatcaatctgaaaaaggcactcgatagcgtcaaatatggaggctacaactcaccaaagacgagtgccttcgcttttatagagttcgacggtaaaaagaaggaacggaaaaatcatatcgttgagattcccgtgtatatcgtgaacattgccaagcgacagccggataccatcaaagagtacctggaacagaagaaagggtacaagaatgtagtcgtgaagaaatatcctataaagaaaaacgcacttattaagatcgacggctacttggctcgcctgagaggagccaatgagactgacatcttactcaaaaacgcggttcaactgattcttaatgataagtattacgaaatcataaggcgggtggagaaatatctggaatacaacgtccgatatgaggccgagtccatgtttgaaggcttcgaccacgctgatctaaattctctctacgacgagctgacaagcaagttggaaacctccatttacaagaaaagacccgcaaaccagctgaatgccttagagaaggggaaagagaagtttaaaaacatccagacactccgcgaaaaggctcaaattatcaaggagatgctgataatgtataggtgcgatgccgcaactgtggcgaatcttaaagccattggaggctcagctaacgccggtagcatgaagatcaaaaagaacaccctgacgagtcgttctttggttctcgtgaatcagtccatcaccgggctgttcgaaacagaggaggagctagtatga

SEQ ID NO: 3028 - RNA, 4056 nt, synthetic construct
  misc_feature 1..4056: note = Cas9 variant
  source 1..4056: mol_type = other RNA
atgtacaagaaatatggcatcgggctggacattggaaccagctccataggttggtctgtggtcgatgagtacggccacatcattagagttaaggggcagacaggactcggcgtgaggcttttccgggaaggtcaacccgccgctgaccgccgaacttttcgtacgaccagaaggcggctggggcgcagaaggtggcggttgcgcttactgcgagagatcttcgatccttatattgcagcccaggacccaaactttttcgcgagacagaaagctagtgccatcgcaccgggagatagtaggtttaaggccgtataccggctattcaatgaccagacagatcgtcaattttatgacaaataccccactgtgtatcatctccgccagaagctgatgaccgaaaagagacagttcgatataagggagatctaccttgctgtccaccatattgtgaaataccggggccactttctgacaggcggggcagccaagaacttcaaacctggaaagttggacctcaatacctattttgctactatcaacgcccagctggcggcaattttcatggatagccaagttgaactgccacagctcgactgggatgccgtggtctccttactgacaaatgaccaggagtctccctcggaccgacagaaagctcttaccaagatgttggtggcccaaggtgatgcaacgcagaagcgcttttacactgagttctcaaaagctctgctaggcctcaaggccaaactgtatgtacttaccgggttcgaaggagacaagacagatcagaaagcgctgactttgagcctcgagaccctggacgatcatcaagacgatgttacacagttactgggcgacgaacagagacagctcgtggagcttctggccagggtccaaagtgcaatccagttggctataattatccctaacggtaagaccttttccgggcagatggtgcagcaataccagacgcactatgatcagctacggctgctcaaagactaccgcgagcagctgactgatcaaaagcacagaagggcccttaagcaggcttatgccgactacctggcaaatgaccaggatcaggacgccttggtgaaagctgtcgaaaaggttctcaaacaaaaccagccactgtctacagtgggagtacgtttacagaccgcgattgatgcaggcgacttcctgcccaagcaacggactaaagccaatagcgtgatccctcatcagatccaccagcaggagctagatcgaattatagaagctcaatccgtctactatccatggctcgccgaggaaaacccggtggcagcccatagatcatacgctccctataagctggacgagcttgttgattttagggtgccttactatgtcggcccattggtgcagccccaggccgacaaggcagcgaaagagacaaagttcgcttggatgacccgcaaagaagcccagagtacgacccctatcacaccatggaattttgagcaagaagtagatcggaacgcaagcgccaatgctttcattcagagaatgaagactaccgacacatacctgctcggggaggatgttctgcccaaaaactctcttctgtatcagaggtttgaagtgttgaatgagctcaacaacgtccgcgtggacggaaagctgttaactatcgccgagaagcagcgactgttccaagatctatttgtcgaccggtcccaggcatcagtgaccatagctcagctccaagccaatctgattgcgcacggtgccgctaaagaccgtgttgaaatcaagggccttgcagatccgaaaagattcttgagcagtctgacaacctaccacgactacgcccagatcattcctgaggctctcgaacagcccgataagagggccgacatcgagaaaattataaactggtctactatctttgaagatacgtccattttcaaggagaagctgcaggagatcgcatggttaacaccagaccaacgccggcagctgagccagaaaagatatagggggtggggacagctttcggataagttgctcacccaactgcgagacgcgactggccagtctgtgatggatctactgtggaccgaacctaataactttatgcagatcattcgccggacagagttccagcaagccatagctagagtaaatcagaccgacctcaaacagcaggatctggccactacaatcaacgacctttacacgtcaccccaaaataagaaagcaattaggcaggtcttgctggtggttgctgatatccagaccgccatgcatgaagtggcaccatcatggttattcattgaggccgctcgtggtcccgagcaaaaccctaagcgcaaactcgcgcggcagcagcagctgcttgaagcctataagacttcagcaaaggagatcgtcaatgaagctgtgaaagagaagctgttgagcgccatagacgaccaccaaaaatttgaagatcaggtagtgctctacttccagcagaacgggctggacatgtatacaggcaagccactagattttgagagactgtccaaataccatatcgaccacattatcccgcaatctgttgtcaaggatgacagcctcgataatagggtgctgaccacacccgaggaaaacgagcgaaagggagcccgggtgcctggcccactttatgcttcacagcaggggcgctggagattgctgcagagggcaggattaattagtcaacggaaactcgaccatctgcttctgcgacccgaggaactagatcagcaggccactggtttcgtcgcgagacaactcgttgaaacccgccaggtgatcaagctgataacgaatattttgtcccagcagtacgaccctgagcaaaccaaactggtgagcgtaaaggctggcttatctcaccagtttaggacacgtctcaacctgccaaaacttcgggagctgaatgattaccaccatgcccacgacgcatatttggccgctagaatcgggacttacctcctgcagaggtatcccaacctagaacgcttctttgtctacggacagtatcaaaagacccgattcgacctgaagagacattttaacttcattggcgagatgcttaaaggtaagccggaagatgcagtgatcgttaaagcccctcactcagagacagtgatatgggacaagcaggatgaagtcaaacagctcaagaagatcatggagtaccggcacctgttggtgactcatgaggtttatgacaatcacggggcgctgtttaaccagaccattcatccagctaaaaatcccaagaacaggaaattaatccctcgcaagacgacacaaagtaccgaactctacggcggatacagcggcgagactacagggtatctggccattgcacgtaccgtgactaaaaataagatctcctaccaggtacttagagtccccacccggctggtgggaaggttgcagcgatcttcggaaagcgcccagcgccaaatactcacagattggttcgctccatcctttgtgtcaagaggtaaacagcagcctttcgagattgtcctgcggcacgttttcaagaaccaaacggtgatcgacgatatccatgagcagagtcacaggtttggcctacgctctgacacctattactgcaatcagcagcaactggtacttagcctcgaacagcagagaatgattatcgatcagaagctgaacaatactaacaaattgatggtggtctatgaggccgtgtgtgaccaagttgcaaagtacttccccttatataggatgaatcactttaaagaatccctgctcgaggctgggccaaagctggccgaacttccgattaacacagtgcagtccaaaaatggaaagctgaagttgggccagcggagcgtcctactgcagaccatgcaaggtctccatgcgaaccctgagacaaaagatctgtctataatcgggtgccccaagtacttcggcaaacttcaggtgtccagtggaattaagttaactgagaatgccgttctgatccacgaaagcccaaccggcctctttcagcgtcgcgtgcgattgtctgacctgtga

SEQ ID NO: 3029 - RNA, 4056 nt, synthetic construct
  misc_feature 1..4056: note = Cas9 variant
  source 1..4056: mol_type = other RNA
atgaagatcctgggcctcgaccttgggaccaacagcattggatgggccgtggtcaatgaggctgaaaacgagagagaatcctcttcaataatcaggctgggtgttcgggtgaatcccttgacagtagatgagcagaacaatttcgaaaaaggcaagcctattactacgaacgcagaccgcaccttaaaacgaagtatgcgtagaaatctgcaaaggtacaagctacggcgcgccaacctcgtgagcctgcttaaaacacaggggtggatcactgatgagaccctgttgtccgagcagggaaataactctacatttgaaacctatagactcagggcggaggctgccactaaggaaattacactggagcagttcgcacgggtcctgctcatgttaaataagaaacgcggctacaagtcgtcacgaaaaatgaagcacgacgaggatggtagctttgtgaacaatctggacatcgccagagaactttatgatagtgggttgaccccaggacaatacgcttataacctgctaaaagacggcaagaagtacataccggatttctataggtccgacctccaggaggaactggataaaatctgggcataccagtacgagtatcatgaaaatattcttacgcactctctgcggagcgccatcattgaccagtccaagactggcaccacaaaaatctttttgaagactcatgggatattcaccgctgatattaaaggaaaccgtaacgagcgcaataagcaactctttgagctgagatgcggtgccttagaaagggcgctgacagcagaggaactcgccaccgttatcgctgaggtgaacggccagattaattcaagtagcgggtaccttggagccatctctgaccggtccaaagcactgttcatcaaccaccagacggtcggccagtatttgatgcaacagctagaccgagatcccaataagtcactgaagaaccagcctttttaccgccaagactatctcgatgaatttgagcagctgtgggagactcaggctcattaccacccagaacttacagccgcgctgaaacacgagattagagacataatcattttctatcagaggcggctaaagagccaaaaatggctcgtggccaattgtcccttcgaacatcgcaaggtatgccctaaaagttctccactgtttcagcacttcagaatctggcaggttttaaacaatgtgaccgtcactgtggataacaagacatacgtgctgaatgaggaacagaagtccatactaagcaaagagctcctgtacaaggagaaaatttcgaagagggacgcacttaaaatgttgttcgtcaaggctaagggtgttgatatgaactttgcctctctggaaggggaccgtaccatgtccaatctcctgaaagctgcccaagagatcgtgtcaatcagtggacatggcgattatgacttcggcaagatgcccgcagatgacattcacaacatcattcggagcgtatttgggggacttggtttcgccacggactggctgaatttggataccgacgctgatgacctcgaacaggagtcccagatgcgactgtggcacttaatatactcttttgagggcgataacagcacaactggggacaccaaactggtggaaagactaatgtcactcctgaaccttcctcaggagtatgcgaggttgttcgcaaatgtccatctggaagatgactactgtggaatcagttccaaggccctcaaacgcattctgccatttatgaaggctggccacatctatagcgaggcctgcgcattagccggttacaagcattctgaacaatcactgacacgggaggagaacaaaaatagaccgcttaaggatcacttggaacagctccccaaaaacagtctgaggaatcctgtggttgagaagatcctaaaccagatggtgaatgtcgtgaacagcattatagacacttatgggcgcccagatgaaatccgaattgagctggctcgggaactcaaaaataacgccctgggccgtcaggcaatcttcgaggcgattaatagaaacaccaaggagtccgaaaggatccaacagatacttaaaaaggagtttggattgacacatgtatctcgcaatgacatcattcggtacagactgtaccaggaattatcgggcaacgggtataagaccctctacagcaatatctatattccccaagagaaactgttctccaaggaaatcgatatagagcacattatccctcaggctaggctttttgacgactcattcagtaacaaaactctggagtaccgagatgttaacattaagaaatctaatacgacagccatcgactttgtgcgcaacgaatatggagagaatgaagtcgagcagtacaagaagcgggtgaacgatttgctcaaaagcggtgcaatatcccaggccaaggctaaaaagctgaaaatgaccgaggccgaaatcccaaatgacttcattgagagagatctaaggaacactcaatatatctcacgtaaggcacaggaaatgctgcgcgacgtcgctcgggtggttaccgccacaaccggcagcgtgactgatagactcaggcaggactggcagctggtagatgtcatgcaagagcttaattgggacaagtacgaacgacaggggttgacaacggtgattaacggacgggatggccagcagatccgcagaataaccgactggactaaaaggaatgatcaccggcatcacgcgatggacgccctgacaattgctttcaccaagcccgcatacatctcttatttaaaccatctcaatgcccgatccgaggacgatatcagaagtattgagcgcaggtttctggaacgtgacgctaacggtcaccttcggttcatcagcccgattgcccacaattttagatctgaggcaaaaaggcatctggaaatgatattggtttccatcaaggcgaaaaacaaggtggtcacacgcaataacaacactaccaagacgaaagggggccgaagaaatcggattcaactcacccctaggggacagctgcacgatgccacagtgtacggctcaatcttgctgccccatactaagaccattgctgtagacgggaaaatgacagccgagatcataggacaggtgcaaaacccagttttccgccaggcattaagtcagcgtctcgaggcttgtggtaatgatcctaagaaagcctttactggcaagaacagcctggaaaaagcacccgtctggatcgaccaggcccacaccgagcatgtgccagctgaagtgacgattcaaagacttgagccccagcacacaatccggagggcggtcaataaggatctgaacattaataaggttttggacaaagggatccagcacatactccaggcccgcctggatgcatatggaggcgacgctgccaaggccttcgctaacctagataataaccctatttggctgaatcaagaaaaaggtatcgcaatcaagcgagtgaccactgccgagaacatttcgggggaaccacttcatcacaaacatgacaaggagggcagaccgatactcgacacaaatggaaagcccatgccttccgattttgtgcggctgatgaacaatcaccatgtagcgatcttccaggacgctgatggcaacttgcaggagcacattgtctctttttacgaagccgtggcaagggttaccgagctggggttaccagtgatcgacaaagaatataataaggataaaggatggcagttcctctttactctgaagcaaaacgagtacttcgtctttcccaaccctgcccagggcttcaatccagacgagattgatcttaccgacgaacgcaactatagcagaatctcacccaatctgtacagggtgcagaaaatgagttccaagtactatgttttccggcaccatttggagacaacggtggaagataagaaagagctccagggtataacctggaagcgtatccaatctctgaacaatctaaaagggattgtaaaggtccgcatcgaccacattggacgaatcgtgcagataggcgaatactga

SEQ ID NO: 3030 - RNA, 4056 nt, synthetic construct
  misc_feature 1..4056: note = Cas9 variant
  source 1..4056: mol_type = other RNA
atgttcagccagcaaaacaatctgtactgcgagtccctctctaagttgtattacaacatcaccaaaaattttctgtcaaagaacgaagtgtgtagaatttatgagatattcttttgcagtatcttgacatacttcttaaagaagtataatcacgacatttttaaaaagagctccactatgaagacgatcctgggcctagatctcggggtcacctctattggatgggccgttatcgtgacagacgatgacaacactcccataaaaatcctgggtatgggctcgaggattatccctctttcaaccgctgataaggaagagttccagaaagggcaggcaattagcaagaatcagagtcggacaatcgcccgcacccaacgaaaaggatacaaccgtaagcagctgagaaaggaagagttgaaaaagatactcggcgagctgggtattactccatccaaagaactgctcaatttaccgtctatcgagctgtggaaacttagggcggacgctgccagcgggaacgcacccttgtccgccgaacagctgggacggatcttttatatgctaaatcagaaacgcggctacaagtcagctagaagtgaggcaaaccaagataaaaaggacacagattacgtagccgctgtgaagggcaggcatcagcagctcaaagagaaggggcagaccattggacaacacttctatacggaaatgctgactcttgaggaaaatagcggtcattttcaggtcaaaaacaatgtgtaccctcgggaggcctatctggaagagttcaacgcgatcattgcagcccagaagccacaacacgcttttcttaccgacgatgttgtggaccgcctccgagatgaggtcatattctaccagagaaaactgaagtctcagaagggcttagtgtccatctgtgaatttgaggggttcgaaaggacattctttgacaacgtaaaacagaaggacaaaactattttcaccggacccaaggttgcccctaaatcaagcccactgtttcaactctgcaagatctgggagacagtgaataacataaatcttaaggtcaaaaacaccgatggcagtaagaataaatgggcagactatgtgcccacgctggaacagaagcaggagattatcgagcatttgttcaaaaacgctggtatctctctagatgccctgcggaagattctcgggtttaataaggacgaaatcttcgtgaacaaacagattgagaagggactgcaaggcaatactacatacgcggaaatacacaaaatccttggcgattccaagcctgagctgttggggtttaacattaatatcgaaccaagcaaacactcggccctcctggtcgacaagcgtaccggagagatcttagcagagaaagaaggtcagcaggtttctgctgagattgaaaaggagaacttctatcagctgtggcatactatatactccatcaaggatctagacgagtgtgccgctgccctcattaaacgctttaatatcgatccgaacgtggcagcccaactggctaagattgacttctcaaaaggcgcgtttgggaataagagtaacaaagcaatgagaaagatccttccctacttgatgcagggatataactacgccgatgcttgcagcctggccggctataatcactccgactctcagacaaagaaagaaaaggaggaaaacgtagtggacgataaactcaagctgcttgagaaaaatagcctgaggcagcctgtcgtggaaaagataatcaaccaaatgattcatgttgtgaatgcaatcattgacaagtacggtaaaccagatgagatccgggtcgagttggcccgagacctcaagaaatcaaaggatgaacgcaacgaggctgaactgcagaatgccagtaacaaaaagttaaatgaggaagtggcaaacagactgaaggagctagggctccccgtaaccaaaaggttcgttcagaagtataaatttatattccctgtgcgggaccgcaagattaaagaggcgcaactggtcaatcagtgtatctactgcggcgaaacgttcaacgtgaccgaggctctttccggagataattttgacgtcgatcacattatcccaaagagcatgttgttcgacgattctcagacaaacaaagtgctggttcacagaaagtgtaatgccaaggacaaatcaaacaagactgcatatgattttatagccgctaaaggcgaaaacgagctcgccatctacctggacagggtggacgattggttcaagcgtggggtattaagttacggaaaaatgcagcggctgaaggtcagctatgaacaatacgcagagcgaaagcagcttaaaaaggagaccgaagctgacattaaattgtgggagaattttatcgaaagagatctcaggcagacacagtatattgccaagaaatccaaggacctgctaaagaaaatctgcaacaatgtgactgttaccgagggtaagataacagcgcaactgcgcaacctctggggctgggatgacgtgctgatgaatcttcagttgcccaaatacaaggccctggggcagaccgagattaaagaatggacttctgagcatggacggagattacacaagaaggaagagatcacgaactggacaaaaagggatgaccatcgccaccatgctatcgatgcactcgtcgtggcctgtaccaagcagggcttcattcaacgaatcaatactctgaactcgagcgacaccaaagatgctatggaccgggaaattaaggccgcaaaagagaagtataatgagctttacgataagaaactgttgacagaaaccaacgagcaggtaaagaatcacactgaacgttttaacaaactcgagacatatctgaagtcccagcaaccgcctctattcacgaccagatacgtggaacaggaggcggacaaaatatttgtttcattcaaggccggtaaaaaggctgccacttacgggatcaggaagattaaaaaggacggcaaaaaggtcgtggtgcaggagaaaatcgtcgttccccgcggagcactgcacgaacagagtgtgtatggcaagattaagacacaagagaaagataagccactcaaatacctgtttgaaaatcctgagaccatcgtggacaaccggataaagatccttgtaaaagaaagattggataagttcgagggggacgtcaagaaagctctgacatctttaaagaaagagcccctctttattgataatgaaaagaacactctgcttgagaaagccgcatgctataccgacgccacggtgctgaagtacaagctacaggctctcaaagcgaaccaggttaatgatatcgtggacgaaggagtcaagaggattgtgaaagcccgactggcacagcataagaacgagaaagaggctttcaaggataccgtttggttcaatcaagaaaaacgcatcccaatagtgagcgtacgggtctttgccagacccgacgcctccaagttggctattatcaagacagatgagaacaataaacctatcggtttcgcactgactggcaacaatcaccatattgccatatataaggacaacaccgggaaattagtgcagcacatctgcacattttggtcagcggtggaaaggaagaaattcggagtcccaactgttgtgaagaataccggcacgctctggagcgagctgcttcacaaggacctgccgggtacatttttggataaactcccccaggacgggctggaactagagtactctctgcagcaaaacgagatgttcgtacttggcctccctaaggaatcctttgaggatgctattaaaaataacgacctgccattgctgagtaagcatttatatctcgtgtggagcatctctgataatgactactggttccgtcaccatctggaaaccaaaaactccgagcttaagtcaactacaggagccaaggaaagtaaacgctactatcggtttcagagcgtcggcaccttcactaaggagaatcccattaaagtgcagctgaaccacttgggggagatcaccaagataggagaaccttga

SEQ ID NO: 3031 - RNA, 4059 nt, synthetic construct
  misc_feature 1..4059: note = Cas9 variant
  source 1..4059: mol_type = other RNA
atgaagaaaagaaacagggaggaatactatgtgggcctggacatcgggaccagctccgtcggatgggccgttgctacacccgattaccggattcctaagttccgcggtcacaaaatgtggggctctcgactctttgcagaggggaagcgtgccgcggaaagaaggcagttccggactaatcgcagaaggcttgctcggcgccgagacagactgcaaatattggaggaattatttgccgaggagatggcaaaagtggataacacgttctttatgaggctgaaggaatcaaagttctttctagaggacaaaaccgtaaaggaaaaacatatcctcttcagtacagataagtttgacgccgatcggttctataaagacaatccaactatttaccacgtgcgtaagcgcctgatggaggaggaaccgcaggatatcagagagctttttctggctgtccatcacattttgaagtataggggacatttcctctttgcaggcagcctggaacagaacggtgcctccatcgaggaactggtgcggaccctcttagggaaacagggactggctatacttgacgatacaatcgactctaatgagatggttaacattttgaagaataccggcgagactaaatcggatcgaaagaaagacgtgcaagaactgtggaaccccctaaaggacaaagtcaagaaggcccaggcggcagagatggccggcctcgtgctggggcttaaatcagatatcagcaagctgttcgctaatagtgactacaaagatttggactcctctattaagaacatcaatttcagctccggagattatgaagagaaacgcgacgattacgccaactcaataggtgacgatattgtactcctggacacaatgaaggcattatacgataccctgatcctcagtcagattcttcagggcaagagaagcatctctgctgccaaagttgaagactataatacgcacaaggagcaactgagggcgttgaaagccatcctaaagcctcacaaacggctgtacaacgagatgtttcgcgaaaataacaagaaggacctctccaactatgtggcatacatttcaagctatagtgaggggaaaagagtcaatagggaaggattctacaagtatgtgcaggctgtgctgaaacaggtcgatgactctgattccaagcaggccatacttgaggctatccgtctggaaacttttctaccactcctgcgggttaaagacaacgccgtgattccccatcaaatccaccaggcagagttagaggccatactggaaaccgctcgaaagaagtacaatttcctaaacgatgtaagcgacggcgtgtcggtcaaagataagattatccagctctttacattcagaatcccttactatgtgggtccactgaatccccattctggggagactgttgcggacaggaaacaaggaaccggctgggtggtccgcaagcagcggggcaaagtgtacccttggaactttgcagatatggtagacgttaaggcctccgctgaagccttcattacaaatcttaccaacaaatgcacgtatttgatcggggaggatgtgctgccaaagagatcactcctgtacagtgagtttatgcttctgaatgaattgaacatgattaagtatgacggacacgagctcccggtcgcaataaaacagctgtacatcgaacaggtgttcaagcaagagcacaaaaagcagactaaaggtagggtcttagattttctgaagcgcaatggcctaattacagggagcgccaccgctgtgatcactggaatggacgacgccatcaagggcgatctccagtcctatcgagacatggttcggattttcggtgcagggtttgatcattctatggcggaacgtataatcagatgggtgacactgttcggcgaggctaaagacattcttgagaacaagatcagggaagtatacggaaatagcatttcagatagtcagatgcgcgccatcaaaaagttgaaatacgcagactggggccggctgtcccaagccttcctcatagctgtcaaggggtgtgataagagcggagtggagagaaacatcattacctgcctgagggcctcttcacagaatttaatggaaatcctgagtgaccagggtacgtatattaaacagatcaaggcatggaaccaccaacataccacaaacatgatggatactcttgactaccagttggttgatgacctctatgtggctcccagcgtcaaacgatccatatggcagtctctgtgtattgtggaggaattggtaaagatcatgggccaggcccctaaaaagatttttgtggaggttacccgcacaaagcaagcggagaaaactaagaaagattcgcggaagaaaagactggtcgaactctacaccgccatcgggaaggagggagctgcatggaaaaaggaaatagaggcccaccaggctggcgacttcaggcgtaagaaactgtatctttactatacacagatgggtcgctgcatgtacagcaatgaaccaatcgccatggacgcattgtttacctccgcgtacgatattgaccatatctatccccaatcactgactaaggatgggagttgggacaacttagtgctcgtgaaatctcagctgaataaggagaaaagcgatcagtaccctcttcggccagccattagagagaagaacaaggctcactggcagtatctgtgtagggccggcttcatctccgaaaagaagtacgagcgattgatgcggacgacagaactcaccgcagaggagctgtcaggatttatagctcgccagctagtcgaaactagccaggccaccaaagcagttacaggcctgctcgagagaatttataccaatactgaaatctgcttcgtgaaggccgagacagtgtctcagtttaggcaccagcataacttcatcaaaattcgggaactgaataactaccaccatgctaaggacgcgtatcttaatatcgtagtcgggaacgtgtaccacgagaagtttacgaaaaatccctgggagttcattgcccgatccaccgaaagacgcccgtacaacttgaataggatgtatgattttgacctgttaaagcaaggacgtgttatatggcaagtgcctaaaagtctcgagactgtccaggcaatgatgaaaagcaacgatgtgcggatcactaaaaagctgcttgttcagaagggtgaactgtacgacgctaccattacaaaagcccacaaggccaaagagggcacttatttccccctaaagggggctgatgcaagactcagggacgtgcatcgctacggaggctatgagaaaatcaagattgcctactattctgtattttcctgtcgagaaaaggcgtcaaataccatccacacgctgataatcccaattcctgtctacaaagctggtttgctgcaaaccgaggccgacttaacagcatacgcctggcagactaagcagaaaaccaagcccatcaaagatatttatagtgctatcacaccaatatacaagaaactctgcattaacactgtggtgaagatcgacgggttcaagtatttcctgggcggaaaaaccggcgattacatgtggcttgaccccgcaatccctgtcgttctggatgaacaagccgcggcttatttgaaggccattagcaaagtggggagagcagacgatgtagagaacacggcccaggctatagacctcatcacagccgaagcaaatgaggctttttacgatgtgctgctaaagaaaatggaagccaagattttcgcgaaggcctatcagaccatcgtcgagaaactggcatcggagactgctcgggaaaggtttcgcgagctttccattggagcccagtgttcttgcctcctggaaatcttgaacctgttagctaataacaagacaaccttcacatttttcaaagacaagatgggcgtgaccatgagccgtagaaaacaaccaatggatctcacaaagctggaggagtgtatagtttacgaaacgtcaatcaccggtctttacgagaaggcagtgagtctgttgtga

SEQ ID NO: 3032 - RNA, 4059 nt, synthetic construct
  misc_feature 1..4059: note = Cas9 variant
  source 1..4059: mol_type = other RNA
atgggcaagagataccacatcgggctggacattggaaccagctccataggttgggccgtgatggatgacgatttcaaaatcatgagggtcaagggcaaaaaggggattggagttcggctctttgaggaaggcaaaacagctgcagagcgccgaggtcatcgtactacgagaaggcggtattctcgcagaaagtggaggcttaacctgttggaagagatcttcgaccccgaaattgccaaggtggatcctacctttttcgcgcggttaaaagagtcaaatctgagtccaaaggacgatcgcaaacagtacagcgggaacctaatctttccggagaaggctaaagaagagatacgagaatggacagagaagtatcccactatctaccacctcagaaatgccctgatgaccgagaacaggcaattcgacattcgggaagtatttcttgcactgcatcacatcgtgaagtatcgtggaaatttcttgtttaacggcaatttccagacaggcgaggtcaacctctccgatcgctttgacgatattaattctgccttcatctcggcttgcggggaagaggaagcacctcagataccatcagagctgtacaacgacattcaggagctgctctttgataaaaataccagaaagttagacaaccaaaaacagctggccactaaacttagccaggacaatgataaagactggagtacacagttctccaaggctttgttcggatataaaaccaagtttaaggtggttctgcaatctaacgaagatctagacgatttccagctcgacagcgatgacgccgatgacaaaatcgcgtccatttcagagcagatcgatgacgacaggggtagtatcctggataatattaagatactttacagccggatcacgctgaacgaaattgtgcccgacggcaaaactttgtctcagtccatgatcgagaagtacaacctccatcgagatcacctgaaagaaataaaggaccaattaaagcacaccgataattgggtcaaatttgacgatctgtattcacagtacgtgaacgggaagctcgagagcgaccgccataaaaagctgagttctgatgacttctataaaaaggtacttacattgtttgatggagagctaaagactagagttaaagaatggcaggagaagggcgaatttctgcctaaacaaaggaccggttccaatggggtgattccacaccagctccatcagaacgagctggaccagatcatcgaaaatcaaagcaagtactatccctggcttgcaacactgaaccctaatgagaaacggcagcgcgtcgccaagtacaagttgtcggagctcgtggcttttaggattccatattacgtgggaccgatggtcaccaaagatcagtctgacttcgcctggatggttagaaagtccgacgaaaaagagatcacgccctggaactttgatcaggtggtagaccgtgataagtcagcagaagagttcattaatcggatgactacaaaagacacctacctgataggcgaggatgtgttacctgctaagagtctgctatatgaaaaatttactgtcctcaacgagctgaataacatccgaattaatggcaagccacttacaaccgacgaaaagcaccaagtgtacagagatttgttccagaacgccaaaagcatctccacgaagaaatttcacaattatctggtttgtaagctcaacaaacccaaccatctgaatatcaccgggttctctgaccttacaaagttcaacagctcactggatagttacattgacttgaagaaaatatttgcggatcagatcgacgatcagtccctccaagacgacttcgagaagatgattaggtggagcactgtgtttgaagataaacagatcttcgagcgcaagctgtctgagattaattggttaaccgaccaggaacggtcagaggtcgccaaactgagatataggggatggggtcgcctaagtaagcgactcctggcaggcatccacgatgaaaacgggcagcggataatcgacgctctttggaatagccctaagaactttatgcaaattcaggccgaggtggctttcaataaacagatcaacgatttgaatacaaaggaactgtccgacaacaatgtagaggatgttctcgccgacgcatacacttctccacaaaacaaaaaggccattcgtcaggtgctgttagtcgtggaggatatccagaaagctatgcatggagacgcgcccacctcgataagcctggaatttgcaagagaggaacaggagtcctcaaggacacgcagtcggagagccgctctttctgccacctataggcaaattagcgatgaaatcgtctccgcaactgtgaagggcgagttgggtaaggccacgtcaattagcgaccgactctacctgtacttcacacagggaggccgcgacatgtataccggagagccgatcaatatagatgaaatctctcggggctacgagattgaccacatcctacctcagtcctttattaaagatgacagtctggataacagagttctcgtgaagggggctatcaataacggaaaaagcgccaactatgtaatggaccagtcttgggcacccgataggctggcgtggtggaagaaacttttggacaatcgtctgatatcccgcaagaaataccaatcattaactctcaccccaggtaagattaacaagtatagtcagaatggcttcatcaaccggcagctggtcgaaacaagacaggtgatcaaacttgttgctaatattctgaacgatcaatacagcaatgacgataccaagatcattgtggtcaaagccgcattgaactcgcagctcagggggtttctggagctattcaagaatcgaaacataaatgactatcatcacggaatggatgcctacctgtccacttttatcggcaactacctctataaaaagtaccctaagctgcggtcttatttcgtgtacggtgagttcaaaaagtttagcgggaaacagaatcttaagtcattcaactttttgcacgacctggaagacgatagtattaatatcatttccaacgacgatggcgagatcgtaggaaaccatcacgaaatgatagaggaattagagaaggcttatcaatacaagtatatgctcgtgtctcgcgaggttttcgaaaagacaggcgacctgtttaatgtcacggtgtacagcagaaaagccaagaaaacccttatccccattaagcaggataaaccaatcaacatttacgggggatattccggtaataacgacgcatacatggctatcgtgaagctgcccggcaagaaagggaagcctgatacttataaaatagtcgggattccactaaggttcgccggcgagctcgaacgggcgaagcagctgggtgagtcagcctaccgagaaaaattgagcgctgttatcacaccgcagtttaccaaggagaagaaagacagaaagacaggggagatcactaaagtggtggatgacttcgaagtagtcctggatcgcgtgccctataggcaattatttaaggacagtgataaatggttcatgctcggctctgcagcctaccagtataatgctaagcagctggttcttaacaatgacgacgtgaaactgttgaacgagcagggacgtaagaagctcgaactgcctaatgagaaactatccagcgccctgaacgatgtctttgaccatattatacaaatcatgaactcgaagttcggcctttacgataaaaatgggttccggaccaagctcacggaagcagcgtcaattttctacgacctgccattgagagccgagtataatggaaacaaaaaggtgaccgatggcaagctggaggttttagacaatatcctcattggtctgcacgctgatccctctttcgggaaccttaaacagctgaatatgagtacaccttttggacagatgcagactaagggcggtgtggtattgaacggcaactccaccctcatctaccaaagcccaacagggctgttcgaaaggcgcgtcaaactaaaggacctgtctaaatga

SEQ ID NO: 3033 - RNA, 4059 nt, synthetic construct
  misc_feature 1..4059: note = Cas9 variant
  source 1..4059: mol_type = other RNA
atgaagaaaatcctgggcctcgaccttgggaccacaagcattggatgggccttcataaacgagggtgaaaatgataacgagacttcctctatcattaatgctggcgtgagaatcgtccccctgacgaccgacgaagaggcagattttaagaaagggaacacaatttcaatcaatgccgacaggactttgaagcggggagcgcgccgaggcttacagcgtttcaaacaaagaagggatgctctgctacagagttttcggggtataaacttcatcagctccaattacgtttatgccgaaaccgggaagcagacaaccttttcttcgtacaagctccgcgcaaaatcagccactgagctggtgacaaaggaggaacttgtacaggtgctgttgatgctcaacaaaaagagaggatataaaagcagtaggaaggctaagaccgcagaggaaggcgacgccattgatggcatgaaaatcgctaaggagattttcgagaataacctgacgcctgggcaatgggtctacaattccctgtctatcggaggtaaatttataccagacttctatcggagcgatctccagaaggaagtggagaaaattgttcgctttcagaaccagttccacccggaacaaatgaatgagaagttactggaaaacatccagggcaaagcccgaactgtgacctcccagtacttttcaaggattcttaatatccccttggcggagaacaaggggacaagagaggaaactaagctgcagcattataaatggcggaacgaggcactaaccgaggaactcgacctgaaggtccttgccttcatcattacagaaataaataaccaaatcaatcagagtaacggatacctgggcgctattagcgatcgttctaaagagttgtactttaatcaggagaccgtgggtcaattccagtataaccagctcaaggaaaatgcccacacgaaactgaagaaccaggtattctaccgccaagactatttagatgagtttgaaaagatctgggagactcagtccaaattctaccctgaactgaatgacgagctcaagtcagaggttagagacataacaatcttttatcagaggaaacttaagagccagaaacatctggtgagtttctgcgaatttgagaaggggcacaaggcaattccaaaatcttcccccttgttccaagaatttcggatctggcagaacattaataacatcgtcgtgaagaatgagaccactaaagagcctttcctactgggagaagatctcaagaaagtgattgctcaggagctgagctttaaggaatcgatgacagactctcagcttctgaccttctgtgatttgaagaaaggcacgcataccgtcaactttaagaaaatagagggcaatcgaacaaacacttccctcttcaaggcctttgagaaaatcctggttttagaagggtacgacgagctggatctatcaaagctcgacgcgagtgatattaaaagcatcatcaagtccgccttctctgacctggaaattagcaccgcaatacttgatttcgacccaacaatccaaggaaacgattatgacaagcagtcatactaccagttgtggcatctgctctatagttccgaggaagacgattttctgaaaaagagccttatggacaaattcggttttaaggagtctcatctgcccttcttgctcaatattaacctgcaggctgattacggctcattaagtgccaaagctatcaagaaggtgctgcctcacctaatggacgggcacatttatgataaagcctgcactctcgtaggatacaatcacagctcctctctgaccacagaccaaaacaatgaacgcgtgcttaaggataccttggagctgctcaaaaagaactcgctgagaaatccagtcgtggagaaaatcttaaaccagatgataaatgttatcaacgcaattatcaaggacccggccatgggcaagcccgatgaaattagggtggagctggctcgggaacttaaaaataacaatgagcagcgcagcgaaatgactaaggcgatcaacaaatccacgacagagcacgagcaaataagaaagttgctccacaccgaatttggtattcatagggtcactcgtaatgacatcattcggtataaactgtggaaggagtgtgatgggatctcactatacaccggcaagcctatagaaccaagtaaactgttcacaaaggactatgatatcgagcacattatccccaaatctcgactctttgacgacagcttctccaacaagaccatttgcgagagacagctgaacatcgataaatcaaataagactgcatacagctttttccaggaaaaactttctgccgaggaatttgaccagttcgagaagagggtgaagtccttgtttggaaaaataagtcgcacaaagcaaaacaaactgttaatggctaataacgaaattcctgagggcttcatcgatcggcagctcagagagacgcagtacatcgccaagaaagcaaaggaaattctgcttgaggtaagcaggaatgttaccgccactatcgggtctgtgacagacaagctgcgcgatgactgggaattggtcgatgtgatgaaagagctcaactgggaaaagtatgacaaactgggactaacctacattgaggagggtaagaatggcgaacgactgtataaaataaaggattggacaaagcggaacgaccatcgtcaccatgctatggatgccatcactgtcgcattcaccaaaccagcgtacattcagtatctcaataacctgaatgctagaacgaacaccgacaagaaaggaaattccatcattgggatcgagaacaagtaccttaaaagggataagaataacaagttgcgctttatagaacccatcccgaacttccgggaggtggccaaaaagcaactggaatcaattttaatcagttataaagcaaagaataaagttgtgacaaagaacaagaatgtaactaaaaagagcaacggcaccaatcagaaaattcagctcacacctagaggtcagctgcacaaggagactgtctacgggaaacttcaacagtacgtgaccaaggaggagaaaatcaacgccaattttacgcccgaatatgttacaaaggtggctaagaaagaatacagggaggccctgctaaagcgactcatagagaacgaaaatgaccctaaaaaggcattcaccggcaaaaacgctctgtcgaagaatccaatttatatctccttggagaacaatatcctggtccccgaaaaggtgaaaattgtatggttaaagtctgactacactatacgcaaagatatcacaccagacctcaagattgataaagtgatcgacattggactgaagaccatccttcagaaccggctgaatgagtttaacggcgatactaagaaagccttcgttaatttggacgaaaaccccatatggcaaaacaaggagaaagggatcgcgattaagagagtcaccatcagcggagtgtcaaatgcccaggctctccacacgaaaaaggatcatctgggtaacgagattctagacgaaaatggccagcctctgccagtggattttgtcagtacagggaacaatcaccatgttgcaatctatagggacgagaagggaaaccttcaggaagaggtggtgtccttctttgaagccgtaacccgtaataacctcggcctgtctataattaataaaaaccacgagaagggttgggagttcttgtttagcatgaaacaaaatgagttcttcatctttccgactgatgggttcaacccccacgaaatcgacctgttaaatacagaaaactaccatctcatttcccgcaatatgtttcgggtccagaagatcgctaccaaaaactatatgttcaaccaccatctggagacaaagtcagtggacggcgaaatgcttaaaactaagaagcagctgagcaaaataagttaccactttattcagaccccttcttacttgaattatatcattaagatcagaataaaccatctcggacaaattgttcagctgggcgagtactga

SEQ ID NO: 3034 - RNA, 4059 nt, synthetic construct
  misc_feature 1..4059: note = Cas9 variant
  source 1..4059: mol_type = other RNA
atgaagcaggactactatatcggcctggatatggggaccgagagcgtgggatgggccgtcacagacgttgattacaacctcattaaaaagagaggtcaagactattggggcgtgtaccttttcgatgaagctcagactgcacaggggaggcgggcctttcgcacgaatcgacgtagactggcgagggtacggcaccgcttgaacttactgcaggagctattcgactccgaaatatctgctaaagattttggattcttttatagactcgaaaattcaaagtacttcgacgaagataaacccgagatcgccaggggcaagtttctgcttttcaacgacaaggattttggtgacaaagagtattacaagaattaccctaccattttccatctgcggaacgcattgcgcacacaagaaatcaaagatgtgcgactcctgtatctggccgtccaccatattctcaagaatagagggcactttttattcggagagcaggactttaacgtgaatgacgctagtgatgttagcggcgagttcgagaaaatcaacaggttcctgtccgagaatgacggcgcagggtttgatcgggaaaagataccagagatcttcgaaactctttgcaacgagaatttggccaagcgtgaacgcaaagagaagattctggagctagctggaaactctaaaaataagctcctgggtgaagccgtgaacgcggtcgtgggccttaacttttcgctgtcaaaaatgttcggggaggacagagattttcagggagaaaataagatgagcttcaccgacagttcctttgaggaaaaattggcaaaggccaggatggctctcgatgacgatgaggccgacttcctggagacattaaagaaagtacagtctgttgcaagcctgcataacatcctccacggcaaggaatttatttccgaggctaaaaccgaagcctacgagactcaccggcgagatctttcagaactgaagaaatatgtgcgcgagaattgtccggagaagtacgcgttggtcttcagaaggcaagtgaagaaaggtaagaaaaacacaagtggggccgacgaaaatgagaaggacgataaaaaggtgaacaattatgcagcttacatcggaatggacaagggcaaaggctttgaaaagtgcaaaaaggaggatttctatgcctttctgaaaaaggagatagggattaacgacgaaagcctactcgctaagatcgatgagggaattttcctgcccaaacagatctctgccgaaaattgtgacatcccttaccaggtccatcttgcagagctgaaggccattttggctaacgcggaaaattacttcccatttctcaaacagaaggatgagaactgcgagatgaccgtttccgagaaaataatctcactgatgaagttccgggtgccctattacgtaggtccttttacggacaaagaaactcgcttcagctggatgattaagaaggaaggcttaagtacccagaaaatcacaccatggaattttgatgacgtggtcgatagagacgcatctgagaagaaattcatagaaaggatgactaacttttgtacctatctgacaggggagaaggtgctacccgcctccagcttcctctactcggagtatgcttttctgaatgaacttaacaacttgaaagttaatggaaccaaggatctgcgtgtgaagaacattctcttcgactttgccaaaacgaataagaaactgactcttaagaaatgctgtgagcaactggtcaagaacggcttgctccctgaaggttctaaggcacgggacgtgttctccgggacagatggcgactttaaaaattcactgagtagctacatcgatttcaagcgaatcattggagacaaagccgatttatatagagacatgtgcgagaagatcattctgtggataaccgtaatctccgataaagaaaggctagttaagattatcaaggacaaatacggcactgtgctctctgatgaggagatcaaggggctgaaagctcttaactacacaaagtggggacgcttgagcgaaaaactgctcgacggtattttcgagaccgattcagaaggcgaggtcgggaatgtgagtataatcgagaagatgcggacggacaccgaaaactttatggagctgttatccaataaacacaactataagagagccattgaactggcaaatagcgagtctatcgtcgatgaaagggtgacataccgcgcggttgaggagctttattgttcaccagctgtgaagcgaagtatttggagcgccttgaaaatcgtacgggaaatagtcaaggtgcagggacattccccgaaaaagatcttcgttgagactacccgtgaaaaacccgacgtgacaagaaagggccaaaggactgtctctcgcaagcagcagctcctggacaaataccgggagaacctaagaaatgaaaccgagctgattaagaaaatcgaggaaacagaggattcgaagtttaacagcgacaaactcttcttttatttcacccagatgggtaaggatgcatacactggggaaaagattgagtttgacgatgtgttcaaaacggaaaagtatgacatcgatcacatataccctaggtccaaaattaaggacgattcactggacaatcgagtacttgtgcgccggaaaatcaaccaaagtgttaagaaggattcttacccattgagcgccgagattagaaacaggatggagggcctgtggcgtcagttacgcgacaaaaagctcatctccgacgaaaaattttatcggctgacaagatcaactccccttactgagaaggaatgcggagatttcataaatgctcagctgatcgccaccagccagtctgcaaaagctgccattcaattgctcaagaggatgctgcctgagtccgagatcgtctacagtaaggcgggcaacgtgaatgaatttaaaaagcgactagagttcgtgaaaattcgggaactgaacgacctccaccatgccaaggatgcttatttcaatatcgtcgttgggaacgtgtttaatacaaaattcaaccacaatccagcagtgtttcagcgcagcaacggaaccggtaattacgacttcgagagactgtatgattttgacataactaacgcctggaagaaaggcgatgaaaataggattcggtctgtagctgagaagaacacatgtcgagtcgtgagattctccaagacggagaaagggcagttttacgacgccaccatctatcccgcaggaaagaatgataaacttgcgccggttaagggcaaagcccctttgaacgacacttcaaagtacggtgggtacgataaggaaacaaccgcttatttcatgctggtgaaaagtcgcgacaagaaaaagaaagataagacattactcagcctggagtgcgtcactgtgcttgccgacaagaactttaggaccgcagaagacaaactgaagtactgcgagaaagaactaggcctcaaggagcccgagatcctgattgagaaaatcaagttgaatacgctgttcaagattaacggatcgtatgcttggatacgtggccggaccaatgatagattagttctctgtaacgccaatcagctgtggcttgacaacgggtccgcaaaagaactgaagaaaatctctaatcattttagggatgtgaagaaatacaacaataaggacttgccagtacgcgaagaggagttcagcaaagaacaaaacctcgccctgtatgatctatttacagagaagctgggaggcaagatttacgctggtcttcctgtccaggggcagatcaaaaatctcgaaaagggacgagacaaattcgaggcgctggaattgaaggatcagctgttcgtgttaatggagattctcaaatttatgcaatgcaactcaatgaccagtaatatcaagctgataggcggtgccgagaacgcaggcaagaatagaatctccaaacttattcaggactctgatgtgaagatgatcttctgtagccccaccgggtatttttgcaaagtcgttgacttcaagcggtttctgtga

SEQ ID NO: 3035 - RNA, 4059 nt, synthetic construct
  misc_feature 1..4059: note = Cas9 variant
  source 1..4059: mol_type = other RNA
atgaagaaaatcctgggcctcgaccttgggaccacaagcattggatgggccttcataaaggagcccgaaaaagatgtggtcggttccgagatcgttgacatgggcgtgagaattgtacctctgtcttcagatgaagagaacgactttgctaaggggaatactatcagtattaacgcagataggacgttgaaacggggagcccgccgaaatttacagcgtttcaagcaaagaaggaacgcgctgctagaaatctttaaggagaaaaagctcataagcaccaatttcaaatacgctgaggacggcccatcctctacattttcgactctgaaccttcgggccaaggcagccaaagaaaagatcgagctgcaggatttggtgaaggtcctcctgcagattaataaaaagcgcggttataaatcaagcagaaaggctaaaagtgaagaggacgatgggtccgcaatcgactctatgggaattgccaaggagctgtacgaaaacgatctcaccccgggccagtgggtgtatgaggctttacaaaaaggcaggaagaatgttcccgacttctaccggagcgatctgcaggaagagtttaagaaaatcgtgaactatcagtccgagttctttcctgacatattcaatgcctcatttgtcgaagactggatggggaaggcgagtacaccaaccaaacagtacttcaacaagaaaggagtgcaacttgcagagaataagggtaagcgcgaggaacgaagattgcaggaatataaatggagggccgaggctgtaaactttaagattgatctgagcgaaatcgccctaattctctctcagatcaattcccagatctcaaacagcagtggctacctgggggcaatttctgaccggtccaaagagctttacttcaagaacctgactgttggacaatatttgtaccagcagattaaaaagaatccccacacacgtctcaagggccaagtgttctatcgccaggattacctggacgagtttgaaagaatctggagcgtccagtcgtctttctatcctcagttaaacgatgctctgaaaagggaggtgcgggacattaccatctttttccaacgacgcctcaagtcccagaaacatcttatatcaaattgcgaatttgaggatcaccataaggtggtcccaaaaagtcaccccgttttccaggaatttagaatttggcagaacctgaataacttgctactgatcaagaaggacaatctcaacgagaaattcgatctggagcttgaaagcaagatcgccctggcgaatgagttggcctttaaaagggaactcaacgtgaaggacgcactgaaaattttaggtctgaagcctaatgagtgggagttcaactttacgaaaatcgaagggaatcggactaaccaagcattctttgatgccttcgctaagattatagagctagaagacggagagccaatcgacctcggcgatctgaaggccgacgatattcttgaccagttctccgaagcatttttgcgcatcggcatcgataccgagctgctccaggtaaattctgacattgagggggccgaatacgagaaacagagctatatacaattctggcatctgctttactcaagtgaagatgaccagaagctgaaattgaacctcatcagaaagtttggattcaaaccggagcacgctaagattctggcgtccatcagcttacaggatgaccacgcatctctgtcaagtagggccattaagaaaatcctaccccatctccagagcggtctgatatacgataaggcttgtacatatgccggctacaaccactcctcttcgtttactaaagacgaaaatgagaagcgtgagcttcgggcagaattggagctgctcaaaaagaacagcctgcgaaatcctgtggtcgaaaagatcttaaaccaaatgattaatgtggttaacgccatcctgaaagatccagagcttgggagacccgacgaaattagggtggagatggctcgcgagttgaaggccaatgcagaacagcggaaaaacatgacctccaatatcgcgtcagctacaagagaccatgataagtatagggagatactcaaaagtgagttcggactgaagcgcgtcaccaagaacgacctactgcgatacaaactctggctggaaacggatggcatttctctttatactggtaagcctatcgaggccagcaaattgttttccaaggaatacgacattgagcacatcataccaaaagcacggctgttcgatgactcatttagcaataagacaatctgcgaacgtcagttaaacattgataaagccaatgtgaccgctttctcttttctccaaaacaagctgtccgccgacgagttcgaacagtatcagagtagagtaaagagcctttacgggaaactgtctaaggcaaaaatccagaagttgctcatggctaatgataaaattcccgaggactttatcgccaggcaactgcaggagactcgctacatatccaagaaggcgaaagaaattctattcgagatctcacggagagttagtgtgacaaccggcacgatcaccgataagctgagggaagactggggactcgtcgagattatgaaagaactgaactgggagaagtatgataaacttggcttgacatacactatcgaggggaagcacggagaacgactgaacaagattaaagactggagcaagcgcaatgaccatcggcaccatgccatggatgctttaaccgtggcactcacaaaaccggcctatatacagtacctgaacaatcttaacgctaagggtctgaataacaaaaagggcactgaggtcttcgccatcgaacagaagtatctaaaaagagagaatgggaagctctgttttattcctcccatcgaaaacattaggtcggaggctaaaaagcacctgtcccgtatcttggtgtcttacaaagcgaagaataaggttgtgaccataaacaaaaataagacaaaaagcaaggccggactgaacgagcaaatcgctttaaccccacgcggccagctccataaagaaactgtatatggtaagtcattccactacagtacgaaatttgagaagattggggcctccttcaatgtccagaagatcaacacagtggctaaaaaggaggaacgggaggcactgcttaaaagactggccgaaaatggcaacgaccctaagaaagcatttaccggaaagaacactttgaataagatgcccatttacctcgatctgggcaaaaacatcaagctatctgagaaagttaagaccgtggtcctggaacagaattatacaataaggaaaaacattgacccagatcttaaggtggacaaggtaatcgatgtggggatcaaacgaatactcgagagccggctggaagagttcggaggtaatgccaagttggctttttccaacctggaggaaaatcccatatggttaaacaaagagaagggcatctcaattaaacgcgttaagatcagcggggtcagtaatgtggaatctctccacgtgaagaaagaccatttcggagagcctattctggatcaagaaggcaacgagatcccagtcgactttgtttccaccggtaataaccaccatgtggcgatatacgaggatgaaaatgggaaccttcaggaggaagtggtcagcttctttgaggccgtagtgagacagaatcaaggcctgccgatcattaagaaaaaccacactttgggatggaagttcctcttcacactgaaacagaatgaatattttgttttcccctcggacgactttgtgcctgcagatgtcgacctaatggatgagcagaactaccacctgatctcaccaaaccttttcagggtgcagaagattgctcggaaaaattatgtttttaacaatcatctcgagacgaaggccgtggacaacgatctgttgaagtctaaaaaggaattaagtaaaatcacctaccacttctatcaaactcccgagcatctgcgaggcataattaagatcagaatcaatcacctcgggaaaattatccagataggagaatactga

SEQ ID NO: 3036 - RNA, 4059 nt, synthetic construct
  misc_feature 1..4059: note = Cas9 variant
  source 1..4059: mol_type = other RNA
atgaacaagaaatactatctgggcctcgacatcgggaccaatagcgtgggatgggccgtcacagatgagaactacaatctttataagtacgctggtaaaagaatgtggggcattaggctgttcgaagcagccgacactgcggctgagcggcgcatgaagcgatccaaccgtagaaggttgtctcggaaaaagcagcgcatagatttactgcaagaactattttcagaggaaatcgttaagaaagacctcacgttctttattagactgaatgagagtaggcttcacttcgaggataagagcaccggggaaaaatatcccctgtttgtggacaaggagtacacagatatcgactatcataaacagtaccctactatgtaccacttgcggaaggaactcattgagaacccagagccgcatgatatccgcctggtatatctggcctgccaccatatactcaagaatcgaggacacttcttaatcaacggctccatttctgacgtgaaaaatctgtcgtttgtctgtggtgaaatgatcaaggagttcaactcagtgagcgaatacgagattagtcttaccgatatcagagaattggagaggatactgtccgacaaaaagacagcaaaatctgttaaggccaaacaggtggctcagctatttgagtgcacccccgcagaagataaggagcaacagaagtgtgccaaagctattatcactaatctcagcaagctgattgtcgggcttaaaggaaacatctccaagatgttccaccagcctctggaagagatctcaacaaaaagttttaagttcaccgaagccaagtatgaggacgagattatgccagcgatagaagagaattaccccgactatgcaagcgtgatcgatcggattaaaggcgtatacgactggtctgttttggtggaaatcctcgatggcgaggactatctgtcctttgccaaggtcaaggcttacgaaaaacatgggaaaaacttacacatactgaagaatgtgatgaagaaatactgcaaggatgaggtgtatcaggccttcttcaacggaattaacgagaaaaatggttacggcaactatatcggggcaatccgtaagaatggacatacgtacaaaatggaccgctgtaagtcagaagaggatttttataagggcctccagaaaattcttagcactatcgtccctgaccaagaagatgaggagctgttggaaaagctaaaagctgaggttgaaaaccagaccctgctcccactggccagaagtaaggagaatggtacaattcccaaccaggtgcaccttcaagaactgatgaaaatattggacaatgcgaaggagtacctcgatttcctgaaaaaggaggacgaatatgggactatcgccgagaagattatctctatcgcaaaatttaggattccttactacgtaggaccattatcccggcgacacaaggaagagggcagcaactcgtggatgatacgcaaagaagagggcagaatctatccgtggaatttcggggacaaggtggatgtcgagcagtctaacaaagaatttattgagaggatgaccaataagtgcacatacctgatcggagaagacgtgctacccaagaactccctcctgtattcaaaatacatggttcttaatgagttgaacaatctgaagattcggggtaacaaaatcagtgtggaactcaagcagcgcatatataaagatctgttctgtaccatggctaaggtcacgggcaagagaatccttgagtacctgaaaatggaggaccctgaaattgtgcaagaggatatcagcgggtttgacattgatttcaagtccgccttggcttcttatctcgactttaaaaagcaggtagttggaaacgaaatcgagaaagatcattacaaggagataattgaagagatcattaagtggaaaactatctacgacgatgacagcaagatgatgaggcgtatgatagaacgggagtatccagaagtgttcgataaagagcagatcaagaaaatttgccagctgaagtactcaggctggggtaattttagtgaccgattcttaaacggggtcagaggcgccgacaaagagacagaagagtcctataccatcattgaagcactgtggaagactaattacaacctaatgcaactcctgagcaagcagttttctttcaaagaggaaatcgatcagataaatgccgagaaggctggagacgtgggcaaaattaactatgagaatacagtcaaggatcttatcgtgtcacccagtaacaaaagggcgatctggcagaccattcaaatcgcagaagagattaagaaggttatgaaatgtgaacctgagcgcatattcatcgaaatggccagagggggagagaaggagaaaaagcggacggtgagcaggaaaacccgcttgcaggaactgtacgctggttgcaaggacgatacacgaaattggatgaaggagattggcgaccgggaagaacgtgagtttaactccagaaaactctatctgtactacactcagatggggaagtgtatgtataccggagatgaaatcgacgtagatgccttaatgaaaggcaattctaactgggacattgatcacatctacccacagtcgaggataaaggacgatagcctggacaatatggtccttgtgcgcaaagacgttaacaataagaagcggaacaaaatcttgtcccccaagattagagaggatatgaaaggttattggacaatgctctgccaaaaggggctgatctcaaaaaggaagtacgaccgactaactcgcaccacagatttcaccgacgaggagctgagtggctttattgaacggcagctcgtggagactagacagtctagcaaggcagtcgccgagctgcttaacaggttgtataaagattccgaagtggtatacgtgaaggctggactggtttcagacttccgtcatgataatgacttactcaaaagccgccgggtcaacgattatcaccatgccaaggacgcatttctgaatatcgtggtgggcaacgtctaccacgttagattcacgtctaatccgaggaaatggataaaggataaccgagactccaattacagtattcggcgcgtgtttaactatgacgtgaaacagggggataagatcgtatggcacggaagcgagaatggtggccattctatcgaccaaattaagaaaataatgtccagaaacgatatcctttacacagaatatacctactgcgagaaggggcagctgttcaatgaaactttggcgaaaaagggaaacgagaaagctattgccctcaagaagaatctggaccctgtcaaatatggcggttacaccacacccaagacctcagcatttgccttcgtggagtttgatgggaaaaagaaagaaaggaagaaccacatcgttgagattccagtgtatgtcgtgaatatcgctaagcgggaacctgacgccgttaaaaagtacctagaggaacgaaaaggctacagtaacgtggtaataaagaaatatcccatcaagaagaacagcctgattaaaatggatggatacctcgcaagactgcgcggcgctaatgagaaggacatcattcttaaaaacgccgtccagttgatcctgaataaggatttatatgagatagtgaggaaaattgaaaagtacctcgagtataacctgcaataccaggcggacgccaaattcgaagggtttactatgaaggatcttaatatgatctatgaggagctgtacctaaagctcaaagaatcgatcttccagaagcgtccagctcagcaaatgaaaacactggagaagggaaaagaagcattcatttccatcgagaacttgggcgaaaaggccaaggtgataaatgagattatcgctatgtttcggtgtgacgccacgaccgtcgcaaacctgaaagttattaatggttctcagaacgcggggagcatgaaggtgaataaaaacactttaacatcaaagagtctcaaactggtacatcagtccatcaccggacttttcgagacagaagaggaactggtgtga

SEQ ID NO: 3037 - RNA, 4062 nt, synthetic construct
  misc_feature 1..4062: note = Cas9 variant
  source 1..4062: mol_type = other RNA
atgaagaaaaagtactatctgggcctcgacatcgggaccaacagcgtgggatgggccgtcacagatgagaattacaacctttgcaaattcaatggtaagaaaatgtggggcattagactgtttgaagacgctaagactgcagccgagaggcggacgaagcgctccaaccgacgtagaatagcgaggaccaaacagcggatcgatttgttacaagaactgtgtgagaagtctattttcgaaaaagaccccacatttttcatccgcctaaatgagtcaagtctccacctggaggataagagcactggggaaaaatatcctctttttgttgacaaggagtacaccgatattgactatcatagagaatacccaacagtgtatcacctgaggaaggagttgatcgagaacccggaaccccatgatcctcggctcgtatacctggcttgctgtcacataatcaaatcccgcggacatttcctggtgaatggctctatttcggacgccaaggatctctcatttatctgcgagaacatgattaatagcttcaacgcagccagtgactacaaaatcaatatacaggatatgaccgctttagaaactattctgacagaccgaaagatggcaaaatccgtcaaggccaaacagatcgtgcagctttttaagtgtattccatgcgaggacaaggaacaacagaaatgttgcaaggctatcatcaccaacttgtctaaactgattgttggtctaaagggggatataagcaaaatcttcaatgagtcctttgaggaaattaagtcattcaagtttgccgagacgaaatatgaagacgagatcctccccactatggaagagatataccctgatcacgcggagattatcgaaaagatcaaaagtatttatgactggagcatcctggatgagattcttgacggagaagagtacctgtctttcgcaaaggtgaaagcctatgaaaagcacaagaaaaacttgcatgatctcaagatactgatcaaaaagtactgtgacgatgagacctatcagtccttctttaatggcatgaacgagaaaaacaagtactcaaattacattggcagcatcagaaagaacgggcacacatataaagtcgaaaagtgcaaaagttctgaggacttctacaaggaattactgaaactcctttccagcgtgaatccaggacaggaggatgagtcgctgttggaacaaatcaagtttgagactgaaaaccagaccctactgcccctcctgaggacaaaagagaatggtaccattcctaaccaggtacatatgcaggaacttataaagatcctggacaatgcttctaagtatttggacttcctcaacgagaaagatgagtacggcacgactgccgacaagattatctccattgcaaaatttaagatcccatattacgttgggccgctgtcagatcggcacaaagaaaatggaagtaacagctggatggtgcgtaaggagaatggccgcatatatccctggaacttcgacgataaggtcgacgctgaaaaatccaataaggagtttatccaaagaatgacaaacaaatgtacctacttaattggtgaagatgtgctgcctaaaaattctctactctacagcaggtatatggtgctgaacgagcttaacaatttgaagatccgggggaacaagatttcagtcgagctgaagcagcagatctacaatgacctcttctgcactaaagcccgagttacaggaaagaacatactgaattatcttaaaaaggaagatccagagctggcggccgaagacttgagtggctttgatgtggacttcaaatccgcactcaccagctacctggattttaagaagcaagtagtgggcaacgagattgaaaaagactattacaaggagatcattgaggaaatcataaaatggaagacgatctataatgaggactctaaaatgatgaagcgcatgattgggagagaataccccgagaccttaaaccaggatcagatcaaaaagatttgccacctgaagtacaatggatggggtaacttctcagagacatttctaaatggcatcaaaggggctaacaaggaaactggagagtgttataccataattgaagccctctggaaaacaaattacaacctgatgcagcttttgagtaagcaattcagcttcaaagaggaaatcgaccagatcaatgctgagaagactggcgccattggtaagatcacctatgagaacctggtcaaagatctcgtggtttcccctgcaaacaagagggccatttggcagacaatacagatcaccgaagagattaaaaaggtgatgaaatgcgaaccagagcggatctttattgaaatggctcgcgggggcgagaaggagaagaaaagaactgtctctaggaagacgcgtctgcaagaattatacacaggatgtaaagacgatacccgggactggatgaaggagatcggcgatcgagaagagagagagttctcgagcaggaaactgtatctttactatactcagatggggaagtgcatgtacaccggagaagagatagacgtggatttgctcatgacagcaaattccaagtgggacatcgatcatatttacccccagtcacgcatcaaagacgatagttttgacaacatggtactggttcggaaggacattaataacaatgtgaaaggtaacaatatcgtcccgtctagcatacagaaggaaatgacctcctattggaaaatgctactgcaaaaggagctcatttcaaagaaaaagtacgaaagactgactaggagcacagatttcacggacgaggagctttctggctttatcgaacgccagttggtggagacccgacagtccagtaaagcggtcgccgctctgttaaaccggctctataagaatagcgaaatcgtgtacgttaaagccgggctggtgtctgatttccgtcacgacaacaaacttctgaagtccagaaggattaatgattatcatcacgcaaaggacgcctttttgaacatagtagtcggaaattgttaccgcactaagttcacagctaaccctcggcagtggatcaaaaagaatagagataccaactattcaattaggcgagtgtttgacttcgatatcaaacaaggcgacaagattgtttggtacggtaacaaaaatgagaacgggaagcatacaatcgatcagataaagaaagccatgagtcgcaatgacatcctctacactgaatatacctactgcgagaagggcaaactgtttgacgagacgctaaccaagaaaggaaacaagaaggcaattcccctgaaaaagaatctcgatccactgaaatatggcgggtacacaagcgtgaagacttcggcgttcgcttttatcgagttcgacgataaaaagaaggaacggaaaaaccacattgtcgaaatccctatatatgtggccaatattgcaaagagagagcccgaagccgtaatcaaataccttgaggagcagaagggatatgtgaacatcgttgtcaaaaagtacccaattaaaaagaactccttgctgaagatcgacggttacttagctaggctccgtggcggggattctagcataattaccctgaaaaatgccgtgcaacttgtgctggacaagaaatcatatgaaatcattcgcaaggtcgagaaatacctagatcacaatagtaagtatgaagcaaactccaagctcgagaaattcaatgaaaacgacctgaatatcatatacaacgagttgtgtctgaagttaagaaattctatttatcagaaacggcccgttcatcagctcgagacactggaacagggaatcgataactttaggagccttgagtccctgaaggacaaagctaagatcattaacgaattgctcgccatgttccgatgcgatgcgaagactggcatggacctgcggctaatcggtggggcctcaaatagcggccgcatgagaattagtaaatctaggctgacctccaagagccttaaactcataaaccaatcggtgacgggactgtttgagacagaggaagagttggtgtga

SEQ ID NO: 3038 - RNA, 4062 nt, synthetic construct
  misc_feature 1..4062: note = Cas9 variant
  source 1..4062: mol_type = other RNA
atggagaagaactactatctgggcctcgacatggggaccagctccgtgggatgggccgtcacagatgaaaattacaaccttatgagaaagaagggtaaagacctgtggggcgttaggttgttcaaggaggctaaaacttctgcagaacggcgcgtgaagcgaacgtcacgtagaaggttacagcgggagaaggcccgcatcgggtatctgaaagaactatttgcggatgagattaataaggtagacgctggattctaccaaagaatggaggatagtaaatttataagcgacgataagaccgtgcaccagaaattcacactcttttccgacactaactataccgatgaagactactataatgattaccccacaatcttccatctgaggaagaaacttattgagtctgacgatgaatacgacgtccggatggtgtttctggccttgctcaacatgtataaacaccgcggccatttcctgaatgcaaacctgtcggacaatggtatgggggatatcaacgagcagtacgaccgactcaaggagttatgctcagaatatctgaatgttgagtgggaaaacaaacctgataagtttgaggaaattcttaaagagtgtaattgcagcaacagtttgagaaatgagaggctgctagaaaccttcaacctcaagaaaactgacaaggagaagtgtgaaatgctgaaacttatctgcggactgtccggcacattgtctaagatatttaaagatctcgacgatgacagcgagaccaagaaaatgacgatctccttccggtcaagtaactacgatgaagaggccattaatgtggaggaaatcattggcagcgagaactttgaaatcatagctgtcctgaaggagattcacgactggtctatgttagcaaatatcatgcgtgggaagaaatatctgtccgtggcccgcgtagaagagtacgagaagcataaagatgacctcaagattcttaaaaaggttatcaaggaatattcaatcgaggaatacaacaatttcttcagagtgatggctgacaacaattacagcgcctatgtcaacagtgtgaatagcaacaaagagtccactaggcggggagcgaagtgtgataatgacacctttttcaaagagattaagaaaatagtgaacaagtgctacgatagcgaagagaaggaatatatcctgaaagagattgaaaagggtacatttttgccaaaacagatcatatcgtctaatggcgtcattccgaaccaagttcacaagatcgagatgaaaaagatcctacagaatgcagagaaatacctgcccttcctcactgaaaaggacgattccgggctgtcagtgagtgagcgcattcttcagatgtttagcttccagatcccttattacattggaccaatatccggcaagatcggttctgacgaaaaatctaagaactcatggagtgtacgaaaagagaaggggagaatttatccctggaactttaaagataagatcgacgaaaaggagtccgccgagaaattcatcgaaaggatggtgaatcactgtacctacctgaacaatgagatggtcttgcctaagaacagcctcctgtacgaaaaatttatggtgttaaatgagctgaacaatctaaagattaacaatgaaaacatatctgttgagctcaaacaatcactgtataataaccttttcaagacaggaaagaaagtgaccgctaagggcatcaaaagttacttggagcggaatggcctgtgcgaaccaaacgaggatattaatctcacggggatcgacggagattttactaaccgcctgagcaactatgccaagttcaaaggtatttttaatacagacgaacttacctacgagcagtggaacatggcagagaagatcataaagtggtccactatctatggcgattctaaaaagttcctggaagagaaaattagaaatgaatactcggagaagttggacagccagcagatcaaaaggattctcgggatcaagttccgtgactggggacggctgtccgaagagttactgaacatggagggcgctgatgtcaatacaggtgaaataaaatcagtgattgggcgaatgtgggacgagaactataatctaatggaactcatcgccaccgataactttacgtacaagcaagtaattaaggagaaacagaatggcctggacaagagtctttctgaaatcgattacgacgatttggacgagctgtatgttagcgcgcccgtgaaaagaatgatatggcagaccctcctgatcattaaggagttagtctccgtgatcggatacgaacctacaagggtcttcgtggagatggccaaagatgttaacactgaaaagaagcgcaccgactcacggaaaaagaaatttctggatctttataagcaatgtgagaaagacgaaagagatttctggattaaggagatcgacgacaagagcgaggcagaatttaggaaaaagaaattgtacctctattacacacagaagggccgctgcatgtatactggggagcagataaatccactggatctaaccaacgacaatctgtacgatattgaccatatctacccgcgacacttcgtgaaagatgactctatcgaaaacaatctcgtactggtcaagaaggagaaaaacgctcataagtccgatacatttcccattgaggacgatatccggaaaaaccagtatgccttctggaagatgctttacgagaaaaattttattaccaaggtgaagtatcaacgtttgactagaaaagagcctttcagtgacgaagagaaggctaactttataatgaggcagatcgttgaaacgcgccagggaacaaaagtgattaccgatatcctggaaaagagcttcgacaaaactcagattgtctacgtgaaggccggtaatgtatctttatttcggcaaaaatatgagtgtatcaagtgcagagaaataaacgacttccaccacgcaaatgatgcctacctcaacatcgtggttggcaatgtctatgacaccaagttcacatccgatccaaggaactttattaaagagtaccgaaagaatccccagaaaaacgaataccatatgtataagctgttcgactacaatgtgcagcgcggggatcgggtggcttggaccgcgtcaaacggagagagtatgaaagtcgttaagggcactcttaagaaaaatacacctctggtgacgtttatgagctatgaggaacacggtgggttgtacgaccagaacatcatttcggcaaaggatatcgagaaagtgaagggcaaaggatatctcccaataaagtcctctgacagcagactgaataacaccgaaaagtacggcgggtatgccaaagtatcaggagcttacttctttgtcgtggagcatactgttaagaatgtgaggattcgtacaatcgaacccatgccgtgctacctaaccaaagtcctgacaactaaggagaaaatcgaagattattgttgcaacattctcaagtacgacagtcctgtggttaagtatgagaaaataaagatgtactccctgatcaaagtgaacggttatcccatgtaccttaccggccgcacggggaatcaattgattgtatctaacggaatccagctggtcttaagctatgatgaggccaagtacattaaagacctcctgaagatcaatcaggaagagttcgatcagaaccggcttgaaaatctgggcataaacaaatttagaaatgagaagctatacgacaccctcaacaagaaatatacaaatgagatctacaagaaaaggccaaactccatgggtaataagatgattgaatggaaaaacactttccaaaatctgtcaatcaaggaccagaccgaggtgttgctgcagttaattcaactcgggcagaagcagaacagcggcgtgaatctggaaaaacttggagcaagtaagaaaacaggcgtctctctggtttccaagaaaatcactgataaggagagctttgaattgataaacaagtcgattaccgggctctatgagaacaaagtggacctgctacgagtatga

SEQ ID NO: 3039 - RNA, 4062 nt, synthetic construct
  misc_feature 1..4062: note = Cas9 variant
  source 1..4062: mol_type = other RNA
atggccgctttcaagtactatctgggcctcgacatggggaccaacagcgtgggatgggcagtcacagatcccaattacaaccttctgaaagccaagggtaaagacttgtggggcatcagagagtttaatgaagcgtccactgctgttgagaggcggacgcaccgcatttctcgacgtagaaggcagcgggaacaagtgcgcatagggttactgaaggattatttccatgacgccatcggagaggtagatcctgactttttccagagactagcaaactcaaaataccacctcgaagataaggacaccgaggtgaggtataagaataacgtctttaatgatgacgattacacagacaaagattatttcgaccagtacccaactatttaccatctgcggaaggagcttatcgaaagtaccgacaaacacgatgtgcgcctggtgtttttggccctcctgaacatgttcaagcatcgaggccactttctgaatagcggtctcggggagaactccggagaaaataacattaataacgcttatttagagctgacaaatcttttgtctgagttcacccagtacaacctgaacgaaactatcgacggcaaaaagatagaggatatcctatcgagaagggacatgtcacggacacgtaaggcagaaggcctcgccgagattctgggggttgattataaaaataagccgtacaaagaacttatccgcggactgtgcggtttgaagtttaacgcttgtgccattttccccgagatccaaagcgacgaggtccctaaactcgatatatgcctgagtgaagcgtcctttgacgagaagtctgatgaaattgcaaatatcttaggcgaggactatttcgaaattatcatggccatgaaagatatctacgacattgggagcctggctggaataatgaagggccacaactatctctcccaggccagagtgacctcatacgagaagcataaagaggaccttaggctgttgaagaatgtaatccggaaatactgtagtaaggaagattatgacaacttctttaatagcgaggcagatggttcttacgcttcctatgttgggtcatacaacagcaaaacgaagcagcgacgcgtgggaaataagagaagttctgaggagctatataaagccattaagaaaatcctgaagaacgtcccagcggaagacgccgatgtgcagaggatactcatgtccattgagaatgagactttcctgcccaaacaacttaccgcaagcaacggcgtgatccctaatcaggtccacgctaaggaaatcaagaaaattctgtcgaacgccgagcggtacttgccatttctccgcgaaaaggacgagacaggcctgtctgtttccgagaaaatcatgaagttattctcatttcagattccctattacgtggggcctactaccgaaaaatcaagcaaggatggaggtaatggctgggtagtgagaaaggaggaagggcaggtcctgccatggaacatagacgagaaaatcgatatgaaggctacatccgaagccttcatttctaggatggtgcgtcggtgcacctacatcagcggagagccggttctacccaaatcaagtctcgagtatcaatccttttgtgtgctgaacgaaatcaataacattaagatagacggcgagcgaatcagcgtcgaacttaaacaggatatttacaaggaggtgttccagaaaggtaagagagtaacgaagaaacaattgtgcaagtatctgcatactagggggatcattgaagcagaggagcaggttacaggcatcgacgtgaccataaataacgccctcactacatacggaaaatttaaggctatcctgggcgatgacatttctaaagactcagtccagaagatggtggaaaatatcgtcttctggtgtaccgtgtatggggatagtaagaaatttcttaaggaccgcattgaggaaaaatacggagagaagctgacgaaagaacagatcaagcggatagttggtttcaagtttaaagattggggcaacttgagcaagaatttcctcgagctgtccggggcggacgtgtctaccggagagtcggtaagcattatcagagcattatggaacaataacctgaatctaatggaactcattaactccaggctgtataattacaaagagcgccttgccgaataccaaaacacaatgatgaagactttgtcagatatcgaggctgaggacctggatgaatattacttcagtgcccctgtcaaacgaatgatatggcagaccatcctcattatcaaggagctggtgaaggttttaggctgcgaaccagaccggatttttgtggagatgacacgtagacccgatgaaaggaaaatgcgcactgagtctcggagaaagaaattcgaggaactgtataagaaagtcaaggacgaggatgtggactggatgaaagtaatcgcacacgccgatgaaaccggtagcataaggtccaagaagatgtacctttatttgacacagaaagggcgatgtatgtacaccggcaagcacattgagctctcagacctgtttaataacaacctatatgacatcgatcatgtgtaccctcgccacttcgttaaagacgataatatcgacaacaatctggtcctcgtgtgcaaggagaaaaacgctcataagagcgatatttacccactggaagacgagatccttgcctctcagaagaatatgtggtccgaattgcggagaagtggatttattactgaggaaaaatataacaggctgataggccgtaatagcttcacggatgagcaaaaggcagggtttatcgcgcgccagttagtggaaacatctcagggaaccaaaggtgtcgctaacattctccagcaactgcttcccgagtccaagatcgtttacgccaaagcatcaaatgtgagtgagttccggaacactagagacattcctaagagcaggctgatcaatgaatttcaccatgcccacgatgcttatttgaacatagtggtaggcaatgtctactatgtgaagttcacccagaacccgctcaattttatcaaaaacgactacgatcgagacaagaccaaaaacaattataacctgtcgaagatgttcgactgggatgttgagcggaatggggaagtggcctggattgcacagaaaaaggacggagaggctggcacaatcgccactgtcaagaaagtgctaggtcgcaacacacccctgatgacgagatactcctttgaggggaagggcggactcaccaatgaaactctgtactctgcgaaaaaggccaaagaggaaggctatattccattcaagagctcagatgagaagatgaaagacgttacaaagtacgggggattcaccagtgtgacaggcgcttactttttccttgtagaacacactgagaaaaagaaaaggtcccggatgatcgagtctgtccctttgtatctggcacagaagatagaacaaaacccccatgagttagaaaaatattgtgaacaggtgctcggtctgattgattttgacatccgagtgagaaagatcaagattgggagccttataaaacgcaagggatacttcttttatatcaccggcaaaacgggtcacaggctgattctacgtaatgccgtcaacatgtgcctcaagaaagaatgggttaagtacatctccaagctggagaaagctgtggataagaataacgtagagggcattatcaccaaagaaaagaatgagttgctgtactcagaattaatagagaaattcaagaacagcatctttagtaatcggccaaaccccgtgggggacaagctcgatgaagccaaagagaagttcattaatctggacatcgagaaacagtgcattgtcctttgtcaaatcctgcagttgtcttccgtgctcggaagcgaatgcgatatgacactgctaggcgagtcggcacattgtgggaagatactgattagtaaaaagatcggagacgaagatatctatcttattaaccagtctgttactggcctctacgagaagaaaatcaatctgagaaccgtgtga

SEQ ID NO: 3040 - RNA, 4065 nt, synthetic construct
  misc_feature 1..4065: note = Cas9 variant
  source 1..4065: mol_type = other RNA
atgaagaaaatcctgggcctcgaccttgggaccaacagcattggatgggccttcataaatgaggctgaaaacgagatcgaagtgtcctctattgtcaatacaggtgttagaatcgtgcccctgactacggatgaggaatcagactttaagaaaggcaacaccattagtatcaatgcagataggacattgaagcgcggggcccggcgaggattacagcgtttcaaacaaagaagggaggcgctgctagagacttttaaccggataaagttcatcgctaccgactttgtatacgccgaaacaggcgcagccaccactttcagctcctatcagctccgcgctaagtctgcagtggaggccgtcacaaaagaagaactggtgaaggttcttctgatgttgaataaaaagagaggttacaaatcgtcaaggaaggctaagaccgccgaggaaggggatgcgattgacggaatgaaaatcgcaaaggagatttttgaaaacaatctcacgcctggccagtgggtgtataacagcctgagtaaaggcgggaagttcatcccagatttttaccactccgacctgcagaaagagctcgaaaagatagtccggttccaaaatcagtttcattctgagcagattaacgataaattactggccgacatccagggaaagagccgcactcaaacctcccagcacttctcaaagacacttaatattccgttggctgagaacaaaggtactcgagaagagaccaagctgcagcattatcagtggagaaatgaagccctagcaaacgagctcgatatgaaaatcctggcttttatcattacagaaataaacaatcaaatcaaccagagtagcggctaccttggggccatttctgacaggtccaaggagctgtatttcaatcaggagaccgtgggacaataccagtacaaacagttgcaggaaaacgtacacgcgaagctcaagaatcaagttttctatcggcaggattacctggacgagtttgagaaaatctgggagacgcaggccaagttccattcagaattaaacgagaaactgaaggcagagatacgtgacattactatcttttatcagcgcaaactcaagagccaaaagcaccttgtgagtttctgcgaatttgagaaaggccacaaggctatccccaaatcttcccctctgttccaggaatttagaatttggcagaatttgaacaatgtcgtggtgaagaacgagacaaccaaagaggtcttcgaactaagcgaggaactgaagcagctcatcgccgaggaactgcaatttaaggagtcgatgactgatgttcagatgcttacattctgtgagctgaaaaagggtacccatacggtgaattttaaaaagattgaagggaacaggaccaatacatctatatacaaagcattcgagaagatcttggaagtagagggatatgaaattgacttttccaaaatgaagccactcgagatcaaggagactgtggcccccatcttcgaaaccctgaacattaatacagtcatattagatttcgaccctactatccagggcaacgattttgacaaacagccatactatcaactgtggcacctactctactcagcagaggatgacgataagctgaaagaaacccttaagacaaaattcggctttaaggagaaccatttgcccttcattctgaatatcaacctccaggccgactacgggagtctgagcgctaaggcgattaaaaagatccttcctcacctgatggatggacacatatatgacaaagcatgcttgatggtgggttacaatcattcctctagcctcaccactgcccagaacaatgaccgggttctgaaggatacgttagaactgctcaaaaagaactcactacgaaatccagtggtcgagaagatcctgaaccaaatgattaatgtgatcaacgctattatgaaagacccggccatgggcaagcccgatgagatccgcgtagaacttgcaagagagttgaaagccaataacgaacagaggaagaaagctacaagtgacataaataccgccactaccgagcacgagcggattcgcaagctgctccattccgaatttaacatccctagagttacaaggaatgatattatccgttataagctgtggttagagaccgggggaataagcctgtacactggcaacccaatcaaagcatctgaccttttctcaaagaactatgatattgaacacatcattcccaaaagtcggttgtttgacgatagcttctccaataagacactctgtgagcgacagctgaacatcgacaaatctaataagacggcgtactcgtttctacaggaaaaactgagcgagaacgatttcgctgcctatgagaatagagtgaaggacctctttaagaccggtaaaataaagtcctacactaaatacaagaaactgcttatggcagataacgaaattcctgaggggttcatcgacaggcaattgcgcgaaacacagtatatcgccaagaaggctaaagagattctgttagaagtctcacggaatgtgaccgccacaatcggcagtgtcactgacaagctcagacaggattgggagctggtggacgttatgaaagagcttaactgggaaaagtacgataaactgggattgacccatattgaggaaggcaagaatggggagaggctctctaagataaaagactggacgaagcgcaacgatcaccgacaccatgcaatggacgctatcaccgtggcctttacaaaaccagcgtatattcagtacctgaataacctaaatgccaagactcaaggagaaaacaaagctaatagcatcattggtatcgagaacaagcacctgtatcgggataagaacaataaactccgtttcatatcccccatgaagaacttcagagaggaagctaaaaagcagctggagtcaatccttattagctacaaagccaagaataaggtagtcaccaaaaacaagaatacaactaaaaagtctggcgggaccaaccagaaaatccagttgacgccgaggggacgcctgcataaggaaacagtgtatggcaaattacaacagtacgctaccaaggaggagaaggttaatgcctcctttactgaagactacattcagaaagtggcaaagaaagagtatcgggaagcgctcctgaagagacttgaggaaaacgataatgaccctaaaaaggccttcacaggtaagaacgctctgaataaaacccccatctacataagtctaaaggataacattatcgtcccagagaaagtgaagactgtatggctcgagaccgactatacaatcaggaaagatattacgcctgacctgaagatagacaaggtgatcgatgttgggattaaacgaatcttgcaaaatcgcctgaacgaatttaatggcgaccccaagaaagccttcgtcaacttaggagagagcccaatttggctcaataaggaaaaaggcatcgcaataaagcgggtgaccatctctggggtgtccaacgctcaggccctgcacactaagaaagatcaccttggaaacgagattctggacaagaatggtaaccccatccctgtcgattttatttcaacaggcaataaccatcacgttgcaatctacagagacgaaaaagggaatttgcaggaggaggtggtgagtttctatgatgccgtaataaggcgtaacctcggactgagcgtcattaataagaaccatgaaaaaggctgggagtttctattctcgatgaagcagaatgaatttttcatctttccatccgacggtttcaacccgcacgagatcgatctgcttaatcccaacaattaccatctcatttctcctaacatcttccgcgtgcagaaaataagcaccaagaattatatgtttaaccaccacctggaaacaaaggctgttgacggggagatgttgaaatcaaagaaagagctgagtaagacttcctaccatttcattcaaaccccaacgaacttaaatggcatcattaaagtgcggatcaaccacctcggaaagatagtccatctgggcgaatactga

SEQ ID NO: 3041 - RNA, 4065 nt, synthetic construct
  misc_feature 1..4065: note = Cas9 variant
  source 1..4065: mol_type = other RNA
atgaagaaaatcctgggcctcgaccttgggaccaacagcattggatgggccttcataaatgaggctgaaaacgagatcgaagtgtcctctattgtcaatacaggtgttagaatcgtgcccctgactacggatgaggaatcagactttaagaaaggcaacaccattagtatcaatgcagataggacattgaagcgcggggcccggcgaggattacagcgtttcaaacaaagaagggaggcgctgctagagacttttaaccggataaagttcatcgctaccgactttgtatacgccgaaacaggcgcagccaccactttcagctcctatcagctccgcgctaagtctgcagtggaggccgtcacaaaagaagaactggtgaaggttcttctgatgttgaataaaaagagaggttacaaatcgtcaaggaaggctaagaccgccgaggaaggggatgcgattgacggaatgaaaatcgcaaaggagatttttgaaaacaatctcacgcctggccagtgggtgtataacagcctgagtaaaggcgggaagttcatcccagatttttaccactccgacctgcagaaagagctcgaaaagatagtccggttccaaaatcagtttcattctgagcagattaacgataaattactggccgacatccagggaaagagccgcactcaaacctcccagcacttctcaaagacacttaatattccgttggctgagaacaaaggtactcgagaagagaccaagctgcagcattatcagtggagaaatgaagccctagcaaacgagctcgatatgaaaatcctggcttttatcattacagaaataaacaatcaaatcaaccagagtagcggctaccttggggccatttctgacaggtccaaggagctgtatttcaatcaggagaccgtgggacaataccagtacaaacagttgcaggaaaacgtacacgcgaagctcaagaatcaagttttctatcggcaggattacctggacgagtttgagaaaatctgggagacgcaggccaagttccattcagaattaaacgagaaactgaaggcagagatacgtgacattactatcttttatcagcgcaaactcaagagccaaaagcaccttgtgagtttctgcgaatttgagaaaggccacaaggctatccccaaatcttcccctctgttccaggaatttagaatttggcagaatttgaacaatgtcgtggtgaagaacgagacaaccaaagaggtcttcgaactaagcgaggaactgaagcagctcatcgccgaggaactgcaatttaaggagtcgatgactgatgttcagatgcttacattctgtgagctgaaaaagggtacccatacggtgaattttaaaaagattgaagggaacaggaccaatacatgcatatacaaggctttcgagaaaatcttggaagtagagggatatgaaatggacttttctaaaatgaagccactcgagattaaggagactgtggcccccatcttcgaaaccctgaacatcaatacagtcattttagatttcgacccttccatacagggcaacgattttgacaaacagccatactatcaactgtggcacctactctactcagcagaggatgacgataagctgaaagaaactcttaagaccaaattcggctttaaggagaaccatttgcccttcctgctcaatatcaacctgcaggccgactacgggagtcttagcgctaaggcgattaaaaagatcctgcctcacttgatggatggacacatttatgacaaagcatgtctcatggtgggttacaatcattcctctagcctgacaaccgcccagaacaatgaccgggttttaaaggatactctggaactactcaaaaagaactcactgcgaaatccagtggtcgagaagatccttaaccaaatgataaatgtgatcaacgctattatgaaagacccggccatgggcaagcccgatgagatccgcgtagaattggcaagagagctgaaagccaataacgaacagaggaagaaagctacgagtgacattaatacagccaccactgagcacgagcggatccgcaagctcctgcattccgaatttaacatacctagagttaccaggaatgatattatccgttataagttatggctggagacagggggaattagcctttacaccggcaacccaatcaaaggttctgacttgttctcaaaggattatgacatagaacacatcattcccaaaagtcggctctttgatgacagcttctccaacaagactctgtgcgagcgacagctaaatatcgataaatctaacaagacagcatactcgtttctgcaggaaaaactcagcgagaatgacttcgcggcttatgagaacagagtgaaggatctgtttaagacggggaaaattaagtcctacaccaaatacaagaaacttttgatggccgacaatgaaatccctgagggcttcatagacaggcaactgcgcgaaactcagtatattgcaaagaaggccaaagagatcttactcgaagtctcacggaacgtgacagctaccatcggaagtgtcacagataagctgagagaggactgggagcttgtggatgttatgaaagaactgaattgggagaagtacgacaaattgggcctcactcatattgaagaggggaagaacggagaaaggctgtctaagatcaaagattggaccaagcgcaatgaccaccgacaccatgccatggatgcaattacggtggcttttaccaaaccagcctatatacagtacctaaacaatctgaacgcgaagacacagggtgagaataaagccaacagcatcattggcatcgagaataagcacctctatcgggacaagaacaacaaactgcgtttcatttcccccatgaagaatttcagagaagaggctaaaaagcaacttgaatcaatcttgataagctacaaagcaaagaacaaggtagtcactaaaaataagaacaccactaaaaagtctgggggaacaaatcagaaaatccagctgaccccgaggggccgcttacataaggagacggtgtatggtaaactccagcaatacgccacaaaggaggaaaaggttaacgcttcctttaccgaggattacattcagaaagtggccaagaaagaatatcgggaggcactgcttaagagactggaagagaatgacaacgatcctaaaaaggcgttcactgggaagaatgccctaaacaaaacacccatctacattagtctcaaggacaatatcatagtcccagagaaagtgaagaccgtatggctggaaactgattataccattaggaaagacatcacacctgacttgaagatcgataaggtgattgacgttggcataaaacgaatcctgcagaaccgcttaaatgagtttaacggagatcccaagaaggctttcgtcaatctcggcgaaagcccaatttggctgaacaaagagaaagggatcgccattaagcgggtgacgatctctggagtgtccaatgcacaagcccttcacaccaagaaagaccacctgggtaacgaaatattggataagaacggcaatcccatccctgtcgactttatttcaactgggaacaatcatcacgttgctatctacagagatgagaaaggaaacctccaggaggaagtggtgagtttctatgacgcagtaattaggcgtaatctggagctaagcgtcatcaacaagaatcatgaaaaaggctgggagtttctgttctcgatgaagcagaacgaatttttcatatttccatccgatggtttcaatccgcacgagattgaccttctcaaccccaataactaccatctgatctctcctaatatcttccgcgtgcagaaaattagcacaaagaactatatgtttaatcaccacttggagaccaaggccgttgatggggaaatgctgaaatcaaagaaagagttaagtaagacatcctaccatttcatccaaactccaaccaacctcaacggcataattaaagtgcggatcaatcacctgggaaagattgtccatcttggcgaatactga

SEQ ID NO: 3042 - RNA, 4065 nt, synthetic construct
  misc_feature 1..4065: note = Cas9 variant
  source 1..4065: mol_type = other RNA
atggccgacttcgctaagtaccagcccggcatggtggcagatgggagaaaaatccctctggactggaccctctattaccttaggaagaaagccctgacacaagcgattcggaaggaggaattggcttggatattactgaactttaatcagaaacgcggatattaccagctacgaggtgaggaagaggaagagaacagcactaagcacgaggaatattacgagctcaaggtcgtttccgtggaagccgcagaggagggcaaagggggaaatacgtggtataacgtaaccctggaaaatggctggatctaccgtagacagtctaagattgagcttaacgattgggtgggtaaagtcaggccattcatcgtgacaactgaatacgagattgacggggttaccatcaagaaagataagaatggagaagtgaagcggtcatttcgcgccccgagtgagaacgactggggcctgagaaagaagaggacagagagcttgctcgaagagtccggcaaaaccgtcggggctttcatatataatcatatcctgtctgaacccgcagataagattcggggaaactttatccgcactattgagcgaaaattctacaagaaagaactggaggccatcctcagagagcaatcgaagcaccagaaggaattaaaagacatagatacactgattgcttgcatcaaggagctttatcctaataacaaaccacatcaggactcattgattaagaaagatatgacctacctgctaatcacggacctcatcttttatcagaggccccttaagagcaagaaaagtcttattgccgattgtccttacgaatattacgagtacgtgataaaggaaactggtgagaataaacggcaatccatcaagtgcattgcgaaatctaacccatattaccaggagttccgtctgtggcagtttatcataaatttgcgcctcttcgacagaaacaacgacaaggaagtaaccagcgagtatctgtcctcaatggaagattacacaaggttatttacttatctgaatgaccggaaggatattaaccaggagaccctccttaaagacttctttaagcaaaagaaggttaaacgaggcatggagaaggagttccccatccgctggaattacatcgaggataaggaaaagaagtatccttgtaacgagacaagacacgaactgttgaccgcactagggaaagtgggaattgaccatagttggctggatgacaaggaactcttctacaggctgtggcaccttctgtacagcgtcgagtctaaagaagaggccgaaggcgctttgcggaagctcgtggataatgacgattttgtgaacgccttcctgaaaatcaagccatttaagaaagagtatggtgcatactccgaaaaggctattaaaaagttactggccgtcatgcgcatggggaatctatggaacgaggttgacatatgcgagcagacgagagacaggatccagaatattatcaaaggagatatcgacgaaaagattaaggatcgtatgggccggactttctcacaactcagcgactttcagggcctgccggagtggcttgcgtgttatgtggtatacgggcagcacagtgaagccacagatatacagcgatggaccaaacccgagaacttgatggcatatatcaatggattcaagcaacattctctgagaaaccctattgtggaacagtgcatcctcgagactctgaggacagtccacgacatttggaaagaggctggtcatatcgatgaaatacacatcgagcttggccgcgggatgaagtccaccgccgaccagcgggctagaatgagcaaatcgattatgcagaatgaaaacacgaatctgaggatcaagtctttgctcatggagctgaagaacgccaaagagtttgaaaacgtgcgcccatactcccccatgcaacaggagattttacgaatctatgaagagggagcactgcaggaactaaccaaggaggatgcccagtacaatgagatatcaaaaattagtcaaatggctcagcctagcgcgaacgaactcctgaagtaccggctttggttggagcagaaatattgttccccatacacaggcaagcccatctctctgagcaaactcttcacttcagcatatcagattgaacacatcataccgcaaagtcgttactttgacgattccttcaccaataaagttatctgcgaggccgaagtgaaccagttaaagagcaatatgctgggttatgagtttattaaaaagcatgggggcgagatcgtcagatgtacaatgattggagacgtgaaactgcttgatgctaaggaatactataacttcgtaactgagcactacaccaataacaggcgcaaaaaggaaaagttgctcatggaggacatccctcaggaatttctgaatcggcaaatgaacgactctagatacataagcaaaaaggttatggccattctaagtaatatcgtgagggaggaggatgaacaggaggcaaaaagcaagttcgtcatcgcctgctccggcgggattacagaccgactgaaacaggattggggactcaacgacgtgtggaactctatcgtctatccccgcttcgaacggctgaataaacttaccaatactgagaactttggtagatgggagaacaagaaaggcaaacaggtgttccaaacgtcggttccattggaactgcagaaagattttagcaagaaaaggattgaccatcgtcaccatgctatggatgccttagtgatagcatgtgcgtccaataacatcattaattacctcaacaatgagtcagctaagagtcaggaaaagcgcgaggacctgcggaaaaagctgtgcgataaaaacagaatcattaggaagccttgggaaacattcacccaggacgcccacactgcactggagaatgtagtcgtgtcttttaaaaactatatccgagttataaataaggccaccaactactatgagaagtacgataaaaatgggaagaaagaaatcgctgagcaaaagggacaggacatgtgggccattcggaaacccatgcacaaggaaacagtgttcggccaggtcaacttgcgcagaaagatcaccattaaactcaaggatgcactggagaaaatcccagctatatgcgacaaggaactaagggactatattaatatcctggtggccaaacagtttaacaagaaacaaatcctcgcgcatttcaagagcattaattaccggctgaacatgaagtccgtagataaagtggacgtttggcagttttcaaacgagaaggagcccatggtcgccactcgaaaaagcgtggatacatctttcgacacgaagagaatagctaccatcactgatacaggtattcagaaaatccttttgaattacctgaaggcaaagaacaatgaccctaacattgcctttaccccagaagggatcgctgagatgaataaacacataacagaatataacaatggcaagcaacatcagccgatcttaaaagtgcgcgtctccgagcccaagggagccaaataccaggttggcgaaactgggaacaagaggagtaagttcgtggaggcacagaaaggaaccaatctctattttgcgatttacgaggataaggaaggtaaccgtagctataatacgatccctctgaacgaggtgattgaacggcttaaacaaggcctgtctccagtacccgacgccaatgagaagtccatccctctaaaattccacctctcaccaaacgatctggtctacgtgcccaagaccgacgaggaaaatgagataaagatggggcagatttataaattcgttgatagtagcggaacaactgctaactttgtgccgcacagagtctcgaatttgatctacaacgtggacaagaaaatcgccgaaaacttctgtaatcatgagattatccagaacgaatacggcataggttcccctcagtctaagaatcaaaaatcaattaccggggagatgatcaaggcagtttgctggaaactggaggtggacaggttaggcaacattcacaagatcataaagtga

SEQ ID NO: 3043 - RNA, 4065 nt, synthetic construct
  misc_feature 1..4065: note = Cas9 variant
  source 1..4065: mol_type = other RNA
atgaagaaaatcctgggcctcgaccttgggaccacaagcattggatgggccttcataaaggagcccgaaaaagatgtggtcggttccgagatcgttgacatgggcgtgagaattgtacctctgtcttcagatgaagagaacgactttgctaaggggaatactatcagtattaacgcagataggacgttgaaacggggagcccgccgaaatttacagcgtttcaagcaaagaaggaacgcgctgctagaaacctttaaggagaaaaatctcatcccaagcaacttccagtacgctgaggacggcccgtcctctacattttcgactctgaaacttcgggataaagccgcaaaggaaaagatagagctggacgatttcgtgaaggtcttgctccagatcaataagaaacgcggttataagtcaagcagaaaagccatgagtgaagaggacgaggggaccgctattgattccatgggaatcgcaaaggaactgtacgagaacgacctgacacccggccagtgggtgtatgaagccctcaaaaatggcaggaagaacgttcctgatttttaccggtctgacttacaagaggagttcaaaaagattgtgaattatcagagcgaattttacccagacatcctgaacacctccttcgtcgaggattggatggggaaggcttcaactcccacaaaacagtattttaataagcgcggagtgcagcttgccgaaaacaaaggtaagcgagaggaaagaaggttgcaagagtacaaatggcgggcggaagcagtaaatttcaagatagacctgagtgagattgccctaatcctcagccagattaactctcagatctccaactcaagcggctacctgggggctatcagtgatcgttctaaggagctttattttaaaaatctgaccgttggacagtacttgtatcaacaggtgaagaaaaaccctcacacgcgcctcaagggccaggtcttctacagacaagactatctggatgaatttgagaaaatttggtccgtgcagagctcgttctacccacagttaaatgacgaactgaagcaggaggtgagggatgtcactatattctttcaacggcgactcaagtctcagaaacatcttatctccaactgcgaatttgaggagcaccataaggttgtgcccaaatcacaccctattttccaggagttccgcatctggcagaatctgaacaatttgaccctaataaagaaagacaacctgaatgaaaagtgtgaactcgccctggaggataagacagcacttgctaacgagctggcctttaaaaaggaattgagtgtaaaagacgcgctcaaggtgctgggtttaaaaccaagcgattgggagttcaattttactaagattgaagggaacagaaccaatcatgccttctttgaggcattcgctaaaatcatcgaactggaggacggagagccgattgacctaggcaacctcaaggccgatgacatcctggatcaattttccgaagcattccttaggattggcatagacacagagttgctgcaggtcaattctgatatcgaaggggccgagtatgaaaagcagagctacattcagttctggcacctcctgtactcaagtgaggacgatcaaaaacttaagcagaacctgatccggaaatttggattcaagcccgagcacgcaaaaatcttggcctccattagcctccaggacgatcatgcttctctgtcaagtcgcgcgataaagaagatcttacctcatctgcagagcggtctaatttatgacaaagcatgcacctacgccggctataaccactcctcttcgtttacgaaggatgaaaatgagaaaagagaactcagggctgagctggaacttttgaagaaaaacagcctgcgtaatccagtggttgagaagatcctcaaccaaatgattaatgtggtcaacgccatcctgaaggaccccaatttagggcggcctgatgagatacgagtggaaatggcaagagagctgaaagccaacgctgaacagaggaagaatatgacttccaacatcgcctcagcaacacgcgaccacgagaaataccgggagattcttaagaaagagttcggattgaagagagtaaccaagaatgacctcctgaggtataaactatggctggaaactgatggcatcagtctctacacaggtaagccaattgaagcgtctaaactgtttagcaaggagtatgacatcgaacacataattcccaaagctcgccttttcgatgactccttttcaaacaagaccatctgtgagcgacagttgaatattgataaagccaacgttacggcattcagctttctgcaaaataagttatctgccgacgagttcgaacagtaccagtcccgggtgaagagtctctacgggaaactgagcaaggctaaaatccagaaacttctgatggccaacgataaaataccggaggactttatcgcacgtcaattgcaggaaaccagatatatttctaagaaggctaaagagatcctcttcgaaattacaatgagggtctccgtgactaccggcacaatcactgataagctgcgcgaggactggggcctagtcgagataatgaaagaactgaactgggagaagtacgataaactcggactgacctatacaattgaagggaagcatggagagcggcttaataagatcaaagactggaacaagagaaatgatcacaggcatcacgccatggacgcgttgaccgtggccctgactaaacctgcttacatccagtatttaaacaatctcaacgcaaaggccattggtaataaaaagggcacggaaatctttgctattgagcagaagtacctgaaacgagagaacgggaaactttgcttcatacccccaatcgaaaatattcgcgccgaggctaaaaagcatctgtcaaaaatcctagttagttataaggcgaagaacaaagtggtaacaattaataagaacaaaaccaagaaaaaggccggattcaatgaacaaactgctctcacccctcggggccagctgcacaaagagacagtctacggtaagagctttcactactcgaccaagttcgagaaaatcggggcctcctttgacgcacagaagataaacactgtggctaaaaaggaagagagagaagccttgctgaaaaggttagcagagaatggcaacgatcccaagaaggccttcacaggaaagaactctctcaataagatgccaatctatctggaccttggcaaaaacattaagctgagcgaaaaagttaagacggtggtcttggagcagaattacaccatccgtaagaacattgatcccgacctcaaagtggataaggtaatcgacgtggggataaaacgcattctggagtcacggctagaagagtttggaggtaatgctaagctggcgttcagtaaccttgaagagaatcctatctggctcaacaaagaaaagggcatcccaattaagagagttaaaatatccggggtctctaatgtggagagcctgcatgtgaagaaagatcactttggagagaagatcttggacgaagagggcaacgaaattccggtcgatttcgtttccactggtaataaccatcacgtggccatctatgaggacgaagatgggaatctgcaagacgaggtggtaaacttttacgaggcagtcattaggcgaaatcagggcgaatcaatcataaaatatcggcacgaggaaggatggaacttcttatacagcatcaagcagaatgagtttttcgtgttccccagtcaagactttaaccctaacgatttcgacctcctggatccaaagaattatgaccttatttctcccaacctgtaccgcgctcagaagttttccaaggttatgtacggcaatagcgccgtgagagattatgtcttcaggcatcacttggagacagtgctcaacgacgttaaagaactgaaggatgtggcctacaaacagctaaagtcgctgcagtatcttaatgggatcaaaaaggtacggctcaaccatctgggacaaattatccaggtcggcgagtactga

SEQ ID NO: 3044 - RNA, 4065 nt, synthetic construct
  misc_feature 1..4065: note = Cas9 variant
  source 1..4065: mol_type = other RNA
atgaccctgcactacaacgtgggcctcgacatcgggacaaatagcgtcggatatactattgttgatgacaacggtaagatacttcaggtgaaaggcaagaatgggtacggagtaagagtgttcaaagagggcgccacggctgcagaaaggcggatctttcgcaccacacatcgacgtctgaagagaaggaaatggcggttgcgcttactgcaagatttctttgagccctatattctacctcaggacgatggtttctttatcagaaggaaggaatccaacctcgtcctgaatgaccgggatgaggacactgcctctcttttcaacgatcgctcagaccgagatttttaccaggcgtatccaaccatttaccacctgagacaggctttgatgacagaaaagaggcaattcgacgtgcgggagatctatctcgccatgcatcacataatcaaataccgtgggcattttctgctgaatggaaccgttaacaatttcactaacaataagattgatctccacagtgactttgaggaattaaacgcactgcttttgaatgtgatcccggagctgaaattccagattgacctagatcacagcacaatgtttcagaccacgctcctgaacactaccatctcccgctctggcagacagagggaccttgtcaagtcgttctacaatggctcagatgacaaacaactggccaagcagcagaagagtgtggctacagaattgctcaaagcaatactggggttaaaggccaaattccataagctgtttaacctcgatcttctggagactaccgagtgggagttcagttttgacgctgaagatattgacgataaattggccaagctagaacccctgatgacagagaaccagcaacaggtaatggacatcctccagcggattttcgcggcaatcaccctgaatggaatcgttcctgaaggtaaaacgctttccgcctctaaggtggatagctatcaaaagcacaaacaggacctgaagttgctcaaagctattgcccagcattccgacaagaaaactgcaacagtcctgcagaccgcttacaacgagtatataaatggcatcgcctcaaagccattaaagcaagaggatttttacaaacgactgactaacgcggtgaagaaaagtagcgacccccaggtggccgatatgctagcactcattgaccaggaaaagttcctgcctaaacagcgcacaaaggagaatggggctatcccacaccaacttcaccagttggaactggagagaataattgataaccagaaggactattacccctggctcgccgaactgaatcctaaccaggctaggcaaaaagtcgccaagtataaactttctgagctggttgcatttcgggtgccatactacgtaggaccgttgatcgagcccgaagtgcagcaggccacctccaatgctcatttcgcgtggatggcacgcaaggaggccggccctatcacgccatggaactttgatcagaaagtcgacagaaatgtgtcagctgaaaggttcattaagcgtatgaccacaaaggatacttatctcctggccgaggacgttttacccctgcacagcctactctaccaacggtttatcgtgctgaacgaacttaataacgtccgagtgaatggtcagaaattgaccaagaaacagaagcaagcagtatatcaggatctgttcaaaagacagcctcatgttacaaagaaacagtttaagagttacctcgtgcaaactggggagttcgccgagtcttccaagattgaaggactggctaacgagaccagcttcaactcgggcttaacaaccgaaaatgagctgaggaaaatatttggcgcccagcttgacgaggcacgctatcaggtcgatttcgaacagatcattgagtgggcgactttgtttgaagacgctaagatcctccggacgaaactggccgagatcacatggctaaccactgaacaaattgagaagctggcagggataagatacaggggatggggtcgcttctctcgaaaactcctggccggccttcgggaccagaacgggcagcagatcattgatttgctgtgggacaccccaaataactttatggtgatcgtctcccaagctgccttctcagaggcaattacaaaggaaaatgagaagttaatcgatcgtagaggagctcaggacgtgataaccgatctctatactagcccccagaacaaaaaggccctgaggcaagttcttgcgatcgtggccgacgtacagaaagctatgggcggtgtcccgcctcagcgcatttttatcgagttcgcacgggaagatgaaaagaatcccagaaggagcgtggagcgatcccgccagctggagaaattgtaccaaacaatttctaacgaatttctcatcaatagcgaggttcggcaggaactgaaggaggccgtggaccagaaggtcaacttcaaagatagactatttctgtacttcctccaagggggcgtggacctgtattcaggaaagaggataaatattgatcagcttagtcactacgacatcgatcatattttgccacagtcctttatcaaagacgacagcctggataaccgtgtattagtgtctcagaagctcaatcgctcaaaaagtgacagcgttcctctgtccgagttcgctaactataagttcggccccgccatgcaggcaaagtggcttcaactgaaagaagcggggctactctctaagcggaaatacgataatctgacgttggacccaaccaagctgtcgaaatttgcccccttaggattcgtcaacagacagctcgtggagactcgacaggtgataaagctggctgccaaccttctggcaagcgaagagacaaaagtcgttaccatcaaggctaatatgacacaccaggtgaggaaggaattggattttcctaaaaaccggaatgtgaacaattatcaccatgccttcgacgcatacctcactgcctttgtaggtattttcctgtccaagcgctatccaaaactaaagccgtactttacctacggcgatttccaaaaagggaacaagctgcccgaccttaagaattttaacttcctctatgagctgaaaaataaggatagatcaatcgacagtaacacgggagagattatctgggataaacagagggacttggcttacatgaataagatatataactttaaaaaggtcaccgtggttcacgaagtgctgacaaagtctggcgcgttatacaatcagactctctataaagccagcgaggacaaggcatccggtcgggggaccaaacaactgattcgaaagaaagataacatgcctacagaactttacggcggatatactggctcaaccagcgctttcatgtctatcgtcagactgtggaagaaggacaaaccatactacaaggtggttgggatccccacgcgcatggccgccaaattggctaatcaggcacagctcctggattatctaacaaagaaattcaccactaggaagctggtgaagaaaacaggagactacaagaccactgtagagcgttttgaacttgtcgtgcctaaagtgggtttcaaccagctcgtcattgatggcgggcaaccatttatgctgggatccgccacctatcagtacaacgcgcgggagttgttcatcagtaaggaggctgttaaagccttaaataagcagctgagcacacatgtggacctcgtacaggtgtttgatgaaattctggtccaagtgaacagatggttccccctttatgacacgaatggctttagggagaaactgtctcacggtcgcgatcgattcatgaagttgaacgactcctttgaagagaagtcagatacccagatagacgttctaaatagaatcctgattgggttccacgcaaacgccgctcggactaatctcaaaatcctgggccttggaacagatttaggctttatgacccagcaggcagggattaggctgacagaaaaggccatcctcgtgcatcaaagtccgagcggattgttcgagcgcaaagtcgcgctgcgtgacctcaagggcctgagatga

SEQ ID NO: 3045 - RNA, 4068 nt, synthetic construct
  misc_feature 1..4068: note = Cas9 variant
  source 1..4068: mol_type = other RNA
atgacctacagcatcggcctggacattgggacaggatccgtgggttgggccgtcataggcgatgactatagactcaagagggctaaagggaagaaccttatcggagttcggctgttcgattctgcaactacggccgcggagcgccgaggctaccgtaccacaagaaggcggttgtcacgcagacactggaggttacggctgctaaatgacatttttgctagtgatctcgccgaacaggacgagaacttcctgccccgccttaaatatagctgggtgaatcctgatgacgaacaaaacccacagcttaattccgatgtagcaaacggtgccttgtttgggtcttcggagactgacaaggctttccataaaaattacccgaccatctatcacctccgacatgaactgatgacagataccgcaaagcacgacctgagagaggtgtacctcgccattcatcacatcgtcaagtataggggaaactttttaaatactgctgataaaataaacgccgaaaattcattcaacgtggacctgtttatcgcggcacttgacgaatacaatgagttcttggaaacacccattaccagcatcaaggatgcccagctgtttagtgacaaactaacggatattaacgctcggaataagtccgttcgtgtggagaacgccatgtctgagacttacgacgataaaagcaagatcttcaaggcaatactcaccgctctggtcggcaacacagccaattttcagactattttcgacctttccgatctggaaaaagacgaggcgaagaactttaaattcaagttggatctcgaagacgtggagaccaaactggatgtagttcgcgccaagttatcagacgaacaaaatgcattcctggaggctgtgctcatcgcctatgacggcattacacttaaaatgatcctgggggattacaagagtatcagccagtctatgattgagtcctataagtcacaccagagagactggaaatacataaagaacaatgtcaggttgaacgaacagaaaatcgagcctgataagaatagcgtgaaatttttcaagctagacccaaagaaactgatttatcccagtaacctcgcttacctgcaagtgatctcttccaatgaagatgagcatcggaagggacttgactattttaaaaccgccatacaggatgcagacattctgcagcgaatcgaaaacgatacgttcttgcctcgccagagaactaagaggaatggtgtcctcccataccaactgcacttagccgagctggagcagatcattaaaaagcagagcaagtactatccctttctagctaacatctacacacaagacaataaaaccgaaaacaagctcattggcctgcttaaattccgggttccttattacgtggggccattggtagaggcggaaaaggtgactggagatggcaaaaatcattggctgataaagaaggagctccaggaaaacacaccgatcaccccctttaacttcgacgatgtcgtggacaaagacaagtcgggtgagcagtttattaaacgcatcacggggaccgattcttatctgatcggagagcctacacttccagaaaattccctgttgtaccagaagtataacgttctccaagagctgaataacgtgagaaatgaaaggcaccagcgtttacccattaaagtcaagcaggacatattcgagcacgtgtttaaaatcgataagaacgtaaatgcaaagaaagttatggcctacctgaagctaaacggctacggcgacttccagattgctgggctctcagatactcggaccggaaaatttaatagtaacctgagctcctataattacttcgtggaccttttgggtcgagagaagacagaaaagatcagagaggataggctggaagagattatcgaaatacaaactgtcttcgaggacaagatcctcgtggccaagcgcctgtctaacttagattttctgacccctcaggagaaaagcaagctgtcagcaaaacattatacaggctgggggcggttgagtcagaagctcctgaccactcagttcattaaaacggccctatccgaagctggagacatcattccacaaagccactctatcatagatctgctctactatacagacaagaatctgatggagattcttaacgataagacctttaatgtcagaaactggttgactgaacagaacaaaggcaccgagtcaggtaatagtctgtacgaccagatcgacgccttagcagggcccaaggatattaaaaggggcatcacacaggtgttcagcataatcgacgatattaagaaagcgatgggatccaacccggaaaccgtttatctcgagtttgctcgcgagactcaaacatctcgactgaccaattcgcggcttaaccgtgtgcaggaaatctacaatagccctgagctgaagacggagttcgcctacttggcaaagaaactcgaggccgaaactaaggagtccattcatgacgatagactgtatctatactatctgcaggagggcagggacatgtacacagggaaagaaatcccctttgatcaaatatcaagtaactatgacattgatcacatcatcccacaggctttcaccaaggacgattctctcgacaatcgcgtactggtcaaccgggccacaaatgcaagaaaaagcaactcccctacttttaccaatgacattatcgataacaggaagtcatggtggcagagccttgtgaaacgaggattgatgtctaaggagaagttcgaacgcctgacggacaaacggaagaccttttccgagaatcagacaaaccatttcattgctagacaattagttgagactaggcagataatcaaaaatgtggccgatctcattaagaacaactacgacggtacccaggcggtcgccatccgtgctagtctgacaggcgaaatgcgccggtatcttgattggcccaaaaatagagacatgaacgattaccaccacgcacatgacgccctgatgatggctactgtggggaagtacgtagataggcgaggatttttcgacaatggcagcgtgtctgatggtgccgggaacgcatataatctatacaccaaggactggctcgttgcggcccgggtcggcacgcgcaacgattcccagagagtgaatccatatggattcattgtgggctcaatgaacagtaaagctgtcaggcaacaggttaataaggagacaggggaaatcgtgtggggaaacgagaatctggactacttgcggcacgtgctgagctataaaaagatattagtaacccgaagactctcgggttcctctggccgcctgtacgccgaaactctttttagccccaaccctaaagcaaagctgatcgctcagaaggccaataggtcagtcgcattgtatgggggattcacaaaagccgagagtgcttacaccgcgctcgtggagtttaacaagaaaggcgaccgttcctacaagctgattaaagttccaatggccatcgcaaatcgggtgaacgataagcagattactgtcaccgcttatatcgcctctctaaatctgagagacttcagcagggtggttcttgaacatctcccgctgggtacattgatacgcgagtccgatgggtcagaattttacgccgctagcagtgagtataagcacaacgcaaaagaactgtgggcccccaaggagattttacgatcttccaaaaagctcgacaaagcgacggctgataacctgatcgacatcttcgattttcttaccaatgacaagactattagcaacttcaagttttacgagaaagatctgttgcacctcaagaatgtgagagacaaattcgtagaagcctcggatgagataaagatcaaagtcctgtcagacgtgatttatgaactacataacgatgcaggctggcgggacccttttaagcacatccaagagaaaccagcctggacaatgcttcaggtgaagggaggcattaaactgtctgaaaaagctgcaatcgtctaccagagtcccaccggactcttcgagacaataactatcgttggggagtga

SEQ ID NO: 3046 - RNA, 4071 nt, synthetic construct
  misc_feature 1..4071: note = Cas9 variant
  source 1..4071: mol_type = other RNA
atgaagaaattcgaggaatactatatcggcctggacatggggaccggaagcgtgggttgggccgtcacagattccgcttacaacattataaagagacacggcaaagcactctgggggatcaggctttttgagtctgccaagactgcggaagaacggcgcattttccgaacgtcacgtagaaggaccgaacggcgcaaaaatagactgcatttgttacaggagatctttgctgaggaaattagtaagaaggacatgggattctatcaaaggatgaaagagagcaagtactggcacgaagataaaaaggacatcaacggcaatatgcccgagctgccttatgccctatttgcagatgacggtttcacagataaagactactataagaagtacccaactatatttcatctccggtacgccctggctaccaacacaaccgataaaccggacatccgccttctgtatttggcactccaccatattatcaagcaccgagggcacttcctgtttgagggcaaaaagctgtccgaagttaaagagttctctactgccattgaagctctcgtgcagcaggccgaggaacaggagatcgatttaaagtcgctgacacaagaggaagtacttacccagttggagcatataatgtcagacgcgcagtgcacgaaaagcgataagaagactcaggtgagtaaactgattgtcggaaccgacaagcaaaaacagaagcaggaaaaagcaatcgccgctctaattacaggctgtactgtgaagctctccgacatctttgccgatcccgagctggacaaggaagagatctctaaaatttgcttcagcgataatgggtacgaggaaaaggaggttgaaatagagtccgtgcttgcagacagatttctgttgatcgctgccgcgaaaggagtctatgattggaccgtgctccacgacattctgggtgatgccaggttcttatcagaagcaaaggtaaaaacatacgagaagcatcgggacgatctgcgtaaggttaaacagctccttcgcatggacaaggaggtgtatgaagctgtcttcggcgtgagtgagaaaaacgaagccaattacagcgcttatatcgggatggccaagaaaaacggaaagaagcaacctatagagaaaaagtgttctcaggaggatttttacaaattcctgaagaaacagttggacagactatccgtggacgaaatgggccaagagattatcgatgaactgaaggcagagatggacctcggtaccctgtttccaaaacagatgatcagggataatggggtcattccctaccagcttcacgaaaacgagctgaatgccatcttggacaacgctcagaagttctatccttttctcctggagaaggatcaagacggatacacgccagttgagaaaattcagaagatattccggtttcgaatcccctattacgtgggccctttaaatactgcgcaccaggataaaggcgggcattcatggagcgtacgcaagaaagagggaaagatttatccatggaacttcagtgaaatgatcgacgaggaagagtctgcaacaaagtttatcgagagaatgaccaataaatgcacttacctgattggtgaagatgtgctaccgaaggagtccctcctgtatgccaaattcaacgtccttaacgaattgaataacctgaggatagacggcgagctcatcgctcccgaactgaagcaggatatttacaataacgtgtttaaaaagtaccaacgggttacagggaagaaagtgaaggactatcttcgcatcaatggagtcattagcaaagagcaggagctgtcgggcttcgatcagaactttaagtcttccttgaaagcctaccacgacttcaagcagatcgtgggtaccggggtactctcagaaagtgagcaagaagacatagttagagatatcacgctgttcgcagacagccagaagatgttaaaacagaggattcatcgtaagtatcctatgctgtccgataaacagatcgcccaactagctaataagaaatacgccggctggggacggctctctcgaacctttctggagaacattgagagcgtgaataaggaaacaggcgaggtcatgaacatcataactgcactttgggaaaccaatgagaacttgatgaaactgctctcagggaagtatgactacacaaagcagattgaacagtggaatgcgagacaaatgaaaaagggagagatcgagtatcaggatattgaggaactgtacgtgagtccagctgtcaaaaggcccatctggcagactataaagatcgtgcgcgaaattaccaacatcatgggtggcgcccctaaacggattttcgttgaggtggcaagagaaccaggggagaagggagtaaggaaggtctcccgccgaaatcagttactggacctttacaaagcctgtaagaaagaggctcccgaattgtatgatcggctcgccaacaaggagagcgacaacgcactgcgttctgataaactatttctgtactattcacaaatgggcagatgcatgtacagtggtgacgctatcgatctcgacgaactgttcacaaataggtatgatatagaccacatttacccgcagagcaaggtgatggacgattccatcgacaaccgcgttcttgtgaagcgggatcttaattctaaaaagaccgacacttttcctgtctcggaggaatatagaaaagccgggaaggcgctgtggagcacgttactcaaaaagggcctgatctccaaggagaaatacaagaggcttacacgaaccgagcccttcggagaagatgagctggccggctttattgctcgccagttggtggaaactcggcagtcaaccaaagcagtagcccatctcctggaggaggcttacccagacgccgaaatcgtgtatgcaaaggcgagagccgttagtgagttcaggcacaaatttgatatgattaaggtccgtgaagtgaacgacttccaccatgctaaggatgcctacctaaatatagtggtcgggaacacatattacgttaaatttaccaaggacgcagcttggttcgtgcgcaataaccctggacggacttataatctgaaaaagatgtttgagaacgaaacagtgaaaagaggtaatgagacggcctggatccccggcgataacgggaccatttgtactgtaaagaaatggatgaggaagaataacgtcctcttcacacgacgggcatacgaggtgaagggaggcctgttcgaccaaaatatccttaaaaagggtaaagggcagattccaatcaagggcggagccgacgaacgcttgagatctagggataaatatggcgcttacaacaaggcgagcggggcctactttatgctggttgagtccgacggaaagaaaggcgaacggaagcgaaccatagagttcgtgcccgtctatttagcaaaatcactcgaagagagcgtggagctgagacgcaggtactgcgaagaggaacttggtctggttaaccctgatgtgcgtctatctaagatccggaaaaatgctctcattgacgtagatgggtttaagatgcacctggtcggaagaacagagaacaggttgctgttaatcggcgccactcagctcgtgctgtccgaagacgatcagcaacttattaagaaaatcggtaagtattgtctggaccatcgcgagaataaagatgccgtgttgagtgagaagtacgaactcaccatggacctgttcgagaaactatatgatatatttgtcttcaagctggaacagacggtttacgctgtgaagttgagcaaacaggcaaaggacctcaaagaggtaaaggaggaatttctggccttggatgacgagcaaaaatgcctgttactcatggaaattctgcaccttttccagtgttctccacagctggcgaacttgaccaatatcggcgggggaaagtccgctggctcactcaaaatcctgagtgacattacaaagcagcaaagcgtgctactgataaaccagtcgatcactgggttttatgagcaggtcattgatcttaagaccatctga

SEQ ID NO: 3047 - RNA, 4071 nt, synthetic construct
  misc_feature 1..4071: note = Cas9 variant
  source 1..4071: mol_type = other RNA
atggaggtgggcaactactatctggggatcgacgccggaaccgatagcgtcggttgggctgttacagacaatcagtacaacgtgattagaaagaaaggcaagtccctctgggggataaggcttttcgatggagcaaatactgcccaagaacggcgcacgtttcgagcgctgcgtagaaggaacgagcggaaaaagcagcgcatcaatttgttacaggaactgttctgcaaagagatttgtaagctagaccccaactttttcatcagactcagggattcttcactgtggagtgaagacaaggaggagaaacagatttatagcctttttaatgataagaacttcaatgaccggaactaccacaataactataaaaccatctaccatctgcgcgctgatttgataaagaataaagaaaagcacgacgcccgactcgtatatctggcaatccatcacattatgaagaacagaggccattttctgttcaatggtaacatcgagtccgtgacatcttttgaaaacactttcaatgagtttaaaaactgcctcttagatgagctggaaattaatcttgagtgtccttcgatctcagagttcgagaacatattgaaggacaggacctttaaagggacacaaaagtgcaaaaagctgaaagaactatgtagcattccaagttccgataagaagctcgacaatatcttcaaactgatttctggacttaaggccgacctgagcatcatcttcgaggatgagtcctttaaagaaaacgagcacaataagatttcattcgctgacagtaactacgaagagacccgggaagtcttgaatagcgagatacaggagaaaactctcatcattgatatctttaactctatatacaattgggtgattctgtccgacatcttatcaggcggcgaatataacgggggactgtacctcagcatcgcaaaggttaatacatataacaagcacagtaaagatcttaagattctgaaatctgtgatcaagaaatacttcccgcagaagtataccgacatttttgcctccaataaggagaacaactactgcagctatataggtatgtacaaatcgggcgggaagaaatactctgtcaagaaatgttccgataagcccgaagagttctataagacgatcaaaaatattatcaacaagaatactgctgaagagatctcaaacgacaaagatgtgcagtacattttgagtgagatagaaaataacagctttctacctctgcaaatcaataagaacaatggagtaattccatatcaggccaacaaaatcgagctcgaatccattctgaagaatgcggagaactaccttcccttcctgaaagagatcgacaccgaatgcaataagacaacttctgagaagataatcgatttgtttgagttccgtattccttattacgttggcccactcaacaccagcaaaggtgaaaatgcatggatgatccgcaaggaagacgggacaattagaccctggaactttgagcagaaagtggacatcgataagaccgccgctgagttcataacgaggatgactaaccagtgtacatatctgaataacgaaaccgtcttacctaaatactcactgctatacagtgagtatactgtgctcaatgaaattaacaatatccggattaacggagagaagatctccgtggaactgaagcaagacatatttaatatccttttcaaaaacaataagcaggtcacatgcaaaaagttgctgagccatctcaactctaatggctacaacctgaaaaaggatgacctttcaggcttcgatgggaattttaagagtagcctgtcctcttatattgacttgaaaaactacatcttcggagataatattgacaagccacagatctataacctcgccgagaaaataattctgtggatcaccttatacggtgatgactcgaagctgctaaaacgagttctccaaaagaactgtagcgagcagctgaatccggaacagatcaagaaaattacgaaacttaaatttaagggctgggggcgcttgtccaaagcattcctgtcagagctcagaggagctgatagggaaaccggcgagacaatgactatcattaagggtctgcggaacacccagaataacttaatgcaactgcttagtcagaattatacatttactgaagagtgcgagaaaataaactctgggtacttcatcaatcccaacgaaattagctacgactccatcgtgaagaatattgtagcctcacctagcatcaagcgctctgtgtggcagaccatacagatcgtcgaggaaattcaaaaagtgatgggctccaagccaagaaaaatctttgttgagatggcgaggggagaggaagagaaggtgcgtacaaccagtcggaaacagaagttgctcgatctgtataagaacattagcgacgaatgcgccaaaggcatgtacgacgagatctattctaaggatgaatccgacttcaaaaatatacgactatacctgtattacactcagatggggtgttgcatgtattcaggaaagcacattgatctcagtcagctgagcaacacgaatatctgggacagagatcatatctacccccaatcgaaaacaaaggacgattcccttgacaacttggtcctggtgtacaagtctattaatagcgagaaatcagatgacataatcagtcctaccattcagaacaatatgaggactttttggaagttactcttcgatcgcaaatttatctccgagaagaaatatcaccggctgaccagaacaaccccacttactgacgaagaactggcaggtttcattaacaggcagttggtagaaacacgccagtctacgaaggttatggctagcatctttaagcgaatataccccaacaccgagatcatttatgtgaaagccaagaatgtctccgatttccggcaccgtaaagactgtgaaaacggcgtgaaggtcagagagctcaatgactaccatcacgctaaagatgcctatctgaacatcgtggttgggaatgtgtactcaagcaagttcactaacaatccgctaatgtggctgaagaacaataggaacgtaaaatatagtctcaatcgcatgtacgactttaacctgacagtcaataacgagaatatttgggtggttggaaacgaaggcacccaaaagacagtgaacaaataccttggtaagaatgatatcttgtatactcggtacgcaatgaccaacaaaggggagctgttcgaccagaatcctttaaaggccacgggcgataaatctaagcagaccacactcgtccccctgaagaaaggaaaggaagtgtggaaatatggcgggtacaactccataactccaagctattttatgcttgtagagtcgaaggacaaaaagggaaattacattagaaccatcgaaacaatgcctctgtatagggagaaggagttctcaaagaacgaagagtttctactcaattactgcaaggaagtgcataaactgaaggagcccaaaatcattttgaagtgtatcaagaaaaacgctctgttaatagttgatggtttcccaatgcacctcaagggctctactgggctgcaacttaaactgcagggagcggtccagttgattctcgagagtgacatggtgatctacctgaagaaactaatgaagtttgtgaatgaaaacaatattaacaagaataaactggaggtcaccccctatatggaactttccgcaaaggagaacatcaaactctacgatatattcattcagaagctgacgacaggcatctatagcaaacgacctgccaatccagttgaaaagttgatcaacgctcgcgacatttttatcgagctgaccgtgaaagagcaatgcattgtgttatctgaaatactccatctgttccagtgtaagccgcttactagcgccaacctggtatccatcaatttgaagaaaacagtcggtattatccagatcgcaaagaacattaccgccaaaaatgtgaagctcgttcaccagtcacccactgggatatacgagtataccgtggatctgaacaaaatctga

SEQ ID NO: 3048 - RNA, 4071 nt, synthetic construct
  misc_feature 1..4071: note = Cas9 variant
  source 1..4071: mol_type = other RNA
atgaccaagaaagagcagccctacaacatcggcctggacattgggacaagctccgtgggatgggccgtcactaatgataactatgacctccttaatataaagaaaaagaacctgtggggtgttagattgttcgaagaggctcaaacggcaaaagaaaccaggttaaatcggtctacacgccgacgttacagaaggcggaagaaccgcatcaattggctgaacgagatcttttcagaggaactagccaagactgatcctagtttcctcattagactgcagaatagctgggtgtccaaaaaggacccagataggaaacgggacaagtataacctttttattgatggcccgtacaccgacaaagagtattaccgcgagttccccacaatctttcatctgcgaaaggaattgatactcaataaggataaagcggacatcagactgatttatctggctctccacaacatcttaaagtacagggggaatttcacctacgaacaccagaaatttaacatttctaatctgaacaacaatctttcgaaggagttgatcgagctgaaccagcaactaataaaatatgatatttcattccctgacgattgcgactggaatcatatcagcgacattctcatcggacggggcaacgccactcagaagagttccaatatcctgaaagattttacacttgacaaggaaaccaagaaactgttgaaggaggtaattaacctcatactgggtaatgtggcacacttaaacacgatcttcaaaacttctctgaccaaggatgaagagaaactcaattttagcgggaaggacattgaatccaaacttgatgacctggattcaatcttggacgatgaccagttcacagtcctagatgccgctaaccgtatatacagtactattaccctgaatgagatcctcaacggagagagctatttttctatggcaaaagtgaatcagtacgaaaaccatgccatcgacctgtgtaaacttcgcgacatgtggcacacaaccaagaatgaggaagctgttgagcaatccagacaggcctatgatgactacattaacaagccaaaatatggcacgaaggaactgtacacttcattgaagaaattcctcaaggtggcgctgcccacaaacttagcaaaagaggccgaggaaaagatcagcaaaggcacctacctggtcaagcctaggaatagtgagaacggggtggtaccatatcagctaaataagattgaaatggagaaaataatcgataaccagtctcaatactatcccttcctcaaggaaaataaagagaagctgctttccattttgagctttcggatcccttactatgttggaccactgcagtcggctgagaaaaacccgttcgcctggatggaacgaaagtctaatggtcacgcacgcccctggaactttgacgagatcgtggatagagaaaaatcctcaaataagttcattaggcggatgactgtcacagacagttacctcgtgggcgagcctgtgctgccaaagaacagccttatatatcagcgctacgaggtcctgaatgaattgaacaatatcagaattaccgagaacctcaaaacgaatcccatcgggtccaggctgaccgttgaaacaaagcaacgtatttacaacgagttatttaaaaagtataaaaaggtgactgtaaagaaactgaccaagtggctaatcgctcagggatactataaaaaccctatactcatcggcctgtctcagaaggatgagttcaatagcacacttactacctacttggacatgaaaaagatttttggttcaagtttcatggaagataacaagaattatgaccagatcgaggaactgattgagtggctcacaatctttgaagataaacaaatactgaacgagaagttacattccagcaaatactcttataccccagaccagattaagaaaatctcaaatatgcggtacaaggggtggggacgactgagtaagaaaattcttatggatatcactacggaaacaaacactccccagttgctccagctgagcaattactccatactagacctgatgtgggccactaacaataacttcatctctattatgtcgaatgacaagtatgattttaaaaactacatcgagaatcacaacctcaataagaacgaggaccaaaacattagcgatctggtgaatgacatccatgtctccccggcgcttaaaagaggcataacccagtcaattaagatcgtgcaggaaatcgttaaattcatgggccacgcccctaagcacatttttatcgaggtgacaagggaaaccaagaaaagtgagattactacatctcgcgaaaagcggataaaaagattgcagagcaagctgttaaacaaagcaaatgatttcaagccccaactcagggagtatctggtcccaaacaagaaaatccaggaggaacttaagaaacataagaatgacctgtcctcagagcgcattatgttgtacttcctccagaacgggaaaagcctgtattctgaagagtccctaaatatcaacaagctgagtgattaccaggtggaccacattctccctcgaacgtatatccccgatgacagcctggagaataaggctcttgtattggccaaagaaaaccaacggaaggctgatgacctgttactcaattctaacgttatagatcgtaatctggagagatggacctacatgcttaacaataacatgatcggactgaaaaagtttaaaaatctaactaggcgcgtgattacagacaaggacaagctcggtttcatccatcggcagctggtccagacctcccaaatggtgaaaggcgtcgccaacattttggataacatgtacaagaatcaggggacaacttgcatccaggcaagagccaacctgtcaaccgcttttaggaaagcgttaagtggacaggacgatacgtatcacttcaagcatccagaactcgtgaaaaatcgaaacgttaatgactttcaccacgcacaagatgcctacctggctagcttccttggcacctatcgcctgcggagatttcccacaaacgagatgttgctcatgaatggtgaatacaacaagttctatggccaggtgaaggagctgtactcgaaaaagaaaaagctacctgactccaggaaaaatgggtttataatttctccactggtaaacggaactacccagtatgatcgtaatacaggcgagatcatctggaacgtcgggttccgcgacaagattcttaaaatatttaattaccatcagtgtaacgtgactcggaagaccgaaatcaagacgggacaattctacgatcagacaatttatagcccgaaaaatcccaagtacaaaaagctcatcgcccagaaaaaggacatggatcctaacatttatggtggcttttcaggggacaacaagagttccatcaccatagttaaaatcgacaataacaagattaaaccagtggcaatccccattagactgatcaatgatttgaaggacaaaaagactctgcagaactggttagaggaaaatgtcaagcacaaaaagtctatacaaattatcaaaaacaatgtgcctatcggacagattatctacagcaagaaagtaggcctcctgtcccttaactcagatagggaggtggccaatcgacagcaactgatattgccacccgaacatagcgctctcctgcggctactgcagattccggacgaggatcttgaccagatcctcgccttctatgataagaacattctggttgagatcttgcaggaattaataacaaagatgaaaaagttctaccctttttataaaggtgagcgcgagttcctgattgcaaatatcgaaaactttaatcaagcgaccaccagtgaaaaggtcaactctctcgaggagctgatcacccttctgcacgctaattccacaagcgcccacttgattttcaacaacatcgaaaagaaggcatttgggagaaaaacgcatggcctaaccctgaataacactgacttcatttaccagtcggtgacaggactctacgagaccaggatacacatcgaatga

SEQ ID NO: 3049 - RNA, 4071 nt, synthetic construct
  misc_feature 1..4071: note = Cas9 variant
  source 1..4071: mol_type = other RNA
atgaccaagaaagagcagccctacaacatcggcctggacattgggacaggaagcgtgggttgggccgtcactaatgataactatgacctccttaatataaagaaaaagaacctgtggggcgttagattgttcgaaggggctcaaacggcaaaagagaccaggttaaatcggtccacacgccgacgttacagaaggcggaagaaccgcatcaattggctgaacgaaatcttttctgaggaactagccaatactgatccttcattcctcattagactgcagaacagttgggtgagcaagaaagacccagataggaagcgggacaaatataatctttttattgataacccgtacaccgacaaggagtattaccgcgagttccccacaatctttcatctgcgaaaagaattgataatcaataagaacaaggcggatattagactcgtatatctggctctgcacaatatcctcaaatacaggggaaacttcacctacgagcaccagaagtttaacatttccactttaaattctaacctgtcgaaagaacttatcgagttgaatcagcaactgataaagtatgacatttcattccctgataactgcgactggaatcatatcagcgatattctaatcggccggggtaacgccacacagaaaagttccaatatcctcaacaattttaccctggacaaggagacgaaaaagctgcttaaggaagtgattaacttgatactcgggaatgtcgcacacctgaacactatcttcaaaacctctttaacaaaggacgaggaaaaactgagcttttccggaaaggatattgagtcaaaactcgacgatcttgacagtatcctggatgacgatcagttcactgtgttggacaccgccaatcgtatatacagcacaattaccctaaacgaaatcctgaatggcgagtcttatttttccatggctaaggttaaccagtacgagaaccatgcaatcgatctctgtaagctgcgcgacatgtggcacacgactaaaaatgaaaaggccgtgggcctttcaagacaggcttatgatgactacattaacaaaccaaagtatgggacaaaagagctgtacaccagcttgaagaagttcctcaaagtcgccctgcccactaatttagcgaaggaagcagaggagaaaatcagtaagggaacatacctggtgaaacctaggaactctgagaatggtgtagttccatatcaactaaacaagattgagatggaaaagataatcgacaatcagtcccagtactatcccttcctcaaagagaacaaggaaaaactgcttagcattttgtcgtttcggatcccttactatgtgggcccactgcaatcttccgagaagaatccgttcgcctggatggaacgaaaatcaaacgggcacgctcgcccctggaattttgatgagatcgtcgacagagagaagagtagcaacaaattcattaggcggatgaccgtgacggattcctacctcgtgggagaacctgtcctgccaaagaactctcttatatatcagcgctacgaggttctgaatgaattgaataacatcagaattaccgagaacctcaagacaaatcccactggcagcaggctgaccgtggagacaaaacagcatatctacaacgaattatttaagaattataaaaagattactgtaaagaagctgaccaagtggctaatcgcccaaggttactataaaaaccctatactcatcgggctgtcacagaaggacgagttcaatagtacacttaccacttacttggatatgaaaaagatttttggatccagcttcatggaaaacaataaaaactataatcagatcgaggaactgattgagtggctcacgatctttgaggacaagcagatactgaacgaaaagttacactcttcaaattacagttatacaagcgatcaaattaaaaagatctccaacatgcgttacaaaggctggggccggctgtctaagaaaattcttacctgcatcactaccgagacaaataccccaaagtcgttgcagctcagcaactactccgtgctggacctaatgtggactacaaataacaacttcatatcaatcattagtaatgataagtatgactttaaaaactacatcgaaaatcataacctgaataagaacgaggatcagaatatttctaacctcgtcaatgacatccacgtgagccccgcactgaaacgagggataacgcagtccattaagatcgttcaagaaatcgtgaaattcatgggacacgctccgaagtatatttttatcgaggtcaccagagagactaaaaagtcagaaattacaaccagcaggggtaagcgcatacagcggcttcagtctaaattgctgaacaaggccaatggcttcaaacctcagttaagaaagtacctcgtgcccaacgagaaaatccaagaagaactgaagaagcataaaaatgatctttccagtgaaaggattatgctgtatttcttgcagaacgggaaaagcctctactctgaggagtccctgaatatcaacaaactatcagactatcaggtagaccacattctgccacgcacatacatccctgatgacagtctcgaaaataaggcgctggttcttgccaaagagaaccagcgaaaggcagatgacttgctgttaaacagcaatgtgatagataagaacctcgaacggtggacttacatgctgaataacaatatgatgggacttaaaaagtttaaaaacctgacccgtagagtcatcacggacaaggataaactaggcttcattcataggcaactcgtgcagacctcgcagatggtcaagggtgtggctaatatcctgaactccatgtataagaatcaagggacaacttgtattcaggcccgcgctaacttgtctaccgcctttcggaaagcactgagcgaccaggatgacagataccacttcaagcatcccgagttagttaaaaataggaacatcaatgattttcaccacgcccaggacgcttatctcgcgtcattcctgggcacataccgacttcgccggtttccaactgatgagatgctgttgatgaacggagaatataataagttctacggccaagtgaaagagctctatagtaagaagaaaaagctgcccgactccaggaaaaacgggtttataatttctcctctagtaaacggaaccacgcagtacgacagaaatacaggtgaaatcatctggaacgtcggcttccgtgataagattctgaaaatatttaattaccatcagtgcaacgtgacccgcaagactgagatcaaaacagggcagttctatgaccaaaccatttacagcccaaagaatccgaagtataaaaagctcatcgcacagaaaaaggatatggaccccaacatttacggaggcttttccggtgataataaatcaagcatcactatagttaagatcgacaacaataagattaaacctgtggccatcccaattcggcttatcaacgatctgaaggacaaaaagaccttgcagaattggctggaagagaacgtcaaacacaagaagagtatacagattatcaaaaataacgtgcccatcgggcaaattatctattctaagaaagtaggcttactctccctgaatagcgatagagagatagctaacaggcagcagcttattctgcctccagaacattcggccttgctccgaatcctgcaaattcccgacgaggatccggaccagatcctagcattctacgacaagaacatactggtggaaattcttcaggagctcatcacaaaaatgaagaagttctatcctttttacaaaaatgaacaggagttcctggcctcaaacatcgagaattttaaccaagctacgacctctgaaaagattaatagtttggaggaattaatcactctgctccacgccaactccacaagcgcacacctgattttcaataacatagagaaaaaggcgtttggacggaaaacccatggccttacactgaatgatactgacttcatctaccagtctgttaccgggttgtatgaaacgcgcattcacatcgagtga

SEQ ID NO: 3050 - RNA, 4071 nt, synthetic construct
  misc_feature 1..4071: note = Cas9 variant
  source 1..4071: mol_type = other RNA
atgagcaagaaagactccgagtactatatcggcctggatattgggaccaactctgtgggatgggccgtcacaaatggtaagtacgacctccttaacataaagaagaaaaatctgtggggcgttagattgttcgaagctgcagagtcagccgcggggaggcggatcaaccgcagtactcgacgtagatataggcggcgcagaaataggattaactggttaaatgaaatctttgctgatgagctgagcaaggtggacccctccttcctaacgcggctcaactcttcgtggatttcaaagaaagatagcagtcgcacccgagacaagtacaatctgtttatggatgccgactatacagataaaaactaccaccataagtatcctactatctaccaccttagaagggacctgatgttcgatgacaaacagtttgatatacggttggtatacctcgcactgcataatatcattaagtatcgtggaaacttcacctacgaccaccgcaagtttaatgtgtccgaaatgtctagcaacctgacaaaagccctcgagaatttcaaccaagagttaatggaatttgaggacgctttcccagataacaccgactattccgcaatctcagaagtcctgcttaagagtaataacgtgagcactaaaattgatgagatcatatctaatttggagctggacaaggataccaaaaagtacctaaaagaagttctcaagctgattcttggcaactccgccaatctgaacacaatctttcatacgtcattggacaaggatgacgagaaactcagcctgagtgctaaggatattgaattaaaactgaataacctcgactctcttctgtccgatgagcagatccacttcatcagctcggccaatgaattgtattcttccattactctaaacgacatactggacggtaagacctacctctcactggcgaaaatcaagcagtatgatacacactgcagtgaccttcaggagctgaaggagatgtggtacaaaactaccaatccggatttgattaagaaaagcagaaaggcatacaaagaatatgtgcatgggtcctacaacacagaggacttttataaggccatctctcccttcctcaagatagctattcctgaagatctggccaaagacgcattaaagaaaatcgatgctaatacctacctgccaaagcaaaggacgagcaacaatggagtcatccccttccagctaaacctcattgagctggagaaaatcattgacaaccagtcaaagtattacccttttcttaaggaaaatcgggagaaaataatcagtattttgtccttccgaatcccatattacgtgggccccatccaggcccctactgataagaactttagctggatggttaaaaagattcaagcgaaagcccgcccatggaatttcgacgaagtaatagatagagagaagtcttcaaacaattttatcaaaaggatgacaaccactgacacatacctggtgggcgaaccggtcctccccaagaacagtctgatttatcagaagttcgaggtgcttaatgaactgaacaatatccggattagcaaaaacttgtcccaggatcctctcgggtctaagctgtcggtggaggtcaaacagcaaatctttgaggaattattcaagcgctacaaaaccgttaagagcgaccagctgaagaaatggctaataagaaattcctattttacggacccaaccatcattggactctcaaagcccagtgagttcaactctagcctgtccacatttatcgatatgaaagcaattttcggtatggactttgtgaataaccctagaaattcaagccagcttgaagagttggctgagtggctgactgtattcgaagataagcaaatcctctctgagaaaatacgtcactccaactacccatatagtgaccagcagattcggaagatcagcaacatgcgatacagaggctgggggaggatttctaagaaactgttatgtgatatcaaggtggaatccaccatatataaatcacatcagctgcacccctacagtatccttgacttgatgtggagcacaaataacaatttctactcgattctccacaaggataaatataactttgagtccatcctggaagactacaatctaggaactgatgacaagaccgatattaacgagctggtcgacaatatccatacatctccggccctcaagcgcggcataattcaaagcatcaacatcgtgaaagagctggttaagttcatgggtcacgctcctcagcatatttttcttgagttcacccgggaagataaaacttcaacgttgagtgaatccagaaagaaaaggctgaagaaattatataataacctctctgaggacacaaagaagtttaaactggaccttcgcgattacctggtgcccgacaagagcatccagaaagaattggagtcccacgataaggacctctcaaaagagcgactgatgctatatttcctgcagaatgggaaaagcctctacagtgatgaagccctggacattaaccggctttctgagtatcaagtcgatcatatattgccacgtacctacatcaaggacgattccctggaaaataaagcattagtgctcgccaaggagaaccagagaaaagctgacgatctgcttctgcagcctagcattatcaataagaacatggaaaggtggatttacatgaaagaccacggaatgatctcgcccaagaagtttaaaaacctaactcgcaccacaataaccgaggacgataaggtacacttcatcaatcggcagctcgttcaaacttcacagattatcaaaaacgtggcgaatattctggacaacatgtataaggagcagggcacaacgtgcgtcgaaaccaaagcaaatttgtctagtgcctttagaactgctttctccgagcaggatgacaagtaccattttaagcacccagagttcatcaaaaacagggatgtgaatgactttcatcacgcccaagatgcatatctggcctgtttactcggcctgtaccgaatacagcgcttccccagcgacgaaatgcttctgattaagaaagagtatcggaagttctttgctcaggcccaaaactctgtcaaaaatcacgggaagatccctgatagccagaagaacggattcatcttggcaccactcgtgaatggtgaaacactgattaacaataaaaccatggagacaatatggaacatggactacaagagaaaagttatcaagatttttaattataaacagtacaacatcactaagaggaccgaaattaaaacgggcgagttctacaagcagaccctatattccccgcatgatgaaaatgtgaagaaccccatccctcagaaaaagaacctggacccaaaaatatacgggggatattcaggcgtacaaagtagctaccttgcgatcattaaggtcgatcagaaaaagcccacaatggtgtctgttcctatccgtttttccaagatgattgacgacggtaaactctcactgcagagttggttggagaataacatcaagcacaaaaagactatagaggtgctgaaaaccaagattccaatcgggcaattaacatataatcccaagaacggctacctcagcgtccagtccgaaaaagagatcgctaatgcccagcagctgttccttccgtttgaacatgtggcactgttgactctcctgcacgcccctacctctgagtatgatcaaattctatcgttctacgacacggatatcctgcttgaaatatttgacgagattacaaacaagatcaaaaccttctttccattctacattgatgagcaggaatatctcgtaagcatccgcgagaatttccagtcagctactgtgatagaaaaggttaacgtcctgcaacagttgttaattatgctgcatgccaattccagtcggatctctatcaaactcggagaggtgagcaagaaggacctgggcaggaaaaagaaaaggattccccttgaaaacacagatctggtgtaccagtccgtcaccgggttgtatcagactaagtttcacatcgactga

SEQ ID NO: 3051 - RNA, 4074 nt, synthetic construct
  misc_feature 1..4074: note = Cas9 variant
  source 1..4074: mol_type = other RNA
atgaacgacagaaataagaaatacaacatcggcctggatattgggaccggaagcgtgggttgggccgtcacagacaataactataatctccttcacgctaagaaaaagaacctgtggggcataaggttgttcgatggggcagagactgccgcgtcccggcgcacgtttcgatctacccgtagaaggtaccggcgcagaaggaatcggatcaactggttaaatgaaattttcgctgacgagctggccaaaaaggatcagtcatttctagttcgcatgaacagtagctgggtgtccaagaaagacaagatccgacaaagagatcagtataatctcttcatggactctgattacacagacgtagaatatcatagggagtttcccactattttccatctgcggaaacgtcttatcgaagataagtcgcaggcagacatacgcctggtgtacttggccctccacaacatcattaaatatagaggaaattttacctacgagcaccagaacttcgatgtctcacatatggacagcggcctggctctgctcttaaatcaactgaaccagcagcttcaggcatttgaggtggccttccctgacgaaacaaactttgagagtatgtccaccatcttgctggaaaagaagactccaacacagaaaattgatgagatcgttgaccaaatacagccggagaaggatctactccagattaccaaaaatatcatgaagatgctgcttggtaacaaagctgacctggtgaagattttctctttggatagcgacgataaaatcacggtcgaattttcctcaaatagtatcgagcaagacctcagcaacctggaagagactttatctgatgaacagttcaatattataaccctggccaactccatctactcaagcattgtgctcaatgacatccttagtggggagacatatctgtctttcgcgaaggcaaggcagtactccgatcacaagaaagacttggccaagctaaaaactatgtggcgggagagccccgaccgaaaggctgtaggaaaagccaagaaggcatatgatgactacctgcactcgggcaaatatggcatagaagatttttacaaggacatgtctaaattcctcgagaccgctacacctgttgaactggccaaggaggcgaacgagaaaattcttaataagtcctatctgttgaagcaacgcaacaatgaaaacggggtgatcccatttcagctcaataaaaacgagatgatcgaaattatcaataaccaggccaagtactaccccttcctggcagagaacaaagataagttactgtcaattctaagttttagaataccttattacgtcggaccactccagagcaaaaaggacaatcccttcgcttggatggaaaagaaatcccaaggtaagatcaggccttggaactttgatgagattgtggaccgggaagcctctagcaataacttcatccgcagaatgacctcaacggatacttatctgatcggcgagccagtgcttccgttgaaaagtcccatttaccagaagtatgaggtcctgaatgaactctccaacgttaggataaatgctgacgaggtggataaccctctgggggacaaacttagcgtagatctgaagcaggccatctacaatgaattgtttctcaaacatcgttctgtgtcaaaggcactgttaacaaagtggctgattaaccagagttatttccaaaatccacagatcagcggactagccgactccaaaaagtttaactctggcctcaccacttaccacgacttcaaaaagatttttggtgaggatttcgtcaatgaccccacaaaccagtcgcagctggagcaacttgctgaatggttgaccatcttcgaggataaaaagatactgaagatcaaactcgacgatagccagtttaattgcacgcctgaacagattaagaaaatcgcggggatgcggtaccagggatggggccgactgtccaagaaattactgtgtgacattaagaccacaactgtgacctcaaagaaccatcaacaggcaagttattctatccttgatttgatgtggaacacaaatagaaacttcataagcgttctcaaaaatgacacttacaagtttgaggataaaattcagaccttcaacctggacaagaatgaagccgctacaccacaagccatgatcgatgagctacagacctcccccgcactgaaaaggggcattcgccagtcagtgactatcatacaggagctcgtcaagtttatggggcacgccccggaacacatcttcctggagtttacgcgggaagacgatgtgagctctcttacaaagtccagagacagtaggttgaacaaactgtatgctcgcattgccaagaataccaaaaagactgacgatgagctcaaaaagagcttactgccttcttccgacatcaaagcaacccttaaggcgaacaagaataacctgtcaaatgatcgattgatgctctactatctgcaaatgggaaaaagtctatacagcaaccagcccctggacattaatcggctctcggaatatcagatcgatcatatactgccacagtcctacattaaggacaactctcttgagaatcgtgctttggtactggccagcgagaaccaacacaaatcaagtgatttactcctgaagcctgaaatcatcaaccagaatattgcaagatggaggtacatgaaagacgccggtcttatgggccccaagaagttcaaaaacctgacacgcatccagattaccgattccgaccagaataactttataaatcggcagctagttcaaacttctcagatcattaagcatgtgagcaacatcctcgattccatgtatggggaccaaggaacacagtgcgtcgagacgagagctcacctgtcaaccgagttcaggaaagcctttagcaatgaagacgataactaccatttccagcacccagaatttgtgaagaatcgaaacattaatgactatcaccatgcacaggatgcttacttggcctgtctgttaggcctctatcaaatgaaaaagtaccccactgacaacatgatcctgcttaagaaagagtataagcgcttcttcagtaataccaaaaagatatacgataaaaagcaccattttcctgactacgtcaagaacggttggatcattgggtctatgttcaatggcgagaaatatgtggatgaagagacaggacagatcatttgggaccagcagacaaaggatatggtttcctgcatctttcaatacaaacagtataacgtgactaagcggaccgaagcggccaatggcgagttctacaaccagacggtatataaaaaggacccaaacgagaagagaaaactgatatcattgaagcaggggctcgataccaaactgtacggaggttattcgggcgacaatccggcttacattgtcctagtgaagatcgatgacaaaaagaacaaactggttaagatgcccatcaggcttgcagaacaagtggacaataagacaattgatctccagacttggctggaggaaaacgtccctcacaaaaaggggatacaggtgttgaaaaccaagatcccactgggacaggtaatttacagcaaaaagaatggctatttagccctcaagtctgacacagagatcgtgaacgctcaacagctggttcttccctacggttatgtcgccctgttgactctcctgcagaaaatgcctgaaaataagtacgatgaggtgctagcatgttatgacgatgggattctggacaacatctttgtggcgataatcgataaaatgaagcacttctacccatattacagtggcgagcttaaaaccctctccgacaatattgataactttaaggaaagccccgacgtcaataagatcaaaacgctgcaacagttgttactgctcctgcatgcctctagcacaaccgcttccattgagttcaacaatgttaagaaaaactcacttggacgtaagccgaatagtatcaacatacagaacactgatctgttgagcttttctgccacaggcctatacgaatcccgcattcacatcgactga

SEQ ID NO: 3052 - RNA, 4074 nt, synthetic construct
  misc_feature 1..4074: note = Cas9 variant
  source 1..4074: mol_type = other RNA
atggccgctaagaactacaatatcggcctggacattgggaccagctccataggatgggcaatcgtggatgacaactatcagctcatgcacgccaaaggtaagtacggctatgggacaagaatttactctgagggacaaactgcggctgataggcggggcttccgcacgacccgacgtagacttaataggcggaaatggcgcctgagattgttacaggactttttcgaaccctatatcctgcctcaggatgaggcctttttcattaggcagaagcaatcaaacctagtcccacaggacactaaaaagcagtacccggaaagtgttctctttgatgacactagcgataaggacttctataccgagtaccccacaatctaccatctgcggcaggcacttatgaccgaaaatcgccaatttgatatacgagaggtgtatctggccatccaccatattgtaaaatacagaggtcacttcttgaacaatgctcctgtgaagacttttaaatccgggaacctcgacctggcaatcaagttcaatgagctgaacgaagagtttaaatctgtctatccagatctcgaattacagttcaatctggaccagattgacgagatcaagaagatacttttggattcgacaaaatcaaggtttgaccggcagggagaggccgtgaagctgatttacaccgttagcgaagtgaaaacgatcgagaagctacaaaacaaaattgtcaagcagttcctcagtggcatcctgggccttaatactcgtttcgatgtgctgaccaacacagaatccgacgattctatgtggaaatttagcttggactccgagtcaagtgatgacgctctcgatgaaatcattgcccagctggacgatcccgcgatacatgtagttgagttagtgaatgagatccacagctctattactctggcagggatcgtccctgaaggacaaggtctctccgagtcaatggtggaaaagtatgaggcccacaaggctcatcttcagctgttgaaagccgtggaaaagctagtcgacaaaaaggcagctgacaaactggaggttgcctacgatcagtatataaacggcaaggacagcaagcagttcattaaagaggatttttacaaggcggtgcaaagtgaaatcaaaggggtagccggagacgaggtggcagaaatcaaccagctcattgagctggatcagttcatgccaaagcagcgcaccaaagaaaatggcgctatcccccaccaacttcatcagcacgagctggacgtcattatagagaaccagtctaagtactatgattggttgggtgaaaaggtggggaatgagtacaaactcgacaagctggtttcctttagagtgccttattacgtcggaccattagtggatacagccagcaaagaaaagaaagacgagaccaggttcgcttggatggtacggaagaacccggagtcgacggaagccatcactccctggaattttgaggatattgttgacaagaacgcatctgccgaaaatttcatcaaacgaatgacaaccaaggataaatatctgctaaacgaggacgtgctccctaagtgctccctgcttactcaggactttgaagtctacaatgagttgaacaatatccgcgtgaacggcgagaaattcacagctgaacaaaagcagctgattcacgatgagctctttaccaaacatgcgtcagtcagtataaagcagctgaaggacttccttgtgagcgaactgatgtatgttagagataatttgaaagtggagggcctcgcagacgaaaagaaactgatgtcctctttaagcacgcagtttgattaccaaaagatcattccagaccagatcaacgatgtaaaatacagggaggacattgagcagatcatagaatggtcaaccatcttcgaggatgccgctattttcaagacaaagctgaaagaaatcgactggctaactgatgagcaacggaataagctcgccaacaaacgctatagagggtggggaagtctgtccaagaggcttttggcatgtctggtcgacgaaaacggtcagcgtattatcgatatactccgggacagctctgacaattttatgatgattgtgaaccgacccgagttcaaacaggccatctttgatgagaatgctaacctgaccgaaacaaattcaaagaaggacatgttcgagatgattgataacttttacacaagtcctcagaataaaaaggccatcagacaagttttactggtggtccaggacatacagaacgcaatgggcggggtggcgccacagaaaatcttcattgaatttgctagggaggatgaggtaaatggacgccggaccaacagcagatattcccaaatcagggaaatgtactctaaggtgacagacgatgttattaataaaaccgtccgcggcgagcttgaagccaacaagggttcgttgaataaggagaaactcttcctgtattttctacaagggggcatcgacctgtacagcggaaagactataaacattgataatatctcctcatatgacgtggatcacgtgctcccccagagtttcatcaaagacgactctattaacaacaaggtcctggttaatgcaaaaggcaaccgagtgaagaatgataacgtgccgatggaactttttggggccaaaatgtaccctacgtggaagcggatggtagacacaggaatcatgagcaaggctaaattcaagaatttgaccctgaaccccgataatgtcgacaaatttaaggccgagggtttcattaaccgtcagttagtggagactagacagataatcaaactcgttgcacagattctgaatgataaacttggcgacgataccaagatcgtgtccgtcaaagctaacctgacacatgacatgagggtgttctttgatttcccaaagaatcgcaacgttaataactaccaccatgcctttgacgcgtatttgtcagccttcgtggggacctacctctataaacggtaccctaagctgcagccctattttgtatacggagagttcaaaaagatggataagctaaagaatatgactagctttgacttcctgagagatctcaagcacacagacaaagtcgtggacaaggatacgggcgagattatcgctgacaaactggcagtgataaccaacatgaacaagatctatgattttaagaaagtccttgttactcacgaagtgcatgaaaattctggtgccatgtacgaccaaacattgtacccagctaagctggataaatccttagggaggaagggcgccaaacagctcattcccaagaaggacgatatgcctaccgcactgtatggaggctacacagggagtaaagacgcgttcatgagcatcgtacgacttaagaaaaaggatgaagtgtattacaaagtcattggaatcccagtgcgcatagccgactctgttcagcacggtaaggaggtggatgtcgaggctctgactcagtttattgaaaccaaattcacgaaggagaacctaaataagaaaaccggcgaaatcacacggaaggtggagtggttcgaactcgttctgccgaaagtgttgtttgggcaagccgtcttcgacggaggccagccctttatgctgggttcctcaacttatcctcataacttaagagagctcgtactgaccaaggatagtgtgaaaaagatcgcagggaaggagagcaataaatcgtaccttgacgcttatgacgaaattatggaggccatgaacaagtacttcccactgtacgatacaaataaatttagggaaaaggttatagagggccgttccaaattcatcgacttgcccgataaggacgagtatgaaaacaataagctcgtgcaggtcggaaaatctactattatcgatcgcatgtttattggcctgcacgcaaacgccgctcggaccgacctaaagaatatcgggataacgacacctttcggatttatgcagcaagcgagcggcatcaaactgaccaaggatactgtggtacttttccagtcaagtacaggtctctttgagagaaaagtggccctgaaggacttgtga

SEQ ID NO: 3053 - RNA, 4077 nt, synthetic construct
  misc_feature 1..4077: note = Cas9 variant
  source 1..4077: mol_type = other RNA
atgaaggagccctacggcgtggggctggacatcggaaccaacagcgtcggttggacagttgtggatgcctccggccacgtaagaaaaattaaggggcagactggaataggcgtgaggctgttcaaagaaggtgctgcagccgcggaccggcgcgggtttcgaacgacccgtagaaggcttaagcgggtcaaatggcgcctgagattgttaagggagttctttgatcaacctatctctaaggtggacattaatttctttgctcggcgcaagtattcagatgttagtccacgagacccgaactacaatggactggaaaagacactattcaacgatagaagcgaccaggatttttatcatgactaccccactatctatcacctcagggaggccctgatgacccagcatcggaagttcgatgtgcgtgaaatttaccttgcaatccaccatatagtcaaatatcgcggcaattttctgagaaacgacgccgctacagcatacaggtccggcaccttggatctccagcaacacttcgagactctgaatcacctgttttctcaggccgacctcgagttaaacctgaatcttacaaccgacgtggctttgctggattcgatcaagcagacgctagtacggactgacatttcacgaagcgatcgccagaaactcatcatgcctctgcttgccgttctgaccggggcgacaactgcagaaaagaagagacaaaaagccgtggtcaccgagttcgctaaggccttggtgggaaacaaaacaaagattgacgtgctcaccctgacggatatcgacgcaactgaagctaaagattgggcctttagtttagaggagaatcaggacaagctgccaggtatagaagataggttctccgaggtcggccagcagattatcgacgaagttattcggctctacgcgtctgtgaaccttgcccaactgatccccgaggggaaacgcttcagccagtccatggtagaaaagtataagagacatggagaggatttgaaactactgaaggcatacatcaggtcacagagtgacgctaaacgtggccgggccattcgagctacatatgaccaatacatagatggtgtcaagagcaaacaggtgacccaggaggcctttcagaaggcactcgggaagttcgtggacgccgatgttgacctcaattcttgggctgcgcaaatcaaacaggcaattgattccgaacagtttatgcctaaacttagaactaaacagaacggagccatcccatatcaagtgcagcagaatgagctggaccagataatttcaaaccaaaaggaatactatccctggttgggcgaggaaaaccctgtcatcaaaaggcgcggcaagttcccatacaagctcgatgagctgtttgggttccgggtgccgtactatgtaggacccttaatcacaaaagagatgcaggctgccaccgcaaatgccggttttgcttggatggttagaaaggccgacggccctattacgccatggaacttcgatgacaaagtggatagggtcgcaagcgcgaccgcttttatccagcgcatgcagacaactgacacctacctgattggggaagaggtgctacccgcccgaagtctcatatatcaacggttcatggtcctgaatgaacttaacaatatccgtgtggatgacggacagttgacacctagacagaagcaaaggctgtacaaccaggtttttaaaaagcacaagcgcgtgactgcaaagaatattcaggacaacctcgtagccgctcgggagttcccaaccgcccccagaatcacaggcctggcagatccgaaggtctttaattcttcccttagcacctatcatgacctgaaacaggtgttgcctgaagctatgtcggatgttaggaagcaagccgacatcgagaaaattatactctggtctactatcttcgaggattccacgattttcaagcagaaactgacagaaatctcatggttaaccgcggcccagctgaagcagctaggtcaactccgataccgcgggtggggccagctgcttcggaagttgctgactggactcaaagacgataacaatagaagtattatggacggcctgtgggagaccaacgctaattttatgcagttaaggagccagcccgcaatcgaaaaccaaataaagtccgccaatcaggctaacctgacaaccgccgatcttcaggacactatcaacgagttgtatacatctccacaaaataaaaaggcaattcgtgaggtgatggtcgtgctcgcggatatcaaagacgccatgcacgggcagacgcctaactggattttcgtagaagctgcccgcggaggtggcgtggcagggcggagaacccagagcaggtcaaagcagatcgttgctgcctaccaaggaactgcacaggccatagtccgagatcaggtgcagcgggagctgaaggagaaaattaagaataaagctaactttaatacacgcctagtgctgtacttcctccaaaacggcagagacctgtataccggtgacgcgatcaatattgataggcttagtgagtacgacatcgatcacatattgccccagtccctggtcaaggacgatagcttagacaaccgggttctcacaaatgcccgaatcaacagagagaaaaatgatacttttgcatctgaaaagttcgggaagaaaatgggcgctaagtggaaagagatgcatcgcatgggactgatgaccaagaggaaacttgaccacctgttgatgcgtccagatgaaatttcaaagtatgccacgggctttatcaaccggcagctcgtggagaccagacaggtgattaagctggtagaggaactaatcaatgccgaataccccagtacagctatagtcagcgtgaaagcaaacctgactcatcaattcaggcagacctttgacttccctaagattcgcgaggttaatgattatcaccatgcctttgacgcggctctcacagccttcatcgggacttacctgcttaaacgatatccaaagttggagagatttttcgtgtacggaaaattcgcaaagcagccggtcaacctgacccggtttaacgtgatcaggaaattagccaagacggacacacccattaccgatatcgacactggtgaagttctctgggataagctgacagacattaaatacttcgagaccctttatgattacaagcgcctgctagtgactcgtgaagtatccgagaattatggcgctatgtttgaccagaccctcctgaaagcatctgataacgggaagagattgatacggaaaaagcaatcgttcgacacagccatctacggaggctatacgggtaagaccctggcgtacatggctattgtcaaagtgagcactaagaaagatgtgcagtatcaggtcgttggggtgcctacaaccatggtaacacaaatcgaacagttagagcagcagggcatgactaataagcaagccgtgaccaaagtcattgagccactcatcgcagccaacaataagaagatgctgacgtacgaagtgcttctgcccaaagttaggtttgaacaggtggtccgcgaccgaataaagggacagacacacagattcgctttgggcaccgatacttactatcacaacatccaggaactctacctgcctctaaccctgcaacgggcctttcttgggaaacagaatgagtccgaggtgcagctcaaccagaatctgttgacagttttcgacgcaactctggctcaagtgaacaggtattttccattatacgaaatgaataagttcaaaaagattctcaactcagcccgcgatcagatcgagctgcttgaagcgaagaatcagtttgtcaaaaacaagctggtattgggaaaacaaggcattctcaccaatatgttcatcggtctgcatgccaacgcaagttatggggacctaaaggtgctgggagttaaaatagacttcggcaaacttcaggtgcccggtggcattaagctcacaggggatgctgagatcatctaccagtctccgacgggactgtttgaaagaaaaattgccttgaaggacttatga

SEQ ID NO: 3054 - RNA, 4077 nt, synthetic construct
  misc_feature 1..4077: note = Cas9 variant
  source 1..4077: mol_type = other RNA
atgaacgagccctacggcgtggggctggacatcggaaccaatagcgtcggttggacagttgtggatatgaacggcagagtaaggaaggtgaaagggaagactgccctcggagctcggcttttcaaagaaggcgcaacggccgaggaccgccgaggttttcgtaccacaagaaggcggctgaagcgcgtcaaatggagattgaggttactgcgggagttctttgatcagcctatttccaagatagacccaaatttctttgcgcgccgaaagtattctgatatctcaccgagagaccccaactacaatgggctagctaaaactctcttcaacgataggaccgaccaagaattttatcacgattaccctacaatttatcatctgcgggacaaacttatgaccagtgatcgtaaattcgacatccgcgaaatttacctggccatccaccatatagtgaagtatagaggaaactttttgaggactggcccagcaagccagtacggctccgcctctctccacctggctacatcgttccagaaactgaatgatctctttgcacagtcagaggagagcttaaatttcaagctggttaccgacgaagcccaacttcagcagatccagcaaattttggtgcggacggacctgagtcgatccgagcagcagcgccagatctggcccctaatggtcgtgctcatgggggctactgccgcggaaaagaaaagacaaaaggattttgcaaaagagctggccaacgctcttgtaggactgaaggccaaattgaatgttgtgaccctcacaaacgtcgacactaccgtggtgaaggattggacattcaccctggaggaatctcaggacaaattacctgagattgaggaacagctgagcgaagtcggtcaacagatcatggatgaggttatacagctctacgcatccgtgaatcttgctcagctgattccagccggcaagaggttctcacaacatatggtagagaagtataaccaccacgaaaagaatttggagctactgaaggcgtacatccatagtcagagcgactctaaacgggggcgcgaaattagagccacgtatgataggtacatcgacggagtgaagtccaaacccgtcactcaggagatgttttataaggatctcatgaagtacgtggaagcagacgctacatcaaaccacctggccgctgagatcaaagatgagattgacagcgaacagttcatgcctaaacttcgtaccaaacaaaacggcagtataccatatcaggttcagcagtacgagctggaccaaatcatttctcatcagaagaaatactatccgtggttgggtgaagagaatcccgtggccgaacggcgagggaagtttccttacaagctcgatgagctggtcggattcagagtgccatattacgtaggccccttaatcactaaagaggaccagcaggcaacatccggcgccgggtttgcttggatggttaggaaggcggatggacctataaccccatggaacttcgaccaaaaagtggatcgcattgcaagcgccacggcttttatccagcggatgcagaccacagacacttatctgatcggtgaagatgtcctacccgccagatcgctcatttaccaaaggttcatggtgctgaatgagcttaacaatatgcgcgtcgaagaccagaagttggcaccgcgacagaaacagcggctgtataaccaagtgtttaagcagcaccagcacgtttctgtgaagaatatccagcaaaacctcatggatgccggcgagtaccgtgagacccctaaaattacagggctggctgaccccaagggattcaattcctcacttagtacttaccatgattttaaaaagatactgccagaagccatcgcagacgagcacaaaagagcggatattgaaaagatcatcttgtggagcaccacattcgaggactccgctatttttaaacagaagctcgaagaggtagcctggctgaccgacgcacagaggaagcagttatctggcctgcgctatcggggttgggggcaactaagccataaactcctgactgccttcaaggatgacaacggcagatcagtcatggatggactttgggagacgagtgacaatttcatgcagttgaggaaacagcctgctatagaaacacaaatcaaggaggccaaccaggcaaatctgaccgatgctgacattcaggatactatcaacgaactctacaccagcccccagaataaaaaggccattcgagaggtgatgctggttttagacgatatcaagaacgcgatgcacggccaaacaccatcctggatatttatcgaagccgctcgcgggggaggtgtggcaggccggagaacccagtctaggtcaaaacagattgtcgaggcctataagagtactgctaaagagatcgtgagcgaaaaggtacagcatgagctgaacgaaaagattaaggccaaggcagacttcaatacacgtcttgtgttgtactttctccaaaacgggcgcgatctgtatacgaatgaggcgatcaacatagaccggctatccgaatacgatattgaccacatcctgccccagtctctcgttaaagacgattcgctggacaatagagtccttaccagcgccaggattaaccgagagaagaatgatactttcgcttccgagaaatttggacggaagatgggcgcccagtggcgcgaattgcacagaaacggtctgatgacacagaggaaattaaagcatctcctgatgcggcctgacgagatctcaaagcacgcaaccgatttcataaatcgacaacttgtggaaacaagacaggtgatcaaactggtcgaggagttgattagttctgaatatccaagcgcttccatcgttgccgtgaaggcaaacctcactcatcagtttcgccagaccttcaattttccgaaactgagggaggtgaacgactaccaccacgccttcgatgcttcactaacggcgtttattgggatgtacctgctcaagcaatatcccaaactggaacgtttctttgtatacggcaagttcgccaaacagcctatcaatcttacccggttcaacgtcataagaaagttggcagtggctgaggaaccaattgccaatatcgagacaggagagatcctgtgggacaagactgccgatattaaatgctttgaaaagttatataactacaaaaggctcctggttacccatgaggtgcgcgaaaactatggcgctatgttcgaccagacaatctttaaggcaactgatagccgaaaaagacttattcaaaagaagaaagggttcgccaccgagacgtacggaggttatacaggccggaccctggcgtacctagctatagtcaaggtggttactaataaagacacacagtaccaggtggtagggatccccaccactatggtcacccagattcaacagctcgaagcctctggactgacatccaagcaggcagtgacgaaagccatcggcgctatgattaacgagaataacaagaagttgcagagttatgaggtgctgttacctaaagtcaggtttgaacaagttgtgcgcgacgaggtaaagggtcacatccatcgtttcgcactcgggaccgatacttactatcacaatatacaggaactgtaccttccactgacaatccagagagcctttttgggcaaacggaacgacaccgatgcgcagacagagcaaaatctcctgactgtgttcgaaaccacgctagctcaggtcaacaggtattttcccctgtacgagatgaataagttcaaacagattcttaacagcgcccaagagaagtttgcagccctcccgacaaagaataaaaccgtgaagaacaaactggttactggaaaggacggcgtgttgaataacctgttcatcgggttacatgctaatgcctctctcggagatctgaaaattcttggcatgaagaccggtttcgggaagctgcaggtccctggaggcttgaaactcacagaccaggcagaaatcatatatcagtccccaactggtctgtttgagcgcaaggtggctctaaaagatctgtga

SEQ ID NO: 3055 - RNA, 4077 nt, synthetic construct
  misc_feature 1..4077: note = Cas9 variant
  source 1..4077: mol_type = other RNA
atgaacgagccctacggcgtggggctggacatcggaaccaatagcgtcggttggacagttgtggatatgaacggcagagtaaggaaggtgaaagggaagactgccctcggagctcggcttttcaaagaaggcgcaacggccgaggaccgccgaggttttcgtaccacaagaaggcggctgaagcgcgtcaaatggagattgaggttactgcgggagttctttgatcagcctatttccaagatagacccaaatttctttgcgcgccgaaagtattctgatatctcaccgagagaccccaactacaatgggctagctaaaactctcttcaacgataggaccgaccaagaattttatcacgattaccctacaatttatcatctgcgggacaaacttatgaccagtgatcgtaaattcgacatccgcgaaatttacctggccatccaccatatagtgaagtatagaggaaactttttgaggactggcccagcaagccagtacggctccgcctctctccacctggctacatcgttccagaaactgaatgatctctttgcacagtcagaggagagcttaaatttcaagctggttaccgacgaagcccaacttcagcagatccagcaaattttggtgcggacggacctgagtcgatccgagcagcagcgccagatctggcccctaatggtcgtgctcatgggggctactgccgcggaaaagaaaagacaaaaggattttgcaaaagagctggccaacgctcttgtaggactgaaggccaaattgaatgttgtgaccctcacaaacgtcgacactaccgtggtgaaggattggacattcaccctggaggaatctcaggacaaattacctgagattgaggaacagctgagcgaagtcggtcaacagatcatggatgaggttatacagctctacgcatccgtgaatcttgctcagctgattccagccggcaagaggttctcacaacatatggtagagaagtataaccaccacgaaaagaatttggagctactgaaggcgtacatccatagtcagagcgactctaaacgggggcgcgaaattagagccacgtatgataggtacatcgacggagtgaagtccaaacccgtcactcaggagatgttttataaggatctcatgaagtacgtggaagcagacgctacatcaaaccacctggccgctgagatcaaagatgagattgacagcgaacagttcatgcctaaacttcgtaccaaacaaaacggcagtataccatatcaggttcagcagtacgagctggaccaaatcatttctcatcagaagaaatactatccgtggttgggtgaagagaatcccgtggccgaacggcgagggaagtttccttacaagctcgatgagctggtcggattcagagtgccatattacgtaggccccttaatcactaaagaggaccagcaggcaacatccggcgccgggtttgcttggatggttaggaaggcggatggacctataaccccatggaacttcgaccaaaaagtggatcgcattgcaagcgccacggcttttatccagcggatgcagaccacagacacttatctgatcggtgaagatgtcctacccgccagatcgctcatttaccaaaggttcatggtgctgaatgagcttaacaatatgcgcgtcgaagaccagaagttggcaccgcgacagaaacagcggctgtataaccaagtgtttaagcagcaccagcacgtttctgtgaagaatatccagcaaaacctcatggatgccggcgagtaccgtgagacccctaaaattacagggctggctgaccccaagggattcaattcctcacttagtacttaccatgattttaaaaagatactgccagaagccatcgcagacgagcacaaaagagcggatattgaaaagatcatcttgtggagcaccacattcgaggactccgctatttttaaacagaagctcgaagaggtagcctggctgaccgacgcacagaggaagcagttatctggcctgcgctatcggggttgggggcaactaagccataaactcctgactgccttcaaggatgacaacggcagatcagtcatggatggactttgggagacgagtgacaatttcatgcagttgaggaaacagcctgctatagaaacacaaatcaaggaggccaaccaggcaaatctgaccgatgctgacattcaggatactatcaacgaactctacaccagcccccagaataaaaaggccattcgagaggtgatgctggttttagacgatatcaagaacgcgatgcacggccaaacaccatcctggatatttatcgaagccgctcgcgggggaggtgtggcaggccggagaacccagtctaggtcaaaacagattgtcgaggcctataagagtactgctaaagagatcgtgagcgaaaaggtacagcatgagctgaacgaaaagattaaggccaaggcagacttcaatacacgtcttgtgttgtactttctccaaaacgggcgcgatctgtatacgaatgaggcgatcaacatagaccggctatccgaatacgatattgaccacatcctgccccagtctctcgttaaagacgattcgctggacaatagagtccttaccagcgccaggattaaccgagagaagaatgatactttcgcttccgagaaatttggacggaagatgggcgcccagtggcgcgaattgcacagaaacggtctgatgacacagaggaaattaaagcatctcctgatgcggcctgacgagatctcaaagcacgcaaccgatttcataaatcgacaacttgtggaaacaagacaggtgatcaaactggtcgaggagttgattagttctgaatatccaagcgcttccatcgttgccgtgaaggcaaacctcactcatcagtttcgccagaccttcaattttccgaaactgagggaggtgaacgactaccaccacgccttcgatgcttcactaacggcgtttattgggatgtacctgctcaagcaatatcccaaactggaacgtttctttgtatacggcaagttcgccaaacagcctatcaatcttacccggttcaacgtcataagaaagttggcagtggctgaggaaccaattgccaatatcgagacaggagagatcctgtgggacaagactgccgatattaaatgctttgaaaagttatataactacaaaaggctcctggttacccatgaggtgcgcgaaaactatggcgctatgttcgaccagacaatctttaaggcaactgatagccgaaaaagacttattcaaaagaagaaagggttcgccaccgagacgtacggaggttatacaggccggaccctggcgtacctagctatagtcaaggtggttactaataaagacacacagtaccaggtggtagggatccccaccactatggtcacccagattcaacagctcgaagcctctggactgacatccaagcaggcagtgacgaaagccatcggcgctatgattaacgagaataacaagaagttgcagagttatgaggtgctgttacctaaagtcaggtttgaacaagttgtgcgcgacgaggtaaagggtcacatccatcgtttcgcactcgggaccgatacttactatcacaatatacaggaactgtaccttccactgacaatccagagagcctttttgggcaaacggaacgacaccgatgcgcagacagagcaaaatctcctgactgtgttcgaaaccacgctagctcaggtcaacaggtattttcccctgtacgagatgaataagttcaaacagattcttaacagcgcccaagagaagtttgcagccctcccgacaaagaataaaaccgtgaagaacaaactggttactggaaaggacggcgtgttgaataacctgttcatcgggttacatgctaatgcctctctcggagatctgaaaattcttggcatgaagatcggtttcgggaagctgcaggtccctggaggcttgaaactcaccgaccaggcagaaataatttatcagtccccaacaggtctgtttgagcgcaaggtggctctaaaagatctgtga

SEQ ID NO: 3056 - RNA, 4077 nt, synthetic construct
  misc_feature 1..4077: note = Cas9 variant
  source 1..4077: mol_type = other RNA
atgaaggagccctacggcgtggggctggacatcggaaccaacagcgtcggttggacagttgtggatgcctccggccacgtaagaaaaattaaggggcagactggaataggcgtgaggctgttcaaagaaggtgctgcagccgcggaccggcgcgggtttcgaacgacccgtagaaggcttaagcgggtcaaatggcgcctgagattgttaagggagttctttgatcaacctatctctaaggtggacattaatttctttgctcggcgcaagtattcagatatcagtccacgagacccgaactacaatggactggaaaagacactattcaacgatagaagcgaccaggatttttatcatgactaccccactatttatcacctcagggaggccctgatgacccagcatcggaagttcgatgttcgtgaaatctaccttgcaatacaccatatcgtgaaatatcgcggcaattttctgagaaacgacgccgctacagcatacaggtccggcaccttggatctccagcaacacttcgagactctgaatcacctgttttctcaggccgacctcgagttaaacctgaatcttacaaccgacgtcgctttgctggattcgattaagcagacgctagtgcggactgacatctcacgaagcgatcgccagaaactcattatgcctctgcttgccgtactgaccggggcgacaactgcagaaaagaagagacaaaaagccgttgtgaccgagttcgctaaggccttggtcggaaacaaaacaaagatcgacgtgctcaccctgacggatatagacgcaactgaagctaaagattgggcctttagtttagaggagaatcaggacaagctgccaggtattgaagataggttctccgaggtgggccagcagatcattgacgaagtcatccggctctacgcgtctgttaaccttgcccaactgatccccgaggggaaacgcttcagccagtccatggtggaaaagtataagagacatggagaggatttgaaactactgaaggcatacattaggtcacagagtgacgctaaacgtggccgggccatacgagctacatatgaccaatacatcgatggtgtaaagagcaaacaggtgacccaggaggcctttcagaaggcactcgggaagttcgtcgacgccgatgtggacctcaattcttgggctgcgcaaattaaacaggcaatcgattccgaacagtttatgcctaaacttagaactaaacagaacggagccataccatatcaagttcagcagaatgagctggaccagattatcaacaaccaaaaggaatactatccctggttgggcgaggaaaatcctgtgatcaaaaggcgcggcaagttcccatacaagctcgatgagctggtcgggtttcgggtgccgtactatgtaggacccttaattacaaaagagatgcaggctgccaccgcaaacgccggtttcgcttggatggttagaaaggccgacggccctatcacgccatggaattttgatgacaaagtggatagggtcgcatcagcgaccgctttcattcagcgcatgcagacaactgacacctacctgataggggaagaggtgctacccgcccgaagcctcatctatcaacggtttatggtcctgaacgaacttaataacattcgtgtggatgacggacagttgacacctagacagaagcaaaggctgtacaatcaggttttcaaaaagcacaagcgcgtgactgccaaaaacatccaggacaatctcgtagccgctggcgagtttccaaccgcaccccggatcacaggtctggcagatccgaaggtcttcaacagttctctttccacctatcatgacctgaaacaggtgttgcctgaagctatgagcgatgttagaaagcaagccgacattgagaaaataatcctctggtcgactatttttgaggattctacgatcttcaagcagaaactgacagaaatttcctggttaaccgcggcccagctgaagcagctagggcaactcaggtaccgaggctggggacagctgtcacgcaaacttttgactggcctgaaagacgataataaccggagtatcatggacgggctctgggagaccaatgctaacttcatgcagctgagaagccagcccgcaatagaaaatcaaatcaagtccgccaaccaggctaacttaacaaccgccgatctgcaggacactattaatgagctttatacatctccacaaaacaaaaaggcaatcagggaggtgatggtcgtgttggcggatattaaagacgccatgcacggacagacgcctaattggatctttgtagaagctgcccgtggtggcggggtggcaggacgccggacccagagcagatcaaagcagatagttgctgcctaccaaggcactgcacaggtcattgtgagtgatcaggtgcagagggagctcaaggaaaagatcaagaacaaagccaatttcaacacacgactggtcctatactttctgcaaaatggtcgggacctctataccggggacgctattaacatcgatcgcctgtccgagtacgacatagatcacatccttccccagagcttggttaaggacgattctctggacaatagagtgttaacaaacgcgaggattaatcgggaaaagaacgatactttcgcctcagagaagtttggcaagaaaatgggagcaaagtggaaagagatgcatcgaatgggcctcatgaccaagagaaaactggaccaccttctgatgcgcccagatgaaatcagtaagtatgctacggggttcattaataggcagttggtggagacccgtcaggtaatcaagctcgtcgaggaactgataaacgccgaataccccagcacagccattgtgtccgttaaagctaatctaactcatcaatttcggcagaccttcgactttcctaagatcagagaggtgaacgattatcaccatgcattcgacgccgcgctgacagcttttatcggaacttacctcctgaaaaggtatccaaaacttgagcgcttctttgtctacggtaaattcgccaagcagccggtgaacttgacccgattcaatgttattagaaaactggcaaagacggacacacccatcaccgatattgacactggcgaagtgttatgggataagctcacagacataaaatactttgagaccctgtatgattacaagcggcttctggtaactagggaagtctctgagaactatggggccatgttcgaccagaccctactcaaggcttcggataatggaaagcgcctgatccgtaaaaagcagagctttgacacagcaatttacggcggttatacggggaagaccttggcctacatggcgatcgtgaaagtgtccactaagaaagatgtccaatatcaggttgtgggcgtacctacaaccatggtgacacaaattgaacagctggagcagcagggaatgactaacaagcaagctgtcaccaaagtgatcgagccattaatagccgcaaataacaagaagatgctcacgtacgaagttctgcttcccaaagtgagattcgagcaggtcgtgcgggacaggatcaagggccagacacaccgctttgccctggggaccgatacttactatcacaatattcaggaattgtacctccctctgaccctacaacgagctttcctgggaaaacagaacgagtcagaggttcagcttaatcagaacctcctgacagtgtttgacgccactttggcacaagtcaatagatatttcccactgtacgaaatgaacaagtttaaaaagatcttaaatagtgctcgggatcagattgagctcctggaagccaagaaccagttcgtaaagaataaacttgtgctgggcaaacaaggtatcttgaccaacatgtttatagggctccatgcgaacgcctctttcggagacctaaagagcctgggcgttaaaacatccttcggtcagcttcaggtgcccggcgggattaaactgacgggagacgcagagatcatctatcagtcaccgaccggcctctttgaaaggaagattgctctgaaagatttgtga

SEQ ID NO: 3057 - RNA, 4077 nt, synthetic construct
  misc_feature 1..4077: note = Cas9 variant
  source 1..4077: mol_type = other RNA
atgaagcagggcaaaagagggtactatctgggactcgacatcggtaccgatagcattggctacgccgtgacagacgagcaatatcaccttctgaggttccatgggaacgatgcttggggatcccacgtctttgactctgcatcattgtgcgatgaacggcgcggcttccgaagtgcccgtagaaggttagaccggcgccagcagagagttaagctgctacaggagatatttgcgaaagaaatcgctaatattgatcccaggttctttatccggctcagcgagtcctaccgctggcgagacgatactgacgatagatatatttacttcaacgaagaggagtatacggacatccaatacatgagggattaccctaccatacatcacctgatctgtgaacttatggagaatgaagaggagcatgacattcggctggtgtatttggcctgcgcatggctcgtagcccaccgtggtcactttctgtctcagctgtcggtggacaacatcgattcactcattgacatcgaaagcgtctaccagaagttcttacatttcttcatagataatgggtgtgagaacccatggattcaggacgctgaactggtgggaggcatccttaaagagcacattggcgttacagaaaagcataatcgcttgggggagatcatgctgggaaacagaaagccgagtaaagatgtgagggacacttttctatattccgagtactgcatcattcggctcctggctggtggcacctgtaaacttcgagatctgtatgggaaagaagagtacgaagacttcggatctgtcagcttggagatggatgacgataagctcgccgaaataatgatcaatattggcgaggactatgagctgatcgctgtgttacgctccctgcacgactggtcagtactcgccgatatacttgacggtcaaaacgggctgacaaatattagtaccgcgaaagttgcaatctacgaacagcacaagaaggatttggccactctaaaatactttatcagaaagtattgccccgagaaatacaacgctattttcaaggacgccagggaagataattatgtggcatacagctatcattacaacaataaactggacggacagatcaagaaaaaggctgatacagagaccttctctaagtttctcattaaaataatccactccattaagcctgacaaagaagatgagatcatctatcaggacatggataaccggctgggccttcgccaattcctgccaaagcagagaaacacggacaatagggtcattccccatcagttgtacgagtacgaactcaaaaagatactggagaacgccgcgaagtatttatcatttctgaatcaaaaagaagatggcatcagcaacactgagaagattatcagtattttcaaatttaagatcccttactatgtggggccactaaataaacactctgagttcgcctggatagaccgtaagtccggaaagatcctcccctggaactacgaaaatatgattgacgatgacgcaagcgaggaggcttttatcaaaaagatgaccaaccagtgtacatatctgcctggtgaatcggtgcttccaaaagattctttgtgctaccagaagttcatggtcctgaatgaaattaacaatatcaaagttgacggccggaagatatccgtgggggccaagcagggaatttattcagatctctttctgaaatacaagaaagtaaagcgaagtcaaatcgaggagtaccttattagcaacggccagctggaaaagaatagaagggagactttgtccggtatcgacatacagatcaagtctagcctctcaagtcatattgctttccgccggctgttagaacagaaaatcctgaacgaggccgatgtggaaagaattatcgagagggcatcctatgccgaggacaaggggcgcgtcgctaagtggctacgagcgaaatacccgcacctcaccgaagcagatataaagtatatttgtaaagtgaagatcaaagactttggccggctgagccgtacattccttaccggaatcgagggcgcctgcaaggaaacgggggaggttgctactattatctctatgatgtgggaatcaaatgataacttgatggagctgctcagtgagagatacacatttgccgacaccattctggaatttaagagcgattattacactgagaggaaacaaacattatccgaacgcctggacgagatgtatgtgtctaacgcagtccggagacccatatacaggacccttgacatcgtgaaggatttggagaaagccttcggaaagcctgagaaaatttttatcgaaatgacgcgaggtgctatgccagaactcaagggcaagcgcaccaaatcgcggcagcagcagctgctagagtactatgacaagtgtaaagaagaggatgtaagagacctgaagcaacagctcgaggccctgggggaatacgttgataataaacttcagagcgacaggttgttcctgtattttatgcagttcggaaagtgcgcatactccggcatgcccatttcattagagcgtctcatggcgggtagtaaggaatatgatatcgaccacatataccctcaagcatatgtgaaagatgactctatcattaacaataaggtcctggtgcttagcgtcgccaacggggagaaaaaggatgtgtacccaatcaaatccgaaattcgcaataagatgcagaaaacatggtcattttggcatcacgttggcactatcagcgacgagaagtacaagcggctgataagatctacccccttcacagaggacgaaaaatatggatttattaacaggcagttgactgagacctcccaaagtacaaaggtggtagcagaactcctgaaagagcgatacccggaagccgagatcgtctatagcaaggctggcctaatctctgatttccggcatgagtttgacctgtacaaatcccgctcatataatgatctccaccacgccgtggacgcatacctgaacattgttgtggggaatgtctatcatatgagattcagtaggcagtggtttaacgtgaatagctcgtactccataaagaccaagactcttttcacgcacacagtaaactgcaatggaaaagaagtgtggaacaaggatatgttgcctggtgttctgaaaaccgctaagaaaaatactgcccattttaccaagcacgcgacattcaagaccggcgggttattcgaccagaaccccgtcaaaaaggccccaggactcactcctctgaaagctggccttcccacagagaagtacggtgggtataacaaagcaggcgtgatgtttttcatcccagtgcggtacaagtctggaaagaaaacggtcctgatggttctaagcgtggaactcctgtatggcaatcgatttttggaggatgagattttcgccaaggaatacgctaaagacagactgcagcgcatgatcgggaagtcagtggatgagattgactttcccatcggaatgaggccttggaaagtaaacaccatattaagtctcgatggcttccgtatctgtattactggtaatgcctccgggggaaagtgcctgatcgcacaaccaattatgcagttttctagcgacgaatattggaagtactatcttaaaaaggtcgagaaattcgtggaaaaggttaaaaacaattcctcatacgtgtacgatgtcgactatgacgcggtgcagcatgaggataacctgaagttgtacgacctctatctggataaactacagaatagcatctaccggaagagaataaacgccccgattcaaacactgatcgagggcagggaaaagtttatcgactgtagtgttattgagcagtgccaggtgcttctcaatatccaccaggtattcggtcgcatgacctctggctgtgatctgacattgatagggggaaaaactcgatccgctagcaccgtcaacttttcgtcaattatcctgaattggaagaaaaactatacggacgtgagaattatcgatcaatctgccagtggcttatgggaagtggtctccgagaatatactcgaatacctgtga

SEQ ID NO: 3058 - RNA, 4077 nt, synthetic construct
  misc_feature 1..4077: note = Cas9 variant
  source 1..4077: mol_type = other RNA
atgggcaagatgtactatctggggctcgacatcggaaccaacagcgtgggttacgccgtcacagatccctcctatcaccttctgaaattcaagggcgagcctatgtggggagctcatgtttttgcagccgggaatcagtctgcggaaagaaggtcattccggactagccgccgacgtttggacagaaggcaacagcgggtgaaattagtacaggagatttttgctccagtgataagcccgatcgatccccgcttctttattagactgcacgaatccgccctatggagggacgatgtcgcagagacggacaagcatatcttctttaacgatcctacctacacagacaaagaatattactctgattatccaactattcaccatctcatcgtggacctgatggagtcgtcagagaagcacgatccccggcttgtttacctggccgtggcttggttggtcgcacaccgcggccatttcctcaatgaagtggacaaggataacataggtgacgtactgagctttgacgccttctaccctgagtttctggctttcctcagtgataatggggtttccccatgggtgtgcgaatctaaagccttacaggcgaccctgcttagccgaaactccgtcaatgacaagtataaagcattgaagtcactgatctttggaagtcaaaaacccgaggataacttcgacgccaatattagcgaggatggcctaatccagctcctggctggcaagaaggtgaaagtgaacaaacttttccctcaggaatctaatgacgcctcctttacactgaacgataaagaggacgcaattgaagagatcttggggaccctcactccagatgaatgtgagtggatagctcacattagaaggctgttcgactgggccatcatgaagcatgcgttaaaagatggacggacaatttcagagagcaaggtcaaactgtacgaacagcaccaccatgacctcacccaacttaagtattttgttaagacgtacctggccaaagagtatgacgatatcttccgtaatgtggacagtgaaactaccaagaactacgtagcatattcttaccacgtgaaagaggtcaagggtacattgccgaaaaataaggctactcaggaagagttttgcaagtacgtgctaggcaaagttaagaacatcgagtgttccgaagccgataaagtggacttcgatgagatgattcagcgcctgaccgacaacagctttatgcccaagcaggtctcgggggaaaatagagtgataccttatcaactctactattacgagctgaaaacaatccttaacaaggctgcctcttatctgccattcttgacccagtgcggaaaggatgcaatttccaatcaggacaaactcctgtcaatcatgacgtttaggataccctacttcgtaggccctttacggaaggataacagtgaacatgcctggctggagcgaaaagctggtaagatttatccatggaattttaacgacaaagttgatctagacaagagcgaggaagcgttcatccgcagaatgactaatacatgtacctactaccccggggaggatgtgctcccgctggactcccttatctatgaaaagtttatgattttgaacgagatcaataacattaggatagacggataccctatctctgtcgatgtgaaacaacaggtcttcggcctgttcgagaagaaacggcgcgtgactgttaaggacattcagaatctcctgcttagcctgggcgcattggataaacacgggaagctcacaggaatcgacaccacgatccattcaaactataatacctaccaccactttaaaagtctgatggaaagaggtgtgttaacaagggatgacgtagagcgtattgtcgaacggatgacttattccgatgacaccaagcgagtgagactgtggctaaacaataactacggcacactcactgccgatgacgttaagcatataagcaggctgcgcaaacacgatttcgggcggctttctaagatgtttttgaccggactgaaaggcgtgcataaggagacaggtgaaagagcttcaatcctcgacttcatgtggaacaccaatgataacctgatgcagttactgagtgagtgctatacttttagcgacgagattacgaaacttcaagaagcctactacgcaaaggcccagttgtccctcaatgacttcctggattctatgtatatctcgaacgctgtcaagaggcccatttaccgcacactagccgtggtaaatgacatccgaaaagcatgtgggaccgcgccaaagcggatatttatcgagatggctcgtgatggcgaaagcaaaaagaaaagatccgtgactaggcgcgagcagattaagaacctgtatcggtcaatcagaaaggacttccagcaagaagttgattttctcgagaaaattctggagaataagagtgacggacagcttcagtctgatgccttgtacctgtatttcgcacagttaggcagggacatgtacaccggggatcctatcaaactcgaacacataaaggaccaaagtttttataacattgatcacatctacccccagtccatggtcaaagacgactcactggataataaggtgcttgtgcagagcgagattaacggagaaaagtcttcccgatacccactggacgccgctatccgcaataaaatgaagcccttgtgggatgcctattacaaccatggtctcataagtctgaaaaagtatcagcggctaacaagaagcacccctttcactgacgatgagaaatgggactttatcaataggcaactggtcgaaacacgtcagtctacgaaggcactcgctattctgcttaaacgcaagttcccagataccgagatcgtttactccaaggccggcttgtcaagtgacttccggcacgagtttgggctggtgaaaagcagaaacattaatgatttacatcacgcgaaggacgccttcctcgctatcgtgactggaaacgtatatcatgaaaggtttaaccgacggtggttcatggtcaatcagccgtactcggtgaaaacaaagaccctgtttacacactccataaagaacggcaatttcgttgcatggaacggtgaggaagatcttgggcgcattgtgaagatgctgaagcaaaataaaaacactatccactttaccagattctcttttgacaggaaggagggcctattcgatatccagcccctcaaagccagcacgggactggtccctcggaaggctggcttggacgtggttaaatatgggggatacgacaagtcaaccgccgcatactatctgttagtgcgatttacactcgaggataagaaaactcagcataagctgatgatgattccagtagaaggtctttacaaagcgagaatcgaccacgataaggagttcctgaccgactatgcccagacaactattagtgaaatattgcaaaaagataagcagaaggtcatcaatattatgttccccatgggcacccgccatatcaaactcaactccatgatttctatcgacgggttttacctgagcataggaggcaagtcctcaaaaggtaagagcgtgctatgccacgctatggtgcctctgatcgtcccacataaaattgagtgttatatcaaggccatggaaagtttcgcaaggaagtttaaagagaataacaaacttcgtattgttgagaagttcgataagatcacggtggaagacaatctcaacctgtacgagttgtttctgcagaaattacagcacaatccctataacaagttcttttctacacaattcgatgtactcaccaatgggcggtccacttttacaaaactgagcccggaagaacaggtgcagacccttctgaacatattgtcgattttcaagacttgcagatcatctggctgtgacctcaagagtatcaacggatccgctcaggccgcaaggatcatgattagcgccgatctgaccggcctatctaaaaagtacagcgacatacgcctggtcgagcaatccgcttcagggctttttgtgagtaaaagccagaatctcctggagtacttgtga

SEQ ID NO: 3059 - RNA, 4083 nt, synthetic construct
  misc_feature 1..4083: note = Cas9 variant
  source 1..4083: mol_type = other RNA
atgaccaagctgggcaaaccctacgggatcggagtggacattggtagcaactccataggcttcgccgctgtcgatgaaaattctcacctcatcagacttaaggggaaaacagttattggagcaaggctgtttgaagagggcaaggccgcggctgaccggcgcgcctcacgaactacgcgtagaaggttgagtcggaaccgctggagactgagcttcctgagggactttttcgaatcccatatcacccctacagatccaaactttttcatgcggcagaaatattctgagatttcgccgaaggataaggcacgctacaaatatgaaaagcgactatttaatgacagaactgatgccgagttctaccaacagtatcccaccatgtaccacctcaggacacggctgcttaccgacccttcaaaagctgatgtgcgtgagatctattttgcaatacatcacatcttaaagagccgcggtcatttcttgacaagtgggtacgccaaagactttaatactaacaaggtagctctcaatgaaattttcccagccctgcaggatgcgtacgcacaggtgtatcccgacctggatatcacctttgacgagaacaaggtcaatgagttcaaaacggtgctcttagacgagaaggccactccttccgatacccaaagagctctggttaaccttttgctggccgaggacggagataaagacattctaaagcagcagaaacaggtgctcacagagttcgcaaaggctgtcgtgggcctgaaaactaaacttaatgtagccctgggcaccgaagttgattctagcgaagcgacagcctggaacttttccttggggcaactcgacgataagtgggcaggaatcgagtcagctatgaccgacgaaggtacggagatactggatcagattagggacttataccgggcccgactgctcaatggcatcgtgccagctgggaaaactcttagtcaggccaaggtcgatgactatgagcagcaccacgaagacctggagttgttcaaagattacctaaagcaactggaagacgatggaatggcaaaagccattcgccagctctatgacagatacatcgatggcgacgatgctaagccctttgtgagggaggacttcgtgaaggcgctgacaaaagaagtcaccgcacatcctaacgccaagagcccagagcttctggagcggttggttcagccggattttatgctcaaacaacgcaataaggctaacggtgccatccccgtgcagatgcagcagagagaactggaccaaattataaagaaccagtctgtatattacgattggttagcagcccctaatccagtggagaagcacaggcagtccatgccctaccagttcgacgaactgctaaactttcgtatcccttattacgtcgggccactcgtgactgctaaggagcaaaaagccgcacagggaggcgttttcgcgtggatggtgcggaaggatcccgacggcaatattacaccgtataactttgacgaaaaagtcgatcgagaggcttcagccaataccttcatccagagaatgaagacgaccgacacatacctgataggggaggatgtgcttcctaaacagagcttgctgtatcaaagttacgaagtactcaacgagctgaataacgttagggtgaatgacaacaaactttcttttgatcagaagcagcaggtcctgggagaattgttcgagcgccataatactgtgaccattaaacaatttgtcgacaacctcctggcacacggtgattatgaccggatccccgaggtgagaggcttagccgatgaaaagaggttcctgtccagcctatcgacatacaatcagctcaaagggatcctgcacgaggctattgacgattctgacaagcagactgatatcgaaaagattatagcctggtccaccatcttcgaggacaaggcaatttttaaaacaaaacttaacgaaatctcatggttgaatgctggaatgatcaacagtctggccaacattcgctaccgaggctggggtcaattcagccataagctcctgaatgagttaaccctgtccactgggcggacggtttttgaggaacttttgatatctagccacaacctcatgcagatcctgacagacgaggtgctaaaacagaagattgcggaactgaatgcccatgagctcaaggcttcaggcatctatgcagccattgatgacgcttacaccagtccatccaacaagaaagccctgcgtcaggtacttagcgtcatcgatgacataactaatgcagcgggacaagcccctaactggttgtatatcgaaaccgctgatggcgacggggtgcccggaaagagaacaaattctaggcagcgcaagattcaggagatctacgttaacgccgcacaggagctgattaccggttcagtgcggggcgaattagaggataaaatcgctagtagagccgacttcactgataggctcgtcctgtattttatgcaagggggacgagacatatacacaggcgaaccacttaatattgataacctgagctcctatgacatcgaccacattttgccccagtctctcatcaaggataattcgctggacaaccgcgtgctagtacatcctctggtgaatcgggagaaagatacgatattcgcaagcaccagatttgccaagcagatgaacggtatgtggaggcagtggcacgctgcggggctcatctcctcacgtaaactgcgcaatcttcaaatgcggccagacgaaattgataagtacgccagtggcttcgttgcaagacagttggtcgagactaggcagatcattaagctgacagagcaaatcgtggctgaccagtacccggatgccaaaataattgccgtgaaggctggattatctagccagctccgaaaagaactggactttcccaagaaccgggaggtcaaccactatcatcacgcattcgatgcctttcttgcggctcgcatcggcacctacctgctaaaaagatatcctaatctcgaaccattctttacatacgggaagttcaagaaaactgaggttaagaaactgaagtccttcaactttatcagggacatgacccatgccaaagataagattgtggcaaaagagacgggagaaatcgtgtgggacaatgcctcagatattaacgagttggaccggatatataatttcaagcgaatgctgatcacccacgaagtaagatttgagacagctagcttattcaagcagactctctacgcagccaaaaactctaagaatcgcggtggctccaggcaactgattcccaaaaagaaagggtatcttgtcgacatctacggaggctacacccaggaaacaggtagttatctgagcgtggttcgtttgactaagaaggcgatgtacgctgtggtcaaagtgtctacccgggatgccgcaaagctcgccgttgctaaatccatttcagagcagaaggagaacgaaacgctgaaaaagatcatagacgggaagctaagtaaaacaagcaagaaaggcaagaccactcaccagctgtttgagatcgtgcttcctagagtaggacagaaaacactcttcaaaaattcgaagtataaccaatttctggtcaattccgatacctacatgcataactatcaggaattgtggatgccaagggagtaccagcgcatgtggaaagacattctgttatctaatcacggcgatgcccaactcgaagggcagctggaccagatcttcaagtttattgtgagccaggtgaactcatatttcaatctttacgatatcaaccaatttcgaaagaagatagcagacgctactgataaattcgccaagctgcccacccatgacacagataacgcgagaggaaagattgccacgatcggccagttgctcatcggtctgcaggcaaatgctatgcggagtgacctaaggaacctggatattaaaaccccgttcgggcttctccaaataggaactggcatcacactggacttggacacctccattatctaccagtctcctacaggtttatttgagcgcgaggtcccactgactgatctctga

SEQ ID NO: 3060 - RNA, 4083 nt, synthetic construct
  misc_feature 1..4083: note = Cas9 variant
  source 1..4083: mol_type = other RNA
atgaccaagctgaaccagccctacggcatcgggctcgacattggaagctcctctataggtttcgccgtggtcgatgctaattcacaccttctgagattgaaaggcgagacagcaatcggggccaggttatttcgggaaggagagagtgcggctggccgccgagccagccgtactacgagaaggcggctgtcccataaccgctggagactaaggttcctccaagactttttcgatcctcacatttcttcgatcgacccagatttcttcctgcggcagaagtattcagaaattagcccgaaagacaaggagcgctttaaatacgaaaagcgacttttcaatgatagaaccgacgcacagttttataagcagtaccccacaatgtatcatctgaggttgcacctcatgaacgatgccagtaaagctgaccctcgggagatcttctttgcaatacatcacatcctgaagtcccgtggtcacttcctgactccaggggatgccaaaaattttaacaccgacgatgttgacctcaagcatattttccccgctttaacagaggcctacgcgcaagcatatcctgacctgaccctttctttcgaaccaagcaaagccgagaagtttaagtccatcttgctggatgaagacgctacttcaaatgatacacagaaagccctagtgaagctcctgcttagtgacgatggagacaaagaggtactgaagcagcagaaaaaggtgttgaccgagttcgcaaaagctgtcgccggcctcaaggtgaagtttaacgttgcgctgggcattgaagtgacggatgccgacgtcgagaaatggcacttcgggatggcacaattagaagataagtggagcgacatcgagccctctctgactgatcagggaatggaaatatttgagcagattcaggacctctaccgcgctagacttctgaatggtatcgtgcctgccggcaaaaccttgtcccaagctaaggtagacgattacgaccagcattgcaaagatctaaagctgttcaaggagtatctcaaacagctgaacgaccacgatcttgccaagaggattcggctgttgtacgaccgatatatcgatggggacgatgcaaaaccatttctccgcgacgatttcgttaaggccctgaaaaaggaagtgacagctcacccgactgagttagcggaatcactgctagagagaatggaacaagacaattttatgctcaagcagaggaccaaagcaaacggaagcatccccgtccagatgcagcaacgggagctggataagattatagccaatcaggctgagtactatagttggcttgccgcagaaaaccctgtgaaagagcatcgcgactctaagccataccagttggacgaactgctcaatttcagaatcccctattacgtgggccctatgattaccaaaaagcagcaagagaagtccggtcagaacgtctttgcctggatggttaggaaagatccaagcgggaacatcacaccctacaatttcgacgaaaaggtggatcgtgaggcttcggccaacgcatttatacagcggatgaaaacgactgacacatatctgattggagaggatgtacttccgaagcagtctctgttgtaccaaaaatatgaagtgctcaatgagctgaacaatgtccgagtgaacggcgaatccttatcaaccgaccagaagaaaagactgatcagggagctattcgagcgccacagtagcgttactctcaagcagttcgtggaaaatctggtcgcgcatggcgatgtggctaagcggcctgacgtaagagggcttgccgatgagaaaaggtttttgtcctctctgagcacataccaccagctccgcggaatcctgcatgacgcaattgatgaccgaggtaagcaatcagatatcgaaaacattataacctggagtacggttttcgaggacgcctccatctttaaaagcaagttaggcgaaatttcttggctggactcaaaaacccggacaactcttagtaatatccgttatagagggtggggacagttcagcaggaagttgctcgatggcctgaagctaggtaacgggcacaccatcattcaggagctgatgctctcctctcgcaatctgatgcaaatacttacagacgagactttgaaaaaggaaatggctaccctgaaccaggagcggttaaaacccgattcgatcaatgaagccattgacgcagcttacacaagcccatccaacaagaaagccatcagacaggtgctcaaggtcgtggatgacattaagcacgcggccaatgatcaggctccttcatggctgtatatcgagaccgcagacggcggaggccatcccgggaaaaggactcttagtcgacaaaagcagatacaggccatctacgaaaacacggctaaagagctgattgattctgccgtccgcggagagttgaaggacaaaatcgcagataagacaaactttagcgaccggctcgtgctgtacttcatgcagggtggccacgacatttataccgggactgcgctaaatatcgatcaactgtcctcatacgacatagatcatattctcccacagagcctgatcaaggacgattctcttgacaacagagttttggtgcacgccaaaattaatagggaaaagaacgctgagtttgcctccaccctgttcgcagctaaaatggccagtacatggcaccgttggcgcgatgcaggattaatcagcggccggaagctcaaaaatctgcttatgagacccgacgaagtagataagtatgccaaaggttttgtcgctaggcagctggtggagacccgacagataatcaagctaactgaacaaattgttgcggcccagtaccctgacacaaagatcattgcagtgaaagctgggctctctcatcagctgcggcaagagttggatttcccaaagaaccgcgacgtcaatcactatcatcacgcctttgatgccttcctggctgcaagaatcggcacgtacttactcaaaaggtatccgaacctggccccctttttcacctacggagagttcactaagacaaatcttaaaaagctgcagtcctttaacttcataggcgcgttgacccatacagacgggaagattacttcaaaagacaccggagaagtgctctgggataatcagcgggacatcgaggaactggatcagatctacaactttaagcgaatgctaattacgcacgaggtatatttcgagaccgctggtctgtttaaacaaacagtgtacgccgcaaaggacagtaaagaaagaggcgggagccgccagcttatccctaagaagaaaggatattcgactggcatttacggtgggtatacccaggagacaggctcctacaatgccctcgttaggctgactaaggctggaaaagtcgtgtatcgtgtgttcaagatatctacccagaacgcagccgaaatcgcggctgcccggagcttgtcagcagaggaaggcaatgagagactgtgtcaaattttagagcagagtctcctgaaaacgaacaaggataagaaaaacacagtcgacctttttgatgttgtgatcccaaggctggggaaggaagccttgttccacaattccaaatacggactctttctggtgaactctgacacctactatcataattaccaggagctatggctgagccgcgaaaaccagaagattcttaaaaagctcttttccactaagtatgatcaatcagagatggaccgagatgctctgcacttgtttgaaacaatcgccaaacaggtagagcagttcttcaagttatacgacataaatcagtttagaaccaaaatcagcagtgcattcgatgcttttgagaagctgcccgtcgaaggcgaggaaggtaaagtggagactctcaagcaactgcttattgggctgcatgccaaccctgttcggtctgacttgaaaaatctaggaatcaagaccccattcggctttctgcaggcgggtaagggcattcacctcgacgatgacacagaaatcatacagcaatcccccgccgggctgttcaaaaggcgcgtgcgtcttgcagatttatga

SEQ ID NO: 3061 - RNA, 4086 nt, synthetic construct
  misc_feature 1..4086: note = Cas9 variant
  source 1..4086: mol_type = other RNA
atgaccaagctgggcaaaccctacgggatcggagtggacattggtagcaactccataggcttcgccgctgtcgatgaaaattctcacctcatcagacttaaggggaaaacagttattggagcaaggctgtttgaagagggcaaggccgcggctgaccggcgcgcctcacgaactacgcgtagaaggttgagtcggaaccgctggagactgagcttcctgagggactttttcgaatcccatatcacccctacaggtccaaactttttcatgcggcagaaatattctgagatttcgccgaaggataaggcacgctacaaatatgaaaagcgactatttaatgatagaactgacgccgagttctaccaacagtatcccaccatgtaccacctcaggaatcggctgcttacagatccttcaaaagctgacgtgcgtgagatctattttgcaatacatcacatcttaaagagccgcgggcatttcttgaccagtggatacgccaaagattttaacactaataaggtagctctcaacgaaattttcccagccctgcaggacgcgtacgcacaggtgtatcccgatctggacatcacatttgatgagaataaggtcaacgagttcaaaaccgtgctcttaaatgagaaggccacgccttccgacactcaaagagctctggttaaccttttgctggccgaggacggcgataaagacattctaaagcagcagaaacaggtgctcaccgagttcgcaaaggctgtcgtgggcctgaaaacaaaacttaatgtagccctggggactgaggttgattctagcgaagcgaccgtgtggaacttttccttgggacaactcgacgataagtgggccggtatcgagtcagcaatgacagacgaaggcaccgagatactggatcagattagggacttataccgggctcgactgctcaatgggatcgtcccagccggaaaaacgcttagtcaggctaaggtggatgactatgcccagcaccacgaggatctggaattgttcaaagactacctaaagcaactggaggacgatggcactgcaaaagccattcgccagctctatgacagatacatcgatggtgacgatgctaagccctttgtgagggaagacttcgtcaaggcgctgacaaaagaggttaccgcacatcctaacgccaagagcccagaacttctggagcggttggctcagccggattttatgctcaaacaacgcaacaaggccaatggggcaatccccgtgcagatgcagcagagagagctggaccaaattataaagaaccagtctgtatattacgattggttagccgctcctaatccagtggaaaagcacaggaagtccatgccctaccagctggacgagctactcaacttccgtatcccttattacgtcggaccactggtgactgccaaagaacagaaggcagcgcaaggcggcgtttttgcttggatggtgcggaaagatcccgacgggaatattacaccgtataacttcgatgagaaggtcgaccgagaagcctcagcaaatacctttatccagagaatgaaaacgaccgacacataccttataggagaggatgtgttgcctaagcagagcctgctctatcagaggtacgaggtactgaacgaacttaataacgttcgcgtgaataacgagaagctgagtattgaacaaaaacagcaggtcatccgggagttgttcgagagacataattctgtgactatcaagcagtttgccgaaaacctcagggctcacggtgactatgcccacattcccgagatccgcggcctggcagatgaaaaacgattcttatccagcctgtcgacctaccggcaactaaagtctctcctgccagacgctattgatgaccctgccaaacaggcggatatagagaatatcattgcctggtccacagtctttgaagacgctgcaatcttcaagactaaacttaaggagatcaactggttggattcacagaccattacaaagctgagtaacatacgttacagagggtggggacaattcagccataaatttctcaatggcctgaccttaggtaacgggcacactatcattcaggagctgttcctttccaataacaatttgatgcagatcctcacggacgaaacactgcagaagaaaatgaccgagctaaacgccgataagctgaaagctgccaatattaacgacgcaatcgatgacgcgtatacttctcccagcaataagaaggccctcaggcaagtgctgcgcgttatagaagacatcaaacgggctgccgatggccaggacccatcatggctttacgtggagaccgcagatggaggcgggacacccggaaagagaaccagggctcgacagcatcagttgcaagaaatttatgccaacgcagcccacgagctgatcgacagtgctgtacgcggtgagttagaagataaaattgcggacaaggccgattttaatgaccggctcgtcctgtacttcatgcagggcgggagagatatctatactggaacacctcttaacatagaccagctgtccagctacgatattgaccatatcttgccacagtctctcattaaagacaattcactggataacagggtgctagttcacgcaatcataaatcgtgagaagaacgctacgtttgccagtaccatctatgcccaaaagatgaacgctacttggcgccagtggcacgaagcaggcctgattagcggtcggaaactcagaaatctgcagatgaggccggaccaaatcgataagtacgcctccgggttcgtggcgcgacagcttgtcgagacacggcagattatcaaattgaccgaacagatagtggctgcccaataccccgagacaaagattatcgcagtaaaagccggcctgtctcatcagttacgcgaggaactcgagtttcctaagaacagagacgtgaatcactatcatcacgctttcgatgcatttctggccgcgaggatcggaacttaccttctgaagcggttcccaaacctacaggcctttttcacctatggcaaatttaagaaagctgacgttaagaaactccgagggttcaatttcattagagatatcacgcacgcagaagacaagattgtcgtgaaagataccggagaggtgatatgggacaagaagcgcgatgtcgacgagctggataggatctacaactttaaacgtatgttgattacacatgaagttcacttcgagaaggccgacctgtttaaacagactgtgtatggtgctaaggactcgaaagaagccggcgggaagaagcaattaatcagcaaaaagaaaggataccccgtggatatttatggcggttacacccaggagacagggtcctacctctcagtagtccggctgactaagaaagcaatgtatgctgtggttaaggtgagtaccagagacgccgcgaaacttgccgtcgcaaaatctatcagcgaacagaaggagaatgagacgctgaacgatataatcgacgaaaaattgtccaagatttcaaagaatggcaagatcacacatgaactcttcgaagtggttctgcctagggtgggacagaagaccctatttaaaaacagcaagtacaatctgttccttgtaaactctgatacttatatgcacaattaccaagagctctggatgccacgcgaatatcagaaaatgtggaaggacatttccctgagtaaatacggcgatgctcagacagaggaccagttggatcaaatctttgggttcatagtcagccaggtgaactcttattttaatctgtacgacattaaccagttccgaaagaagttaaacgatgccgctgacaaatttgcaaccctccccatgagagatactgacgacatgcaaggaaagatcgccaccatcggccagctgcttattggtctgcaggccaatgctgcgcggtccgatttgaggaacctcgacataaaaacaccgctggggctactgcagatccctaatggaatttcacttgatagtgacacgagcgtggtctaccaatcgccaaccggcctcctggagcgcgaagttcatttgtccgatttatga

SEQ ID NO: 3062 - RNA, 4086 nt, synthetic construct
  misc_feature 1..4086: note = Cas9 variant
  source 1..4086: mol_type = other RNA
atgaagaaaccctacagcatcggcctggacattgggaccaactccgtgggatggtctgtcgttacagatgactataaggtgcctgccaaaaagatgaaagtactcggtaatactgataaggagtacataaagaaaaaccttatcggcgctctgttgttcgactcaggggaaacggcagaggccaccagaatgaagaggacagcgcggcgccgatatactcgtagaaggaatcggattttatacctgcaggatatctttagtccagaactaaaccaagtggacgagagcttcctccaccgcctggatgactcctttcttgtcgctgaagataaaagaggagagaggcatgtgattttcggcaatatcgccgacgaggttaagtatcacaaagaatttccgaccatataccatctgcggaagcacttggcagattcttcggagaaggccgacctccgcctggtgtatctggctctcgcacatatcattaaataccgaggtcacttcttaatcgatgaacccattgacatcagaaacatgaactcacagaatctgtttaaggagttccttttggcctttgacgggatacaggtcgattgctacctggctagcaaacacacagacattagtggaatcattaccgccaagatctccaaatctaggaaggtggaggcggtactagaacagttccctgatcaaaagaagaatagctttttcggcaacatggtttccctcgtgtttggcctgatgccaaatttcaagtcaaacttcgagcttgacgaagatgcaaaactgcagtttagtcgggacagctatgatgaggacttggaaaatctcctggggatcattggagatgagtacgccgacgtcttcgtggctgccaagaaagtgtatgattctatattactgtccggtatcctcactacaaacaatcattcaaccaaggcaccccttagcgctagtatgattgaccgttacgacgagcacaactctgataaaaagctgttgcgcgactttatcagaacgaacataggcaaggaagtcttcaaagaggtgttttatgatacttccaagaatgggtacgccggatatattgacggcaaaaccaaccaggaagatttctacaagtacctaaagaatctgctccagaaggttgacggtggggattattttatcgagaagatcgaaagggaggacttcctgcggaaacaacgaacatttgataacggaagcattcctcatcaggtacaccttgacgagatgaaggcgatcctgcgcagacagggcgagttctacccatttttgaaagaaaatgccgaaaagattcagcaaatactcactttcaaaatcccctattacgtgggccctctggcaagggggaactcgcggtttgcttgggcctcttataattccaacgagaagatgaccccatggaatttcgataacgtcattgacaagacatcaagtgctcaggccttcatcgaacgcatgaccaataacgatttatacctgccggaccagaaagtgctacccaagcacagcctcctgtatcaaaaatttgcagtttacaatgagcttacgaagatcaaatacgtgactgagacaggagaagccagattgttcgacgtctttctgaagaaagagattttcgatggtctctttaagaaggaaaggaaagtgaccaagaaaaagatactgaacttccttgacaaaaattttgatgagttccgtatcactgacattcagggcctggataacgagacagggaactttaatgcttcctatggaacctaccatgacttgctcaagatcattggcgataaggagttcatggactctagcgataacgtagacgttctggaagatatcgtgttatcactgacgctatttgaagaccgggagatgataaaacagcgactcctgaagtatgaagatatcttcagtaaaaaggtcattgcgaatcttaccagaaggcactacacaggttgggggcgcttgtccgcaaaactgatcaacggcattaaggacaagcatagccggaaaactatcctcgactatctgatagatgacggacactctaatagaaactttatgcagttaattaatgatgacaacctgtcattcaaggatgagatcgccaatagtcaagtgattggcgacggggatgaccttcatcaggtcgtgcaggagttggctggaagccctgccatcaaaaagggtatactccagtccctgaaaatcgttgatgagctagtgaaggtaatgggctacaacccagaacaaattgtcgtggaaatggcaagggagaatcagaccacagcccgcgggcgaaacaattctcagcagcggctgggatcgctcactaaggctatccaagacttcggcagcgatattctgaaacgttatcccgttgaaaacaatcagcttcagaacgaccagttgtacctgtactatttacaaaacggtaaggacatgtacaccggggatacactcgacatccacaatctgtcccagtatgatatagaccacattatccctcagtcatttatcaaagataacagtcttgacaatagagtgctgaccaactctaagagcaataggggcaaatccgataacgtcccatcaaatgaggtggtaaagcgcatgaaaggattctggttgaagcaactcgacgccaagctgattagccagcggaaatttgataacctaactaaggcagagagaggcgggctgtctgcggaagacaaagctggattcatcaagaggcagctcgtggagacgcgacagattacaaaacatgttgcccgcatactggatgaacggtttaatagagacttcgataagaacgacaagaggatccgtaatgtcaaaattgtgacccttaagtccaacttggtgagtaattttcgcaaagagttcggtttttacaaggtccgggaaatcaacaatttccaccatgcacacgacgcctatctgaacgctgttgtggccaaagcattactcattagataccccaagctggagccggagtttgtgtatggcgaataccctaagtacaacagctatagggagcgaaaatctgctactgaaaagatgttcttctactccaatatcatgaacatgtttaaaaccacaataaaacttgccgatgggcgggtagtcgagaaacccgtgatcgaggcgaatgaagagaccggagaaattgcctgggacaagactaagcacttcgctaacgttaaaaaggtgctgtcatatccacaagtcagtatcgtgaaaaaggttgaggaacagacaggcggttttagcaaagagtcgattctacctaaagggggctccgataagctcatcgcacgcaaaacgaagaataactacctgtctacccagaaatatggaggcttcgacagccccactgtggcctactcaataatgtttgtagctgatattgagaaggggaaaagtaagagattgaaaacagtcaaggaaatgatcggaatcaccattatggagaggtcccggttcgaatctaatagcgtgacatttctggaggaaaagggctatcgaaacataagagagaatactatcattaaattcccaaagtactccttatttgagctcgaaaacggtcgcaggcgtctgcttgcctcagcaatcgagctgcagaaagggaatgaaatgttcttgccccaacagtttgtgaacctcctgtaccatgcgcagcacgccaataaggaggacagcgtcatttatctagaaaaacatcggcacgagctgagtgagcttttccatcacatcataggagtttctgaaaagaccatcctcaagcctaaagtggagatgacgctgaacgaggcttttgaaaagcacttcgagttcgatgaagtatccgagttggcccagagctttatttcgctgttaaaattcaccgcatttggcgctccaggtggcttcaagtttctcgacgccgatatcaaacaatcaaatctgagataccagacagtgactgaagtcctttctagtaccctgattcatcagtccgtgacagggttgtatgagactaggatcgacctcagcaagctgggaggcgaatga

SEQ ID NO: 3063 - RNA, 4086 nt, synthetic construct
  misc_feature 1..4086: note = Cas9 variant
  source 1..4086: mol_type = other RNA
atgggcaactactatctggggctcgacatcggaaccaatagcgtgggttgggccgtcacagatgagaactacaatattgaaagattcaagaaaaagaacatgtggggcataaggctttttgacgaggctaaaactgcagaatcccggcgcatccaccgacaggcccgtagaatgaggcaacggaagattcagcgcctgaatttgttaatggagctgttcgatgttgaaatctctaaagtggacgagtcatttttcattagaaagaaggagagtgatctacattatgaagacaaaagccaggattccaggtacgcgctctttaacgacaaggagttcaatgataaagactatcacaacaagtaccccacgatctttcatctgataatggatcttatcgaaaatgacgagaaaaaggatattcggctgttgtatctcgcttgccactacctgatcaagaaccgcgggcatttcatttttgagggacagaaattcgacgtaaattcttcgctgaacaataacatcaataagctcaaatcacacttagaccaattttacaacatatgtctggatttcgacaacgataaacttattgaaatcttggtgaatcagaacctgaatattagcgagaaaagtaagaaaatcaaggaactactccgaaagaccaacctggaggtcggcatcgccaatcttattgccggtgggtccataaaactgtctaacatgtttgacgatgacgaattgaagaatctcgattataacagcctgtccttcaaaaattcaaacttcgacgagggaagagagttatttgaagaggtgctggaagataggttcgagctcgttgaaatccttaaggacattcacgatgcaagtgtgctggagacaatgttgagctctgcttccatctcacctgacggcggcaaatacataagcagttctatgattaattcctataacaagcataagcgggacctaaaactgctcaagaaaatcatcaagaaatacaaaaagagcgagtatgataatatttttcgtgacgaaaacatcaaaaataactacctgtcgtatactcgcaccgggattaacaagaataaaaaggtccaggcagaggataacacagactctgatggattctacaaatacatagtgaagatccttaaggacattaaagaaaatgattccgacgaggatatcaagtatatcctgtcagaaattgacaaaaagaactttgtaccaaaacagagaaccaaggagaatagtgttataccgtaccaattgagggagatcgaactccggaaaattatcgataaccagagcaagtatcacaagttcctgaatgaggtggacgaaaaaggtatttccgtcaaggagaaaatcatatctttactgacttttcgaatcccctactatattggccctctaaacccaagctacaatgaggaaaagaacttcacaacctcatgggtgaaacgcctcgccaaggggaaggtgacgccctggaattttgaggatatggtcgacatcgacgctagtagagaagccttcattgagaacaaactgaataagtgctcctttcttttggatgaaactgttctgcctaaagacagcctcctgtatcaggagtacatggtgcttaacgagctgaataacttgaagatcaacggacagtctataaataccgatctcaaaaagtcaatttacgaagaactgttcaagaaatataagaaagtaacaaggaagcggttaatcagttacattaaagaaaaggagaacatgagcggcgacatcgtgataactggtatcgatggggactttaagcaaggactgaaatcctatattgcgttcaaggatatcattggcgaaaagatcgacgatgacatataccgcaaggaggtcgagaaaattatcagagatatctctctatatggcgacgataagtcgttcattcagaaaaagatcaagaatgaaaacaaactcgacctgagcgacgatcagatttccaagatagcaaaacttaagtttaaagactgggggaggttctcaaagaagttgctggtgggaatcaaagccagtgataagaataccggtgagattgacaacatcattggctttatgcgtaattacaactataatatcatgcaactcatggctaacgttttcacatttaaagatgaaatagagaagctgaatagtaaatactacaccgacgaaaagatcaacattgattatttagacgatctgtaccttagctccccagccaagcggatgttgtggcagtcattccagatcgtggacgagattaaaaatatcaagaacagcgatcccaaaaagatatttattgagatggcacgatctaaagaagacaagcctacgagaaagatgtccaggaaaagtcgcctcgagaagctgtatactgacagcaaaaagcagttcatcaaactatttgggccagatgaatacgacaagctgaataacgagatcaagaacaaatctgagtccgatttccggtgggacaatctctatctgtactatacacaatttggaagatgtatgtactcacttgatccgattgacttggaggagctgagtaacaagaatttatacgatcaggaccatatatatcccaaaagcaagatctacgatgactcgattgaaaacagggtcctcgtgaaaaagcagctgaatcttgataaatccaacgagtatcctatcccagaccgcgtactgaataaggataagaacaaattgctcgctttctggaagatgctgaatgaaaaagagctaattggcgacaagaaatacgcccgactgatccggaagtctccctttaccgacgaggaactcggtgatttcatagcgcgtcagctggttgagactagacaagccacaaaggaaaccgcaaacatgcttaaaaggttgtgccctgacagcaagatcgtgtatgtcaaagctaagaatgtgtcagatttccgccggaaatttgacattctgaagtgtagaagtatcaacgatttacaccacgcccatgacgcttacctcaatattgtcgtggggaacgttttcgatacgaagtttacctccaatccactgaacttcatcaaaaataactctaagaacaggagctataatcttgagaaaatatacgactacgatgtgattcgaaacgaaaagatcgcctggctggcagagcgcaaagaggaaaatcaggacggctccatcgccacagtactaaagaacctctcaaagaatgatattcgggtcactagaaggacctatatcaaatgcgaggacctgtttgatgaaaacatagtgcgtaagggaaatggcaaattccccattaaggagaacaataacaaaagcgacacaaataagtacgggggatatagtggtatcaaaaacgcttactttgttttgctggaagacgagaagcacaatcgcattttagaggcgatcccgtctttcatatataagaaagaaaagaacggcgagaaagggtccgtgattaattacctccagaacatcctgggaatcaagagcgcaaaaattcttcgggataagatcaagattggctcgctgttgaaaatagacaagtttccttataacctcgccggtaaatcagggaatggcatcctgatttctggaggcgtccagctaatcctggataagaacacttctaaatacatcaagaagattgaaaattacaaatataaacttgacgagaacaaggattaccaaataaatatcttcgacaagctctccaaagaggaaaacattaagctgtttgatttgttcgtggacaagttcgagaatagcatctataaaaacagagtaaatattaagctgaaagaaatcaagttagctaggcccaaatttgagcatctctctatagaggaacagatcaagaccctgacacagatgcttattctgttcgggcgagagaacaatgccgtgaacttggaatacatcggactcccaaagaataccggtaagactaagattaacaaaaagatcaataacaaagatataaagattatcaaccagagcattacgggcctgtatgagacagaagaggacctagcaaatatctga

SEQ ID NO: 3064 - RNA, 4086 nt, synthetic construct
  misc_feature 1..4086: note = Cas9 variant
  source 1..4086: mol_type = other RNA
atgaccaagctgaaccagccctacggcatcgggctcgacattggaagcaattccataggtttcgccgtggtcgatgctaactctcaccttctgagattgaaaggcgagacagcaatcggggccaggttatttcgggaaggacaatcagcggctgagcgccgagaaagtcgtactacgagaaggcggctgagccgcaccagatggaggctatccttcctccgggactttttcgcccctcatattacaaagatcgatccagactttttcctgcgccagaaatattctgagatttcgccgaaggataaagaccgatttaagtacgaaaagagacttttcaatgataggactgacgcagagttttatgaggattacccctcaatgtatcatctgcggttgcacctcatgacccacacacataaagccgaccctcgtgaaatcttcctggctatacaccacatcctaaagagccgcggccattttctcaccccaggtgcagccaaagatttcaacactgacaaggttgatttagaggacatttttcccgctctgacagaagcctacgcacaggtgtatcctgaccttgagttgaccttcgatctggcgaaagccgacgatttcaaggctaagctactcgacgagcaggccacgccaagtgatactcaaaaagcactggtaaatcttctgttgtcctctgacggggaaaaggagatcgtgaaaaagagaaaacaggtcctcaccgaatttgctaaggccattacaggactgaaaactaagttcaacttagcgctgggcaccgaggtggatgaagccgacgcaagcaattggcagttttccatgggccagctcgatgacaagtggtcaaacatcgagacaagtatgaccgatcaagggacggagatattcgaacagattcaggagctttacagggctcggctgttgaatggaatcgttcccgccggtatgagcctatctcaggctaaagtggccgactacggccaacacaaggaagacctggagctctttaaaacttatctgaagaaacttaacgatcatgaactggcaaagacaattcgagggttgtacgaccgctatatcaatggagatgacgccaagcctttcctcagagaggattttgtcaaagctctgaccaaggaggtgactgcgcacccaaacgaagtatccgagcagttactgaataggatgggccaggcaaacttcatgctaaaacaacggacaaaggccaatggtgctatcccggttcagctccagcagcgcgaactggaccaaattatagccaaccagtcaaaatactatgattggcttgcaaagcccaaccctgtggagaagcacagagccagcaaaccataccagttggacgaactgctcacctttaggatcccctattacgtcgggcctctgattacgccaaaggagcaggctgagagtcgtgaaaatgtgttcgcctggatgatccggaaagatccctctggaaacataaccccgtacaattttgacgagaaggtggattgccctgcatccgcgaacatgttcattcaacgaatgaaaaatacagacacttatcttatcggcgaagatgtcctgcccaagaggagcttgctctaccagaagtatgaggttctgaacgagttaaataacgtgtcgatcgacggcaggcgcctgggggctgaccagaaacagcggctaattagagaagtatttgagaggcattcttccgtgaccatcaagcaagtcgccgaaaatctcgtggcacacggagatttcgccaaacgcccagagattcgaggtctggctgacgaaaagcggttcctttcaagtttgagcacataccatcagctgaaaaagatactccacgaggccatcgatgaccctactaaagagcatgatattgaaaacatcatcacctggtccacagtttttgaggacgcagctattttcaagaccgaactggccaagatatcttggttagatagcgacactatcaaagcgctgtcaaatattcgttatagaggctgggggcagtttagtaggaaacttttggatggactcaaactgggcaacggtcacacggtgatccaggagctaatgctgtccaatcacaacctcatgcaaattctgacagacgaaacccttaagactaccatggccgagttgaatcaggataaactgaaggctgacgatatcgaggacgtcataaacgacgcatacacaagcccctctaacaagaaagccttacgccaggtgctccgggtagttgaagatatcaagcatgctgccaatgggcaagacccatcatggctgtatattgagaccgcagatggccccggaactgcgggcaaaagaacacagagtaggcagaagcagatccaaacggtgtacgccaacgctgcccaggaacttattgacagcgcagtccgaggggagctggaagataaaatcgctgacaaggcctccttcaccgatcgcttggtgctctactttatgcagggaggtcgggacatatatactggcgcacctctgaatattgatcagctatctcactacgacatcgatcatattctgccacaatcgctcatcaaggacgacagcctggataacagagtccttgtgaatgccacaataaacagggagaaaaataacgttttcgcttccaccttgtttgcgtcaaagatggccgcaacatggcgtaaatggcacgaggctgggctgatcagtggacgcaagttacggaatctcatgctgagaccggacgaaattgataaattcgcccacggctttgtggccaggcagcttgtagagactcgacagatcattaagctgaccgaacagatcgctgcagcccaatatcccaacacgaagataattgcggtcaaagctggtctatctcatcagctccgggaggagctggacttccctaagaatcgcgatgtgaaccactaccatcacgcctttgacgcattcttggccgctagaatcgggacctatctgttaaaaaggtacccaaagctcgcaccctttttcacatatggcgaatttgccaaagttgatgtgaagaaatttcgggagttcaattttatcggagcgctgactcatgctaagaagaacattgtcgccaaagacaccggcgaaatcgtgtgggataaggagcgagacattcaggaacttgatagaatatacaatttcaaacgcatgctgatcacacacgaggtatactttgagactgcagacttgttcaagcaaaccatttatgccgctaaagatagcaaggaaagagggggatccaagcagctcatccctaaaaagcagggttacccaacacaggtgtatggcgggtacacgcgtgagaacaccgcctatctggcagttgtcaaaactgtggaaaagaaagctgacgtgtaccgggtcgttagaattgccacatcacaagtggcggccctaaaggaggcaagggctcagagcaccgtgaaggaacgcgagctgcttaaaaagtttctcactaccaaattcacaaagatcggaaagaacggcaagaaggccataacgccctttgacatcgtaattccgcgagtccctagagagcagctgttccacaataaacggtatggtttcttcatggtgaactctgataccttgatgcataattaccaggaactgtggatgtccaggagtgaccaacagatcttaagcaagctcgttaaatctgctaagactgtggagaacgggcaggtcggccgcctgttcgaaaatattgtggagcagatcaacaaatactttccactttatgatataaatcaattccgtaagaagctggaccagtccaaagatatcttttcaaagttgcccctcgaaggaaacggcacaaccagtgggaaaagagagacaattcagaatatcctgactggagcaggcaccggtgccaagaacggggacctgaaaaatctgggaattaagacgcctttcggctttcttcaggttcccagcggtatagtgctcgatgacgatacaaccctgatctaccaatcgccaactggcatgttgaaccggattgtaaggttatccgagctgtga

SEQ ID NO: 3065 - RNA, 4086 nt, synthetic construct
  misc_feature 1..4086: note = Cas9 variant
  source 1..4086: mol_type = other RNA
atgaagaacgaggaaaatatctacctgggcctcgacattgggaccgatagcgtgggatatgccgtcacagacgataaatacaagataatgaaatatcacggtaacgctgcatggggctccactatcttcgacgccggggcgcttggagctgatagaagggtttttcggtctgcccgccgacgtctggacagaaggcaggagcggattcaattgttacaggaaatcttcgcaaatgagattgccaaggtggatgaacgctttttcatcagactgctagagtcaggcctctggagggctgacgcagaggatcggtacgtatttttcaacgacaaagaatatacggatgtgcagtacatgcgcgactatcccaccatacatcacctgatctgcgagcttatttacaatcctaacaagcatgatgtccgactggtgtacttggcctgtgcttggctcgttacacacagaggtcattttctgagtaatatcaacactgaaaatattgccgacctggtggacatccacaacgtctataatgggttcatgaggtttttcgaggagaacgaaataatttgcgattggcgggaggtgaatgtagaggaactcggacgtgttttagcggcaaacatcggcattaatgaaaagtaccgcaacctgagcaccgtgctttttgccacaagaaaaccagacaagaaagctaaggagggcttcccgtattccgaggatgccatcgtcaggttgctggcagggggaacctgtaaactaaaggacgtgtacatcaaggaagagtatgatgaatttggttctattactctcggcatggacgatgagaaaatgacagaaataatggctgacatcggggatgacttcgatctgattaaggcccttcggtcgctgtacgactggggaatcttggcgaacatactcgtgaatgagaacaattcacccctgattagccagagtaaagtcaaggtttatgagcaacaccgagaagacttagccaacctgaaatacctcgtgcataagtacatccctcacaaatataatgagatcttccgcgaaattagaggcgataactacgtagcatattcctaccattatgagcttaagaatgacgaaaagatgggtaaaaaggctgatgtggagaaattttctaagttcctgttgaaaatcctagaggggattagcgtcgacgaacaggataaggtggtttacgacaacatgatagagaggctgaccctccggctgtttcttccaaagcagaaaaatacggataaccgcgtgatcccccaccagctgtatgaatacgagttgaagtccattctcaaaaatactaagaactacctgcctttcttaaaagagaaggactcagatggaatcagtaatgaagacaagatcattagcatatttaaattcaagatcccatattttgtcggccccctgaactgcaattctcaattcgcctggattcagagaaaagctgatggcaagatctttccttggaacttcgaggacaaagtggattttgacgcctccgaacaggcattcattcagaggatgaccaaccaatgtacatacctaccagaggaatcagtactcccgaagcagagcctgtattaccagaagtttatggttcttaatgagatcaacaatataaaaatcgacgggcgtaagattagtgtggccatgaaacaagagttgtataacgaaatcttcgagaagaaaaagcgggtccgaaagaaggatgtgattgacttctttgtctctaatggatacctggaaggtggcaaggaggctctcatctccgggctggatgaacagatacacactaaccttagctcgttccatgcgtttagaaggctgttgcagaatcacattctctctgtggaggacgttgagtccatcattgaacgcgcatcatatagtgatgacaaacggagagtgctgttattcctgaagaacaaatacagctttctaaccgatgaggacatcaagtacatatgcaaaatcaagattaaggatttcggaaggctctccaaaaagtttctggtagacttcgaaggcacatgtaaagagaccggtgaaatctctacggtccttcgcttgatgtgggagactaataacaatctgatggagctcctgagcgataagtatacatttgccaacgggattaaagaaaatcgaaagaagtactataccgagcagcaaaagactttagacgatcggctggacgaaatgtacatctcaaacagtgtgaagcgtacaatatatagaaccctttccgttgtgaaagacgtcacgaaggctttcggcgtgcccaaaaagatttttgtagagatggccaggaccaataaccctgatttgaagggaaaacgcacacggactagacagcaacaggtgatcgagctctacgcaaagtgcgacgaagaggatgttagggaactgaaacatcaaatggagagcctaggcgaatatgtcgacaacaagctgcagtctgataaactcttcctgtactttatccagttcgggaagtcagcctacagtggaaaaatgattgaccttgagaagttgatgagcggttccaaggtgtatgatatcgagcacatttacccacaggcttatgtgaaagacgattctataatcaataacaaggtcctggttttctcggaagagaatggcgccaaacaagacatttaccccatcaagaccgaaattcgaaaacagatgagcgggatctggacaacttggcatcacgtgggagcaatatccgatgagaagtataagcgcttaacccggtcaacaccttttaacgaagacgagaaatacggcttcatcaatagacagctcaccgagacttcccagtctacgaaggcgattgctcaaatcctgaacgaaaaatatccagagacagaaattgtgtacgtaaaggccggtcttgtcagcgactttaggcacgagttcgggctgtgtaaatgccgttcctacaatgatttgcatcacgcaatcgacgcctatctcaacgtggttgtgggcaatgtctacaacatgaagtttaatcgcaagtggttctcagtggatagcaaatattctataaagaccaaaactatttttagtcatagtctggtttgtaacggaaagatcatctgggacaaagaaaagatgctacccatggtgctgaagaatgctaaaaagaacaatgcccacttcaccaaataccagtttatgaagacaggcgggttctttgatcagatgccgtgcaaaaaggcaagcggactcgtacctcggaagaaaggtctggacaccgagagatatggcgggtacaacaagtctggaattatgttccttactcccatgaggtataaaataggcaagaaatccgatatcattatcttgtcaattgagctgttatacggtaaactcttcctgaaagacgaagtctttgctaagaagtacgccgaggaacgacttcagaaaatcatagggaagaaagcggatgaggtgagtttcccaatgggcatgaagccttggaaaatcaacacagtgctgagcctagacggatttaatgtctgcattacgggcatcgggggaggcggtaagtgtctctcggcccagcccattatgcagctgtccttgccatatgagctggctaagtacctcaaaaagatcgaaaaattcgttgagaagaacaaaaataacgcaaattatatatacgatgaacagtatgactctgtgagcgtagatgagaacattaagttatacgacgtgtatctggacaaacttgaaaattcaatctacaacaaacggatcaatagtcccgaggccattctgaagaacgggcgcgagaaattttgcaagttgaatgtcctcgaacaagctgtgaccctgatcaacatacagtccattttcggaagaatgactggcggttgtgatctagagaatatcggcgggaaaaagcactctgccgcaacagttaactttagctccaatgtgtcaaactggaagaaatactataatgacgtcagggtggtttaccagagccctagtggaatttgggaacggcgatctcagaacatcctggagcttctctga

SEQ ID NO: 3066 - RNA, 4086 nt, synthetic construct
  misc_feature 1..4086: note = Cas9 variant
  source 1..4086: mol_type = other RNA
atgaacgagccctacggcgtggggctggacatcggaaccaatagcgtcggttggacagttgtggatatgaacggcagagtaaggaaggtgaaagggaagactgccctcggagctcggcttttcaaagaaggcgcaacggccgaggaccgccgaggttttcgtaccacaagaaggcggctgaagcgcgtcaaatggagattgaggttactgcgggagttctttgatcagcctatttccaagatagacccaaatttctttgcgcgccgaaagtattctgatatctcaccgagagaccccaactacaatgggctagctaaaactctcttcaacgataggaccgacaaggaattttatgatgactacgccacaatttatcatctgcgggataaacttatgaccagtaatcgtaagttcgacatccgcgaaatttacctggcaatccaccacatagtgaaatatagaggaaactttttgaggactggccctgccagccaatacggctccgcttctctccatctggcaacatcgttccagaagctgaatgatctctttgcccagtcagaggagaccttaaacctgaaacttgttacggacgaagctctactgcagcaaatccagcagattctagtgcggactgacctcagccgaagtgagcagcaacgccagatctggccactgatggccgtccttaccggggcgtccgcagccgaaaagaagagacagaaaaatgtggtagttgagctgtctaaggctttggtgggactcaaagccaagatgaacgtcgtgacactgactgaggtggatgcagctgtcgttaaagactggaccttcacaatggaagagagccaggataagttacccgaaattgaggaacaactgtccgaggtgggtcagcagatcatggacgaggtaatacaactctacgcctcagtgaatcttgcgcagctgattcctgccggcaagaggtttagtcagcacatggtcgaaaaatataagcatcacgagaaaaacttggaactactgaaggcatacatccacagccagtctgattccaaacgggggcgcgagattagagctacctatgacaggtacatcgatggagtggactcaaagccagttacgcaagaaatgttctataaggatctcatgaaatacgtggaggccgacgctactagcaatcatctggccgcagagatcaaggatgaaattgacagtgagcagttcatgcccaaacttcgtacaaagcagaacggctctataccttatcaggtccaacagtacgaactggaccagatcatttcccaccagaaaaagtactatccatggttgggtgaggaaaacccggtggccgagcggcgagggaagtttccctacaaactcgatgagctggtaggattcagagttccttattacgtgggcccattaatcaccaaggaagaccaacaggctactagcggcgcggggtttgcatggatggtcaggaaagccgatggacccataacaccttggaatttcgaccagaaggtggatcgcattgcttcggccaccgcatttatccagcggatgcaaacgaccgacacatatctgatcggtgaggatgtcctaccagccagatctctcatttaccagaggttcatggtgctgaacgaacttaataacatgcgcgttgaggaccgaaaattggctccccagcaaaagcagcggctgtataatcaggtgtttaagcagcatcaacacgtatccgtcaaaaacatccagcagaatctcatggatgccggcgagtaccgtaagactccgcagattaccgggctggcagaccctaaaggattcaactcaagtcttagcacataccacgattttaagaaaatactgttggaagcgatcgctgacgagcataagagagccgatattgaaaagatcatcctctggtccactaccttcgaggactctgcaatttttaagcaaaagctggaagaggtggcctggttaacagacgctcagaggaaacagctgagcggcctacgctatcggggttgggggcagctctcacacaagctgcttaccgccttcaaagatgacaagggcagaagtataatggatggattgtgggagacttccgacaattttatgcaactgaggaaacagcccgcaatcgaaacgcagattaaggaggctaaccaagccaatctcacagatgcggacatccaggataccattaacgaactgtacactagcccacagaataagaaagccatccgagaggttatgttagtgctggacgatataaagaacgctatgcatggccagaccccttcttggatcttcgtcgaagcagcccgcgggggaggtgtggctggccggagaacacaatcaaggagtagccagattgtagaggcctataaagggaccgcaaaggagatcgtgtccgaaaaagttcagcacgagcttaatgaaaagattaaggcgaaagccgacttcaacactcgtttggtcctctactttctgcagaacggacgcgatctatatacaaatgaggctatcaacatagaccggctgtctgaatacgatattgaccatatcctcccccaatcgctggtgaaggacgatagccttgacaatagagtgttgacgtccgccaggattaaccgagagaaaaatgataccttcgcatcagagaagtttggccggaaaatgggtgctcagtggcgcgaactgcacagaaacgggttaatgactcagaggaagctcaagcatctgcttatgcggccagacgagatcagtaaacacgccacagatttcataaatcgacagctggtcgaaaccagacaagttatcaagttggtggaggagctcatttctagcgaatatcccgcagcctccatcgtggctgtaaaagcgaacctgacacaccagtttcgccagactttcaattttcctaagctaagggaggtcaacgactaccatcacgccttcgatgcatcactgaccgcttttattggcatgtacctcctgaaacagtatccaaaacttgaacgtttctttgtgtacggaaaattcgccaagcaaccgatcaatttgacgcggtttaacataattagaaagctggccgttgctgagaaacccatcgcaaatatcgaaaccggcgagattttatgggacaagacagccgatatcaaatatttcgagaagctctacaactataaaaggctgcttgtgactcacgaagtccgcgagaattacggggcgatgttcaagcagaccctgtttaaggctagctataacaaatctaagacattggtgcctaaaaagaaccatatggaaacttccgtttacggaggttacagtaatcaggagaccgcctatctcgcaattgtgcgaataccattcaaaagcggctttaagttcatcgtagtcgggattcccacgagaatggtggccaagatcaaacactaccaatctctgggagctacattgaaccaggcaacccataaggtgattgaacctaaatttactaagatctcccggaaaacaaagcagaccgtcatatcagactatgaggttgtgctgccaaaggtatacttagatcaggtggtcagggaccaagtgaaaggccagatgtatcgcttcagtctcggtagcgacaaggagtaccacaatgttcaggaactgtatcttcccctgtcgatccagcaagcctttgtggggcattacgatgagtccgacgatcagcgttctaacgacttggtcaaagtgtacgatgcggctctcaagcagctgcagagatatttcccgctacacctgagccggaattttgaccaagttgcctcacaggcacaccagagtttcgaaggccttaaaaacaatgtgcaaacttccgataagcagctcggaaagaaagaggtcctgaactctttgtttgtaggcctgcatgccaatgctaccaggagcaacttatccgtgctcgggatgtcaaaggacttcggacgcattaaaagcaatggcatcacactgacggatcaggccgaaattatctaccagagtcctaccggtcttttcgagcgaaaggttgcactgaaagacttgtga

SEQ ID NO: 3067 - RNA, 4086 nt, synthetic construct
  misc_feature 1..4086: note = Cas9 variant
  source 1..4086: mol_type = other RNA
atgggcaactactatctggggctcgacatcggaaccaatagcgtgggttgggccgtcacagatgagaactacaatattgaaagattcaagaaaaagaacatgtggggcataaggctttttgacgaggctaaaactgcagaatcccggcgcatccaccgacaggcccgtagaatgaggcaacggaagattcagcgcctgaatttgttaatggagctgttcgatgttgaaatctctaaagtggacgagtcatttttcattagaaagaaggagagtgatctacattatgaagacaaaagccaggattccaggtacgcgctctttaacgacaaggagttcaatgataaagactatcacaacaagtaccccacgatctttcatctgataatggatcttatcgaaaatgacgagaaaaaggatattcggctgttgtatctcgcttgccactacctgatcaagaaccgcgggcatttcatttttgagggacagaaattcgacgtaaattcttcgctgaacaataacatcaataagctcaaatcacacttagaccaattttacaacatatgtctggatttcgacaacgataaacttattgaaatcttggtgaatcagaacctgaatattagcgagaaaagtaagaaaatcaaggaactactccgaaagaccaacctggaggtcggcatcgccaatcttattgccggtgggtccataaaactgtctaacatgtttgacgatgacgaattgaagaatttcgattataacagcctctccttcaaaaattcaaactttgacgagggaagagagctgttcgaagaggtgttagaagataggtttgagctggttgaaatcctcaaggacattcacgatgcaagtgtgcttgagacaatgctgagctctgcttccatctcacctgacggcggcaaatacataagcagttctatgattaattcctataacaagcataagcgggacttgaaactactgaagaaaatcatcaagaaatacaagaagagtgagtatgataatattttccgtgacgaaaacatcaaaaataactacctctcgtatactcgcaccgggattaacaagaataaaaaggtccaggcaaaagataacacagactctgatggattttacaagtacatagtgaagatcctgaaagacattaaggagaatgattccgacgaagatatcaaatatatcctttcagagattgacaagaaaaacttcgtaccaaagcagagaaccaaagaaaatagtgttataccgtaccaactgagggagatcgagttgcggaagattatcgataaccagagcaagtatcacaaatttctcaatgaagtggacgagaagggtatttccgtcaaagaaaagatcatagccctgttaactttccgaatcccctactatattggccctctgaacccatcttacaatgaggagaaaaactttacaaccagctgggtgaagcgcctagctaaggggaaagtgacgccctggaatttcgaagatatggtcgacatcgacgcctcaagagaggcgtttattgaaaacaagctcaataaatgcagtttcctgcttgatgagactgttttgcctaaggactccctgctctatcaggaatacatggtgctgaacgagcttaataacctgaaaatcaacggacagagcataaataccgatttgaagaagtctatttacgaggaactctttaaaaagtataaaaaggtaacaaggaaacggctgatctcatacattaaggagaaggaaaacactagcggcgacatcgtgataaccggtatcgatggggacttcaaacaaggattaaagagctatattgcattcaaagagatcattggcgaaaagatcgataatgacatataccgcaaagaggtcgagaagattatcagagatatctccctgtatggcgacgataaatcttttattcagaagaagatcaaaaacgaaaataagctagacctctcggataaccagattagcaaaatagccaagctgaaattcaaggactgggggaggttttccaagaaacttttggtgggaatcaaggcttcagacaaaaatacaggtgagattgataacatcattggcttcatgcgtaattacaactataatatcatgcaactgatggccaacgtttttaccttcaaggacgaaatagagaaactcaatagtaagtactacacgtatgaaaagatcaacgtggattacctggacgatttatatctgtctgcaccagctaaacggatgctttggcagagctttcagattgtcgacgagatcaagaatattaaaaactccgcccccaagaaaatcttcatagagatggcgcgatcaaaggaagataagcctactagaaaaatgagcaggaagtctcgcttggagaaactctacacagactccaagaaacagtttattaagctgttcgggccagatgaatatgacaagctaaacaatgagatcaaaaacaagagtgagagcgattttcggtgggacaatctgtacctctattacacccaattcggaagatgtatgtactctctggacccgatcgatcttgaagagttgtccaacaaaaatctgtatgaccaggatcatatttaccccaagtcaaaaatatatgacgatagtatcgaaaacagggtgttagtaaagaaacagctcaatctggacaagagcaacgagtaccctattccagatcgcgttcttaataaggacaaaaacaagctgttggccttttggaaaatgctcaatgaaaaggagctgatcggcgataaaaagtatgcacgactaattcggaagtcgcccttcactgacgaggaactgggtgatttcatcgctcgtcagctcgtggagacaagacaagccaccaaagaaacggctaacatgctgaggcgcctttgccctgactccaagatagtctacgtgaaagccaagaatgtctctgattttcggagaaaattcgacatcttgaagtgtaggagcattaacgacctgcaccacgcacatgatgcctatttaaatatcgtggttgggaacgtgtttgacaccaagttcacatcaaatccactcaactttattaaaaacaatagtaagaaccgatcctacaatctggagaaaatctacgattatgacgtaatacgcaacgaaaagattgcttggcttgcggagcggaaagaggaaaatcaggatggctctatcgcaactgtcctgaagaacctaagcaagaatgacatcagagtgaccaggcgtacatacattaaatgcgaggatctcttcgacgaaaacatcgttcgcaagggaaatggcaaatttcccctgaaggagaacaataacaaatccgatactaataagtatgggggatactcaggtataaagaacgcctatttcgtgttgctggaagacgagaagcacaatcggattatcgaggctattccgagctttatctacaagaaagaaaagaacggcgagaaagggagtgtcataaactatttacagaatattctcggaatcaagtctgccaaaatcctgagagataagattaagatcggctcccttctgaaaattgacaagttcccttacaacttggcaggtaaaagcgggaatggcatactcatctcgggaggcgtgcagctgattctagataagaacacctcaaaatacatcaagaagatcgaaaattataaatacaagctggacgagaacaaagactatcaaattaatatatttgataaactttctaaggaggaaaacatcaaactcttcgacctgttcgtagataagtttgagaatagtatttacaagaacagggtgaatatcaagttgaaagaaattaagctggcccgatccaaattcgagcatttaagcatcgaggaacagataaagacactcacccagatgctgatcctttttgggcgggagaacaatgctgttaacctggaatatattggattgcccaaaaatactggtaagacgaagatcaacaaaaagattaacaataaagacatcaagataattaaccagtctatcacaggcctctacgagaccgaagaggatctggccaatatttga

SEQ ID NO: 3068 - RNA, 4089 nt, synthetic construct
  misc_feature 1..4089: note = Cas9 variant
  source 1..4089: mol_type = other RNA
atgaagaaaccctacagcatcggcctggacattgggaccaactccgtgggatgggccgtcataacagaggattataaggttcctgctaaaaagatgaaagtgctcggtaatacttctagagacttcatcaagaagaaccttctgggcgcattgttatttgattcaggggaaacggccgaggcgaggcggctgaaacgcaccgctcgacgtagatacacaaggcggcgcaatagactaaggtatctccaggaaattttcctggacgagatgaacaaacttgatagtggatttttccaccggctggacgatagctttttggtaccagaagagaaacgcggctcccgatacccgatcttcggtactctccaagaggaagtgaattatcatgagaactttcccaccatttaccacctgagaaagaaactggccgactctaaggaaaaggcagatctcaggttaatctatctggcccttgctcatatgataaaataccgggggcacttcttgtacgaggagtcgtttgactcaaataacaatagcatccaggaaattttcaacgagtttacagcagaatatcataataccatcgagggaagttgcctgtccggccagattgaacaggtcgaggccatcctaactgataagatatctaaaagcgctaagcgtgagcgcattctcaaactgttccctgccgaaaagtccacaggccttttctcagagttcctgaaattgatcgtggggaaccaagcggacttcaagaagcactttgatctcgaagagaaaaccccactgcagttcagtaaggacacgtacgaagaggacttagagaatctgctcgaacagattggagatgagtttgcagaccttttcctgttggccaaaaagctatatgatgctactctgctcgccggtatcctgaccgcaacagacgttagcactaaagctcccctttctgcctccatgatcaacagatacgaaacccaccagcaagatctggcggccttgaagcagtttattaagaataaactccctgagaagtattcagaagtgttcagcgacctgagtaaagatggctacgcagggtatataaacggaaagacaacccaggaggctttttacaaatacatcaagaacttactgattaagttcgagggcgccgtcgactttctagaaaagatcgagagggaagatttcctccggaagcagcgaacgtttgacaatggttctataccacatcaactgcaccttcaggagatgaacgctattttgcgcagacagggggatcattatcccttcctgaaagagaatagggaaaagatcgagaaaatcctcacttttcggattccttactatgtgggaccactggcccgcggcaacagagacttcgcatggcttacacgtaattccgaccaagccatcaggccgtggaacttcgaagaggtagttgataagaccagctcggctgaagactttattaataagatgactaactacgatctgtatttgcccgaggagaaagtgctccctaagcactctatactgtacgaaacattcgcggtctataatgagttaaccaaagtgaagtttatcgcagaaggcctgcgggactaccagttcctagattccgggcagaaaaagcagattatcaacctcctgtttaaagacaagcgaaaggtgacggagaaagatatcattcactaccttcataccgtcgacggatatgatggtatagaattgaagggcatcgacaaacaattcaatgcctcactgagtacataccacgatctcctgaagattatcaaagacaaggattttatggacgacgctgataacgaggccattttagagaatatcgttcatactctgaccatattcgaagaccaggagatgatcaagcagagccttgcacagtatgatgccatttttgacagaaaagtgatgaaggctttgacaaggcgccactacactgggtggggagaactctccgccaaactgatcaacggcattcgggataagcaaaccggtaaaatgatcctagagtatctgaaggacgatggggaaataaatagaaacttcatgcagctcattaacgacgattctctgagctttaaggagacaatccagaaagcacaggtaattggcgagaccgaaaatatcaagcaaatagtgcaggagcttccaggatcacccgcgatcaaaaagggcattttgcagagtatcaaaattgtcgacgaactggtggagatcatggggtacaaccctgagtccatagttgtggaaatggctagggagaatcagttcactaaccaaggacgccgaaatagccagcagcggttaaagaagctcacggattctattaacaaactgggttcaagtatccttgaggaacatccagtcgacaatagccaactgcagaacgatcgtttgtttctctattacctgcagaatggcaaggacatgtacacaggggaagccctagagctgtccaaactctcttcgtatgacgtggatcacatcattccccaggcattcatcaaggacgatagcctggacaacagagtacttgtttcctacgccaaaaataggggaaagtcagatgacgtgccgagtttggagattgtccaaaaacgcaaggctttctggcggcagctgttagattctcagctcataagcgaaagaaagtttaacaatctgaccaaagccgagaggggcggtcttactgaagacgataaggcagggttcatcaaacgacagctggtggagacccgccaaattacaaagcacgtcgctcagatcctagacgcccggtttaacaccgaagtgactgagaaaggcaagaagaaaagagcggttaagattatcacactcaaatccaatctggtgtcaaacttcaggaaggattttgagttgtataaagtacgtgaaataaacgactaccatcacgcccatgacgcttatctgaatgcagtcgtgggaacggccttactcaagaagtaccctaaactggagcccgaatttgtttatggcgattacccaaagtacaacagctatcgcgagcggaaaaccgctactgaaaaggtgtacttttattctaatatcatgaacttctttaaaacaaccgtcaaacttgccgacgggtccgagaagaagagacaccagattgagacaaatgaagagactggagaaatcgtgtgggataagaccaaacacttcgagattgtaaggaaggtgctgagttaccctcaggttaacatcgtcaaaaagacggaggaacaaaccgtgggtcagaatggcgggttgtttgacaacaatatagtgagcaagaacaaagtcgttgatgcatctaagctcattcccatcaaatccggactgtcaccagagaagtatggcggttacgcgcgacccacaatcgcctatagtgtgctagtgattgctgacatagaaaaagggaaggccaaaaagctgaagcggatcaaagagatggtaggcattactatccaggataagaaaaagttcgaagcaaatcctattgcttaccttgaggagtgtggattcaaaaacatcaatagcaaccatataatcaagctcccaaagtactcgctgtttgagttcgacgatggccaacgcagattgctggcctcctctattgaattacagaaagggaatgaactcatcctgccgtatcaccttaccgcactgttgtaccatgcccagaggattaacaagatcagcgagcccatacacaaacagtatgtcgaagctcatcaaaacgagtttgaggaactcctgacaactattatctcactaagtaagaaatacatccagaagcctaatgtggagtccctgcttcagcaggcgttcgaccaaaccgatgaagacatttatcagctctctgagagctttatctccctgttgaagttaatatcattcggagccccaggcgcatttaaattcctgggtgttgatattagccagagtaacgtgcggtaccagtctgtctccagctgctttaatgctacgctcatccaccaatcgattacagggctgtatgaaacccgaatcgacctttcaaagctgggagaggactga

SEQ ID NO: 3069 - RNA, 4089 nt, synthetic construct
  misc_feature 1..4089: note = Cas9 variant
  source 1..4089: mol_type = other RNA
atgaacgagccctacggcgtggggctggacatcggaaccaatagcgtcggttggacagttgtggatatgaacggcagagtaaggaaggtgaaagggaagactgccctcggagctcggcttttcaaagaaggcgcaacggccgaggaccgccgaggttttcgtaccacaagaaggcggctgaagcgcgtcaaatggagattgaggttactgcgggagttctttgatcagcctatttccaagatagacccaaatttctttgcgcgccgaaagtattctgatatctcaccgagagaccccaactacaatgggctagctaaaactctcttcaacgataggaccgacaaggaattttatgatgactacgccacaatttatcatctgcgggataaacttatgaccagtaatcgtaagttcgacatccgcgaaatttacctggcaatccaccacatagtgaaatatagaggaaactttttgaggactggccctgccagccaatacggctccgcttctctccatctggcaacatcgttccagaagctgaatgatctctttgcccagtcagaggagaccttaaacctgaaacttgttacggacgaagccttgctgcagcaaatccagcagattctagtgcggactgacctcagccgaagtgagcagcaacgccagatctggccactgatggccgtccttaccggggcgtccgcagccgaaaagaagagacagaaaaatgtggtagttgagctgtctaaggctttggtgggactcaaagccaagatgaacgtcgtgacactgactgaggtggatgcagctgtcgttaaagactggaccttcacaatggaagagagccaggataagttacccgaaattgaggaacaactgtccgaggtgggtcagcagatcatggacgaggtaatacaactctacgcctcagtgaatcttgcgcagctgattcctgccggcaagaggtttagtcagcacatggtcgaaaaatataagcatcacgagaaaaacttggaactactgaagacctacatccacagccagtctgattccaaacgggggcgcgagattagagcaacgtatgacaggtacatcgatggagtggactcaaagccagttactcaagaaatgttctataaggatctcatgaaatacgtggaggctgacgccacaagcaatcatctggctgccgagatcaaggatgaaattgacagtgagcagttcatgcccaaacttcgtaccaagcagaacggctctataccttatcaggtccaacagtacgaactggaccagatcatttcccaccagaaaaagtactatccatggttgggtgaggaaaacccggtggcagagcggcgagggaagtttccctacaaactcgatgagctggtaggattcagagttccttattacgtgggcccattaatcactaaggaagaccaacaggccacaagcggcgctgggtttgcgtggatggtcaggaaagcagatggacccataaccccttggaatttcgaccagaaggtggatcgcattgcctcggctacggcctttatccagcggatgcaaaccacagacacttatctgatcggtgaggatgtcctaccagcaagatctctcatttaccagaggttcatggtgctgaacgaacttaataacatgcgcgttgaggaccgaaaattggctccccagcaaaagcagcggctgtataatcaggtgtttaagcagcatcaacacgtatccgtcaaaaacatccagcagaatctcatggatgctggcgagtaccgtgaagccccgaagattaccgggctggcagaccctaaaggattcaactcaagtcttagcacataccacgattttaagaaaatactgcccgaggcgatcgctgacgaacataagagagccgatattgagaaaatcatcttgtggtccactaccttcgaagactctgcaatttttaagcagaagctcgaggaggtggcctggctgacagacgctcaaaggaaacagttaagcggcctgcgctatcggggttgggggcagctatcacacaagctcctgatagccttcaaagatgacaatggcagaagtatcatggatggactttgggaaacctccgacaactttatgcagttgaggaagcaaccagcaattgagactcagatcaaagaagctaatcaggccaacctgacggatgcggacattcaagatacaatcaatgagctctacaccagccctcagaacaagaaggccatacgagaagttatgctggtgttagacgatatcaaaaatgctatgcatggccagactccctcttggattttcgtcgaggcagcccgcgggggaggtgtggctggccggagaacccagtcaaggagtagccaaatcgtagaggcctataaggggacagcaaaagaaattgtgtccgagaaggttcagcacgaactgaacgagaaaatcaaggcgaaggccgacttcaacacccgtcttgtcttgtactttctccagaatggacgcgatctgtatactaacgaagctataaatattgaccggctatctgagtacgatatcgaccatattctgccacagtcgctcgtgaaagacgatagcctggacaacagagtgcttacatccgccaggatcaatcgagagaagaacgatacgttcgcatcagaaaaatttggccggaagatgggtgctcaatggcgcgagttgcacagaaatgggctgatgacccagaggaaattaaagcacctcctgatgcggcccgacgaaataagtaagcatgccactgatttcatcaaccgacagcttgtcgagacaagacaggttattaaactggtggaggaattgatctctagcgagtatcctgcagcctccattgtggctgtaaaggcgaatctcacccaccaatttcgccagacattcaactttccaaaactgagggaagtcaatgactaccatcacgccttcgatgcatcactaactgcttttatcggcatgtacctgctcaagcagtatccgaaactggagcgtttctttgtgtacggaaagttcgccaaacagcccataaaccttacccggtttaatattatcagaaagttggccgttgctgaaaagcctatcgcaaacattgagacgggcgagatcctgtgggacaaaaccgccgatattaagtatttcgaaaaattatacaattataagaggctcctggtgacacacgaggtccgcgaaaactacggggcgatgttcaaacaaactctttttaaggctagcgacaacaagtctaaaaccctggtgccaaagaaaaatcatatggagacatccgtttatggaggttacagtaaccaggaaactgcctacctagcaatagtgcgaatccccttcaagagcggctttaaattcattgtagtcgggatccctaccagaatggtggccaagattaagcactatcagtctctcggagctacgctgaaacaagcaacacataaggtgatcgagccaaaatttaccaagatatcccggaaaactaagcagacagtcatctcagattacgaggttgtgttgcccaaggtatatctggaccaggtggtcagggaccaggtgaaaggccaaatgtaccgcttcagtttaggtagcgataaggaatatcacaatgttcaggagctctacctgccgctttcgattcagcaggcctttgtggggcattatgacgaatccgatgaccaacgttctaacgatctggtcaaagtgtacgacgcggctttgaagcagctccagagatacttccctctgcacctaagccggaattttgatcaggttgccaaccaagcacaccagtcattcgagggcctgaaaaataacgtgcagaagagtgacaagcaacttggcaaaaaggaagtcctcaattccctgtttgtaggattgcatgccaccgctactaggtctaacctgagcgtgttagggatgtccaaagatttcggacgcctccagtcacgaagcggcatcaccctgacagaccaggccgagattatctatcagagtccaacgggtcttttcgagagaaaggttgcactgaaagatttgtga

SEQ ID NO: 3070 - RNA, 4089 nt, synthetic construct
  misc_feature 1..4089: note = Cas9 variant
  source 1..4089: mol_type = other RNA
atgaccaagctgggcaaaccctacgggatcggagtggacattggtagcaactccataggcttcgccgctgtcgatgaaaattctcacctcatcagacttaaggggaaaacagttattggagcaaggctgtttgaagagggcaaggccgcggctaaacggcgcgccggtcgaactacgcgtagaaggttgtcacggaaccgctggagattaagtttcctgagggactttttcgaaagccatatcacccctacagatccaaactttttcatgcggcagaagtattccgagatttctccgaaggacaaagcacgctacaagtatgaaaaacgactatttaatgatagaactgacgccgagttctaccaacagtattcgaccatgtaccacctcaggaatcggctgatgacagatccctcacgtgctgacgtgcgcgagatctattttgcaatacatcacatccttaagagcagagggcatttcctgacccctggagatgccaaagactttaacactaatgatgtagctttggacgaaattttcccagccctccaggatgcgtacgcacaggtgtaccccgacctgggcatcacatttgacgaggataaggccaacgagttcaagaccattctgctcaatgagatcgctacgagtatagacactcaaagggccttagtcaaactgcttttggcagaggaagatgacaaggatattctgaaacagcagaaacaggtgctaaccgagttcgctaaagccgttgtgggcctcaagacaaaactgaaccttgcgctggggactgaagtcgactcctctgaggccaccgcatggaattttagcttgggacaactcgatgacaagtgggctggtatcgaatccgccatgacagatgagggcaccgagattctggaccagatccgggatttatatcgagctcgcctgctcaacgggatcgtgcctacgggaaagactctttcacaggccaaagtagacgactacacacagcaccacgaagatctgcaattgttcaaggcatatctaaaacagctggaggacgatggcaccgccaaggctattagacagctctacgacaggtatatagatggtgacgatgcggcaccatttctgcgggaaaatttcgttaaagcccttactaaggacgtgacagctcatcccaacaccaagagtcctgagctgttggaacgcctcgcccaaccagattttatgctgaaacagagaaataaggcaaacggggccatcccggtccagatgcagcaaagggagttagaccagattatcaaaaaccaggctgtgtactatgattggctggccgcacccaatcctgtggagaagcaccgtaaaagcatgccataccagctagacgaactcctgaacttccggataccctactatgtcggacctcttgttacggcgaaggagcaaaaggctgcccagggcggcgtgtttgcatggatggtacgaaaagatccagaagggaatattaccccctacaacttcgacgagaaggtggacagagaagcctctgctaatacatttatccagaggatgaaaactaccgatacatatttgatcggagaggacgtcctgccgaagcagtccctcctgtaccaacgctatgaggtgcttaacgaactgaataacgttcgggtgaataacgagaaattgtcaattgaacagaagcagcaggtcatcagagagcttttcgagaggcataatagcgtgactattaagcaatttgccgaaaacctgcgcgcacacggtgattacgctcacatacctgagatccgaggcttagccgacgaaaaacggttcctgagttctctatccacctatcgtcagctcaagagcctgcttcccgaggcgattgatgacccagccaaacaggctgatatcgaaaatatcattgcatggtcgacagtatttgaggacgccgctatattcaagaccaaattgaaggagatctcttggctggggtccgaagccattactaaactctcaaacatcagatacaggggatggggccaattcagtcgcaagtttctgaatggtttaacgctggggaacggccatacaattatccaggagcttttgctcagcaccaacaatctgatgcagatactaactgatgaaaccctgcagaagaaaatgacagagctcaacgcagacaagctgaaaaccgcgaatatcaacgatgccattgacaatgcttacacttccccttctaacaagaaagcccttcggcaagttttgagagtggtcgatgacatcaagagggcagctgacggacaggatcccagctggctgtatgtggaaacagccgacggcgggggaacgccaggtaagcgaacccgcgcacggcagcaccagttacaagagatttacgccaatgctgcgcatgagctcatcgatactgccgtcagaggcgaactggaggacaaaatatcagataaggcagacttcaacgataggcttgtgctgtattttatgcaagggggacgtgacatttacacaggcgctcccttgaatatcgatcagctcagttcctatgacattgatcacatcctgcctcagagcctaataaaagacaactctctggacaatcgcgttctcgtgcatgccatcattaaccgggaaaagaatgccaccttcgcttcaacaatctacgcacagaaaatgaacgccacttggagacagtggcacgaggcgggtctgattagtgggaggaaacttcgaaatttgcagatgcggccagatcaaatcgacaagtatgctagcggctttgtagcccgccagctggtcgaaaccagacagataattaagttaacggagcagatcgtggcagcccaatacccggataccaagatcattgctgttaaagcaggactctcccaccagctgagggaggaacttgagttccccaagaaccgggacgtgaaccattaccaccatgcctttgatgcgttcctggctgcccgaatcggcacatatctactcaaaagatttcctaatctgcaggcattctttacttacgggaagttcaccaaggccgacgtcaaaaagttgcgcggatttaacttcattagggatataacacacgctgaagacaaaatcgtggccaaggatactggtgaggtagtgtgggacaaacagcgtgatgttgacgagctggatcggatttataatttcaagagaatgttaatcacccacgaagtcaggtttgagacggcagacctcttcaaacaaacagtgtacggcgctcgcgactctaaggaagccgggggatcgaagcagctgattccaaagaagaaaggctatcccgtggatatctacggtgggtattttcgagagaacaccgcgtaccttgccgtcgttaaggtgactaaaaagacagaaaccatattcaaggtggtaaaaatcgcaactagccaggtcgctgccctgaataaggctagatcccggtcaaccgcagaggagttgagtgtgctcacagaactgctaaaacctaagttttctaaagttggcaagaacggaaagattacggacaccccattcgaggtggtcctgcccagggtgccgcgcgaacagctcttttacaatgccaaatatggcttctttatggttaacagcgatactatgttccataattttcaagagatctgggtgtcccgttcagaccagaagattctccagcagatcagaaaagccaagatagattaccctaacgtagaccaagatctggacaatttgttccacaacctggctgatcagattgtcaaatatttcgacttatacagcatcgcggggtttaaggaaaagatctctcagtcccaaaatacattcaacgatctcgcagtggacgataccgaccagagtgtgggaaaaattacagtcataaatgagctgcttaagggcgcccaggctaacggtatgactgggagcctgaaagttttgaagatctctaccccatttggattcacgcaggacaaatccggcgtgctcacaaaggattcaagtattatctatcaaagccccaccggtctgtttgagcggtcggtaaggctaactgacctgtga

SEQ ID NO: 3071 - RNA, 4089 nt, synthetic construct
  misc_feature 1..4089: note = Cas9 variant
  source 1..4089: mol_type = other RNA
atgaccaagctgggcaaaccctacgggatcggagtggacattggtagcaactccataggcttcgccgctgtcgatgaaaattctcacctcatcagacttaaggggaaaacagttattggagcaaggctgtttgaagagggcaaggccgcggctaaacggcgcgccggtcgaactacgcgtagaaggttgtcacggaaccgctggagattaagtttcctgagggactttttcgaaagccatatcacccctacagatccaaatttcttcatgcggcagaagtattccgagatttctccgaaggacaaagcacgctacaagtatgaaaaacgactatttaacgatagaactgacgccgagttctaccaacagtattcgaccatgtaccacctcaggaatcggctgatgacagatccctcacgtgctgacgtgcgcgagatctattttgcaatacatcacatccttaagagcagagggcatttcctgacccctggagatgccaaagactttaacactaatgatgtagctttggacgaaattttcccagccctccaggatgcgtacgcacaggtgtaccccgacctgggcatcacatttgacgaggataaggaaaacgagttcaagaccattctgctcaatgagatcgccacgagtatagacactcaaagggctttagtcaaactgcttttggccgaagaggatgacaaggatattctgaaacagcagaaacaggtgctaaccgaatttgcaaaagctgttgtgggcctcaagacaaaactgaaccttgccctggggactgaggtcgactcctctgaagcgaccgcctggaattttagcttgggacaactcgatgacaagtgggcaggtatcgagtccgctatgacagatgagggcaccgaaattctggaccagatccgggatttatatcgagcccgcctgctcaacgggatcgtgcctacgggaaagactctttcacaggctaaagtagacgactacacacagcaccacgaggatctgcaattgttcaaggcctatctaaaacagctggaagacgatggcaccgcaaaggccattagacagctctacgacaggtatatagatggtgacgatgctgcgccatttctgcgggagaatttcgttaaagcacttactaaggacgtgacagcccatcccaacaccaagagtcctgaactgttggagcgcctcgctcaaccagattttatgctgaaacagagaaataaggccaacggggcaatcccggtccagatgcagcaaagggagttagaccagattatcaaaaaccaggccgtgtactatgattggctggctgcccccaatcctgtggaaaagcaccgtaaaagcatgccataccagctagacgagctcctgaacttccggataccctactatgtcggacctcttgttacggcaaaggaacaaaaggcggctcagggcggcgtgtttgcctggatggtacgaaaagatccagaggggaatattaccccctacaacttcgacgaaaaggtggacagagaggcatctgccaatacatttatccagaggatgaaaactaccgatacatatttgatcggagaggacgtcctgccgaagcagtccctcctgtaccaacgctatgaagtgcttaacgagctgaataacgttcgggtgaataacgaaaaattgtcaattgagcagaagcagcaggtcatcagagaactcttcgaaaggcataatagcgtgactattaagcaatttgctgagaacctgcgcgcccacggtgattacgcacacatacctgaaatccgaggcttagctgacgagaaacggttcctgagttctctatccacctatcgtcagctcaagagcctgcttcccgaagccattgatgacccagcgaaacaggccgatatcgagaatatcattgcttggtcgacagtatttgaggacgcagccatattcaagaccaaattgaaggaaatctcttggctggggtccgaggctattactaaactctcaaacatcagatacaggggatggggccaattcagtcgcaagtttctgaatggtttaacgctggggaacggccatacaattatccaggaacttttgctcagcaccaacaatctgatgcagatactaactgatgagaccctgcagaagaaaatgacagaactcaacgccgacaagctgaaaaccgcaaatatcaacgatgcgattgacaatgcctacacttccccttctaacaagaaagcccttcggcaagttttgagagtggtcgatgacatcaagagggctgcagacggacaggatcccagctggctgtatgtggagacagctgacggcgggggaacgccaggtaagcgaacccgcgcccggcagcaccagttacaagagatttacgcaaatgccgctcatgaactcatcgatactgcggtcagaggcgagctggaagacaaaatatcagataaggccgacttcaacgataggcttgtgctgtattttatgcaagggggacgtgacatttacacaggcgcacccttgaatatcgatcagctcagttcctatgacattgatcacatcctgcctcagagcctaataaaagacaactctctggacaatcgcgttctcgtgcatgctatcattaaccgggagaagaatgccaccttcgcctcaacaatctacgctcagaaaatgaacgcaacttggagacagtggcacgaagccggtctgattagtgggaggaaacttcgaaatttgcagatgcggccagatcaaatcgacaagtatgcgagcggctttgtagctcgccagctggtcgagaccagacagataattaagttaacggagcagatcgtggccgcacaatacccggataccaagatcattgccgttaaagctggactctcccaccagctgagggaggagcttgagttccccaagaaccgggacgtgaaccattaccaccatgcatttgatgccttcctggcggctcgaatcggcacatatctactcaaaagatttcctaatctgcaggccttctttacttacgggaagttcaccaaggcagacgtcaaaaagttgcgcggatttaacttcattagggatataacacacgccgaggacaaaatcgtggctaaggatactggtgaggtagtgtgggacaaacagcgtgatgttgacgaactggatcggatttataatttcaagagaatgttaatcacccacgaggtcaggtttgaaacggccgacctcttcaaacaaacagtgtacggcgcacgcgactctaaggaggctgggggatcgaagcagctgattccaaagaagaaaggctatcccgtggatatctacggtgggtattttcgagaaaacaccgcctaccttgcggtcgttaaggtgactaaaaagacagagaccatattcaaggtggtaaaaatcgccactagccaggtcgcagctctgaataaggccagatcccggtcaaccgctgaggaattgagtgtgctcacagagctgctaaaacctaagttttctaaagttggcaagaacggaaagattacggacaccccattcgaagtggtcctgcccagggtgccgcgcgagcagctcttttacaatgcaaaatatggcttctttatggttaacagcgatactatgttccataattttcaagaaatctgggtgtcccgttcagaccagaagattcttcagcagatcagaaaagccaagatagattaccctaacgtagaccaagatctggacaatttgttccacaacctggccgatcagattgtcaaatatttcgacttatacagcatcgctgggtttaaggagaagatctctcagtcccaaaatacattcaacgatctcgcggtggacgataccgaccagagtgtgggaaaaattacagtcataaatgagctgcttaagggcgcacaggccaacggtatgactgggagcctgaaagttttgaagatctctaccccatttggattcacgcaggacaaatccggcgtgctcacaaaggattcaagtattatctatcaaagccccaccggtctgtttgaacggtcggtaaggctaactgacctgtga

SEQ ID NO: 3072 - RNA, 4089 nt, synthetic construct
  misc_feature 1..4089: note = Cas9 variant
  source 1..4089: mol_type = other RNA
atgaccaagctgggcaaaccctacgggatcggagtggacattggtagcaactccataggcttcgccgctgtcgatgaaaattctcacctcatcagacttaaggggaaaacagttattggagcaaggctgtttgaagagggcaaggccgcggctgaccggcgcgcctcacgaactacgcgtagaaggttgagtcggaaccgctggagattaagtttcctgagggactttttcgaatcccatatcacccctacagatccaaactttttcatgcggcagaaatattctgagatttcgccgaaggataagtcacgctacaaatatgaaaagcgactatttaatgacagaactgatgcagagttctacaaatatgagaattgccccaccatgtaccacctcaggaaccggctgatgacagaccctagcaaggccgatgtgcgtgaaatctattttgctatacatcacatccttaaaagtcgcggtcatttcctgaccccaggggacgcaaaggattttaatactaacaaggtagccgtgaataaaattttccccgctttgcaagacgcctacgcgcaggtctaccctgatctcgacatcacatttgacgagaacaaggtgaatgagttcaaaaccgttctgctgaacgagaaggcaacgccatccgatactcagagagccctcgtgaatttactgcttgctaaagagggagacagggatattttgaagcagcaaaaacaggccctgaccgagttcgcaaaggctgtcgtgggcctaaagacaaaactcaacgtagccctgggcactgaagttgactctagcgaagcgaccgcctggaatttttcccttgggcagctggatgacaagtggacaggaatcgagtcagcaatgaccgatgaaggtacggagatattggaccagattcgggatctctatcgagctcgcctgttaaacggcatcgtgcccgccgggaaaactctgagtcaagctaaggtcgacgattacgcccagcaccacgaggacctcgaacttttcaaagactatctgaagcagttggaggatgacggaacagcaaaggccattagacagctatacgataggtatatcgacggcgatgacgctaaaccttttgtgcgggaagatttcgtgaaggcgctgaccaaagaggtcactgcacatccaaacgccaagagcccggaactcctggagcgccttgctcaacccgactttatgctgaaacagagaaataaggccaacggtgcaatccctgttcagatgcaacagagggagttggatcagattataaagaatcagtctgtgtactatgactggctcgccgctccaaaccccgtagaaaaacaccgtaagtccatgccttaccaactggatgagttactgaatttccggatcccatactatgtggggcccctagtcacagccaaagaacagaaggcagcgcagggaggcgtgtttgcttggatggttcgaaaagacccggatggcaacattaccccttacaatttcgacgagaaggtggacagagaagcctcagcaaacacgtttatccagaggatgaagaccacagatacttatctcataggggaggacgtcctgcccaaacaaagccttttgtaccagagttatgaggtgctgaatgaactcaacaatgtacgcgttaacgataataagctgtctttcgaccagaaacagcaagtgcttggagagctgtttgaacggcataacaccgtcacaattaagcagttcgtggataatttgctcgcccacggtgactacgatagaatcccagaggtcaggggcctggctgacgagaaacgctttttatccagcctgtcgacttataaccagctaaaggggatcctccacgaagccattgatgactctgataaacagaccgacatcgagaacattatagcatggtccacaatcttcgaagataaggctattttcaagaccaaactgaatgagatctcatggcttaacgccggaatgatcaatagtttggcgaacattcgataccggggctggggtcaatttagccataagctgctcaatgaactgactttatccacggggcgtacagtgttcgaggagctgcttatatctagccacaacttgatgcagatcctcaccgacgaagttctgaaacagaagattgccgagctaaatgctcatgaactgaaagcatcaggcatctacgccgctattgacgatgcctatactagcccttccaacaagaaggcactcagacaagtgctgagcgtaatcgacgatataaccaatgcggccggacaggctcccaactggctttacatcgagacagccgacggcgatggggtcccaggaaaaaggaccaattctcgccagcggaagattcaggaaatctatgcaaacgctgcccaagagttgattactggttcagtgagaggcgagctggaagacaaaatcgcaagtagggccgattttacagaccgattagttctctacttcatgcaagggggacgcgatatatatacgggcaagcccctgaatattgacaaccttagctcctacgatatcgaccacattctgcctcagtctttgatcaaagacaattcgctcgataaccgggtgctggtccatccacttgtgaacagagagaaggacaccatatttgctagcactaggttcgcgaagcagatgaatggtatgtggcgtcagtggcacgccgcagggctgatctcctcacgcaaactccggaacctgcagatgagaccggatgaaattgacaagtatgctagtggctttgtagccaggcagcttgtggagacacgacagatcattaaattgaccgaacaaatcgttgccgatcagtaccccgacacaaagataattgctgtcaaagcaggactgtctagccagttacggaaggagctcgatttccctaagaatcgcgaggtgaaccactaccatcacgcctttgacgcgttcctggctgccagaatcggcacttatcttctgaaaaggtacccaaatctagaaccctttttcacctatgggaagtttaaaaagacggaggtgaaaaagctcaaatccttcaacttcatccgggatatgacccatgcaaaggacaagattgtcgccaaagaaacaggagagatcgtttgggataatgcttcagacattaacgagctggatcgaatatacaattttaagagaatgttgatcactcacgaagtgcgcttcgagaccgcaagcctgtttaaacaaacattatatgccgcgaagaactctaaaaataggggtggctcccgtcagctcattcctaagaagaaagggtacctggtggacatctatggaggctacactcaggaaaccggtagttaccttagcgtagtccggctgacgaagaaagctatgtatgccgtggttaaggtgtctacaagagacgcagccaaattggctgtcgccaagtccatttcagagcagaaggaaaacgagaccctcaaaaagatcatagatgggaaactgagtaagactagcaaaaagggcaagacaacccaccaactattcgagatcgtgctgccaagggttggacagaaaactctttttaaaaattcgaagtacaaccagttcctcgtaaattccgacacctatatgcataactaccaggaactgtggatgccccgcgagtatcaacgaatgtggaaggatattttgctgtctaaccacggcgacgcacagttagaagggcagctcgatcagatctttaaattcattgtgagccaagtcaattcatactttaacctgtatgacatcaatcagttcagaaagaagatagctgatgccacagacaaatttgcgaagctaccgacgcatgataccgacaacgcccggggaaaaattgcaactatcggccagctgttgatcggtctccaggctaatgccatgaggagtgatctgcgcaacctagacattaagacacctttcgggctgcttcaaataggaaccggcatcacactcgatctggacacttccattatctaccagtctccaaccggtttgttcgagcgtgaagtgcccttaacggacctgtga

SEQ ID NO: 3073 - RNA, 4089 nt, synthetic construct
  misc_feature 1..4089: note = Cas9 variant
  source 1..4089: mol_type = other RNA
atgaaccaggagccctacgccatcggcctggacattgggaccagctccctcggatgggctaatgcagatatggacggttatatagccagagtgaagggccaaacagggcttggagtcaggctgttcgaagagggccagcctgcggctgatcggcgctcttttcgaactacgcgtagaaggttgtcacggcgcagatggaggttacggctgctacgcgaaatcttcgacgagccaattagtagcatcgatccgaactttttcgcccgacagaaagcatcctctatttcgcccaaggacgatagatttgaaaccacataccagcttttcaatgacaaaactgatcaagagttttattcaaagtaccctaccatctatcacctgaggtgggcccttatgacagagcatcggaaattcgacctgcgtgaaatatacttggctgttcaccatatcgtgaagtatcgcggtaactttctcagaagcgggaatccaaagagtttcaaaccctccgagctggatttttctcagaggttcaaggaagtaaacggactgtggcacctcatttttgacgaggtggcacctcagttaccaaccgataatctggaggaaatcactaaacttgtcttggacacaacccggacgcgagccgaccgccagagagagagcgtgaagctgctaatggctgccactgataaccataaagactggaagccctacctcaccgagttcacaaaggcgattctgggccttaaaactaagctgtacttgctcaccggcgttgatgtggcaaaagccgaccaaaagacatggaccttctccctggaagatatcgaagaccacagggctgatttagagacggcctttgacgatcggtcactggagctcatagaaaaacttgtcgacctgcaggcagctattcagttgactgagatcatgcctagtgggcagtatttcagccaatctatgatttaccgctatgatcagcacaaggaacatctaagatggctgaaagactacgccgagcagcaaacagacgcgaataagaggaaggccgtgcgtctcgcatatgatcactacatcgaaggagacgctaaaggtaagccagagatcgccgatgacttttataaagagctgaaccggattcttaagggcgatacctccgaactggctaaaaagataaatcatgagatcgccttggaacacttcatgccgaagcagcgaactaaagagaacggggtaattccctaccagatccaccagcaagaactcgactcaataattgataatcagaagaaatactatcagtttctgggagaggacaaccctgttgtgagccatcacggcagtcagccatacaagatcgatgagttagtctctttcagagtgccctattacgtgggtcctatgatcacagcagaccaacagaaaaagaccgccgctgggcagtttgcgtggatggtcaggaaggattccggagacattacgccatggaatttcgatgacaaagttgaccgcaccgcaagcgccacaaactttatccagcggatgaagactaccgatacatatctgattggcgaagacgtgctacccctccaatcgctgacttaccagaaattcatggtacttaacgagttgaataacataagaatcaatggcgaactgctcaccagggagcagaagcagcgcacatataacgatgtgtttaaagggcatggaaccgtcaatgtgaagtctctgattaagtcccttgagtgccactcagaagttactggtgctatcaaagtggagggcctggccgacccgaagcgattcaacagtgcattgacgacataccgggattttaaaaagatcctccctgtcgccattgaccaaccccagcgtcaggctgatatagaaagaatcattaattggagcaccatcttcgaggacgccgatattttcaaagcaaagctgcaagaaatcgactggttaactgatacccagagggaccgcctgtccacaaaacggtacagagggtggggaaggctatctgcgaagctcctgcttaacataaaggatacccagggcttgagcatcatggaccagctgtggaatactcaacataactttatgcagattgtgcacgagccagactatgctgagaaaatcgaaaagacaaatgccaaaggtctcaagcagcaggatattttcgagacgatcaacgaaatgtacacctcacctcaaaataaaaaggcactgcgacagatattagccgtagttcgcgacattcagaaggctcaccatgggcaggcccccagtcggatctttattgaggcagctagaggcgccgaacaaaacccacagaggactcgtcagcgccaaaaacagctggcggatcttttcgccgaccaggctaaggagatcgtgaatgagacagtcgcacaggaattgaacgatgagaccgacaacaaagcccggtttacagatagactcatgctgtatttcctacaaaatggacaggacatgtacactggcgaaaagctgaacatagataaactctccacctatgacatcgatcacattctgccccagagccttgtgaaggacgactctttggataatagggtcctggtgtcaaaggttgagaacttaaagaagaatgaccattttgctagtgaactctacgcccgaaaaatgcaggggacgtgggagctgtggcggagcgcaggacttatctccgcgcgcaagctgaaacacttgctcatgagacctgatgagattaacaagtatgccaccggtttcatcaggcggcaactggtggaaacacgacaggtaataaagctagtcactgacgtgctgtctaatgagtacgattcggacaaaaccaagattatcagcgttaaagctggcctctcccaccagctgagaatggaacttgatttgccaaaggtgcgcgagctgaacgactaccatcacgcctttgatgcattcttagctgtcaggatcgggacatatctcctgaaacgttacccgaagctcgagcggtttttcgtgtatggacagtaccaagtagcaccccagctggacctaagaaggtttaatttcattcatgatctcgtgtcaggcaaacaggaaaagatcgttgccgaggaaactggtgagattgtctggaaccgcgaaaaggacgtgagttatatgaaacacctgttgtctctgaagcatttactcgtgacccacgaggtcaaagaggatcacggggccctgttcaatcagacgatatacaaggctaaaaaggacaacggcaatgttggaggcaagatgaaacttctgcctacaaagagcaaccgaccaaccgaaatctatgggggacattcctcacaagcgattgcctacttggcaatcgtgagagtgaatggtaaagagcccagctaccgggtaatgggcgtccctattaggatcctcgaccagctgaagcaggctaaaaagcaaggggaatatgccgagcgcctagccctgaagcagtttttcactccagattttacaaaaggaaagggcaaaatagtgtctgacttcgatgttgtgatcccccacattccgcttctccagcctgtcatcgacgaaatttccggtcagagtcatcgttttgctctggggaccaacacttactatagaaacttgcaacagctgatcttaaccctcgcagatcagaaggtgctgataagcaaagagacaggcgttgacgaggaaaagaaacttgtggaggtatactctcacatttgtcagcaagtcatgaaattctttccactgtatgatcggaataagttcagggaattgctcgtggactcccgctcacattttgagcagctgcccatcgtgaaccgatacagtgatgccggaaaactagaaatcgcgggcaagagagggattctgcagcagataatggtcggacttcacgctaatgccacgcctggcgacctcaaagagctgggtgttaagacccccttcgggaagttgcaagtgccaggaggcatcaaattaactgagaacgcaaagctgatttatgaaagccctacaggtctctttaaacgggaggtaaagatcaccacagaatga

SEQ ID NO: 3074 - RNA, 4089 nt, synthetic construct
  misc_feature 1..4089: note = Cas9 variant
  source 1..4089: mol_type = other RNA
atgaagaaaaaggccgagaaaatctacctgggcctcaacgtggggaccaatagcattggatatgctgtcacagacgaacagtacagacttctgaagttcaacggtaatgatgcatggggctccatagtttttgacgccgcgtcttcaaacgaggataggcggaatcaccgcttggctcgacgtaacttagacagaaggcaacagcggatcgtgtggctgcaggaaattttcgccaaagagatcagtaaggtagatgaccgctttttcattagactaagcgaatcctttaggtggcgggaggatgtgcaggaccgctatgtcttctttaatgataaggagtacactgacgtgcaatatatgaaagaataccccacgatccatcacctcatatgcgagctgatggataacaagacccctcatgacgttcgacttgtgtatctggcatgtgcctggttgatcacacacagagggcatttcctcaataacctgaatgtcgaaaaactggatgagattatggacttttcttcggtgtaccagaacttcatcaattactttactgagaacggatataagaggccatggggcgaaattgacgtatcagctctcagcgaggttttaaaacagaagaccggtatcacagtgaagaataaagaactgcagaacatacttttggaggggaagaaaccggaaaagagtggaaccgaggagttccccttttcccaagattctattatccggctgctagcaggcggccagtgcaaactcaaggacgtcttctgtaaagaagagtacctggatcttgggagcgtgtccctgggaatggacgaagagaagttcgatgaaatttcaggtagtatcggcgaggactatgatttgctcatcgccctgcgtgggttatacgactggagcgtgctggctaacctccttaatggacactctgagactatttccatggccaaggtccagatgtatgaacagcacggcaaagatctgcaaatattgaagtactttgttcgcaaatatgtgcctgacaagtacaacgaggtattcagaaaagcgaaggcagataattacgtggcctatacaggtcatatggacaaggacaccgcttcacagatcaaaaagaaagccaaggcagaagagtttagcaaatacgtcctaaagctgatgagtccaattaagcccgaaaagacggatctccagtcttatgaggacatgtgcgagaggctgaaacttaaccggttcctgcctaaacaaaagaatactgataaccgagtgatcccacaccagttgtacgaatatgagctcatacagattctgaaaaatgcttccgtttacttaccctttctgaacgacaccaataacgggatcagcgaagccgataaggtgctatcggtcttccgctataagatcccttactacgtgggaccactcaatgaggagtcttcctttgcgtggatttcaagaaaacagggcaagatcacaccgtggaacttcaaagaaatggtagacgaggatgccagtgaaaatgcatttattaggcggatgactaacaagtgtacctatctgcccacagaggacgttcttcctaaagatagcttgtgctaccaaaagttcatggtgctgaatgaaataaacaacctccagatcgacggcctgaaaattccagtcaaggctaagcaggggatctatcatgagctttttgagaaaaataagaaagtgaagcgcaaagatatcgaagagtacctgattagaaacaattatttggacaaggattccaccgaactcatatctggaatcgacgagcagattcacagcggtctgtcaagttactgtgccttctttaacttactgaataagaaaatcctatccgaagacgatgtcgagaggattatcgagcgtgctagctatgccgaagacaagtctcgggtgataaaatggctccgaaaggagtaccccggcctgtcagaagatgacatcagatacattgcaaggatcaaaattcgcgatttcgggcggcttagtaagacgttcttgactggactgaagggctgcgacgttagcaaaggttttgatgggcaagacgtggagatgatctccatactccagacaatgtgggaaaccaacgataatctgatggagattttatctgacaagtatactttcctggaggcccttgaggcttttacacaggagtactataccggcaaaaagaaatcgttgaaggaaagactcgatgagatgagggtaagcaactccgtccgccgacctgtgtaccggacgctggcggttgtgaaggacatcgagaaagcattcggaaagccaaataaaatttttgtcgaaatgacccgtggcgggcaggccgatcaaaagggaaaaagaatcaagtcaaggaaacagcagatactagacctgtatgacaagtgtaaggatgacgtgcacgatctcatgtggcagctggagagtcttggtgaatacgctgactctcgcttgcaaagcgatcggctgtatttatacttcatgcagtttggcaaatgcgcctactccggggcacatatcggattcgagcagctcatggccggctcagtagaatatgacattgatcacatctacccccaaagctatgtgaaggacgattctctgaacaataaagttcttgtcctgtccgacttgaacggtacaaaggataatatttacccggtgagtcctgagatcagagggaaaatgcagggcctctggagctggtggaaccatgtgggagctatatctgacgagaagtataagaggctgattcgatccgccccctttactgacgaagagaaaatgggcttcatcaatcgccagctaaccgaaacatcacagagtactaagtttatcgcagatctgctcaaagagcggttcccagacgcggaagtcgtttacgtgaaggctgggctggtgagcgattttagacacgagttcgaccttcctaaatcgaggtcctataacgatttgcataacgccgcagacgccttcctgtctgtagtcgctggaaatgtgtacgatatgcgttttagcaagaagtggttccgcattgacgagaaatactcagttaaggtgaaaaccatctttacacacgaagtcaagtgtcggggtgatattatatgggacggcatgcccatgttagagaaagtggaagataccgccagaaagaacactgcacacttcgttaagtatgctgcctttaaaacagggggactcttcgaccaaaatccagtgaagaaaggcacgggtctgatcccccttaaggcggggctgcctaccgagaaatacggcggatataacaaggccggcattatgtttctaatcccagtaaggtacaatattgggaagaaaagtgaaatcctcatactgccggtcgagttgatgcatggaaagcacttcctggaggataaagtgtttgctcgaaactatactttcacccggttagaaaatatcctcggcaagaaagtgggtgaggtctcctttcccatggggatgcgcccttggaagattaacacaatgctgtctttcgacggattcagagtttgccttaccggcactagcggtaggggcaaatgcctggtggcacagccagtaatgcagttttccgccgacgaacattggcggttctacgtgaagcgattggagagatttgtcgagaagatcgggattaatcccgatctcctgtatgacaaagatcacgacaaggtgtcaaaagatgaaaacctaaagctgtacgagctttacgttgacaaactccagaatacaatctataagaagcgcgtgaacagccctgtccaaacgctgttgaaaggaaaggaagagttcaaaaagctgagtatagaagaacagtgtcaggtgttactcaatattcagtctgtttttggcaggatgaccgggggatgcgatctgactcttatcggcggttccgctcacagcgccgcaacagggtcgctgtcaaccacaatctctaactggaaaaagaagtacagtactgtgcgtattatagaccaatccccaagcggaatgtgggagaaatctagcgaaaatttgctcgatttcctgtga

SEQ ID NO: 3075 - RNA, 4092 nt, synthetic construct
  misc_feature 1..4092: note = Cas9 variant
  source 1..4092: mol_type = other RNA
atgaccaagctgggcaaaccctacgggatcggagtggacattggtagcaactccataggcttcgccgctgtcgatgaaaattctcacctcatcagacttaaggggaaaacagttattggagcaaggctgtttgaagagggcaaggccgcggctgaccggcgcgcctcacgaactacgcgtagaaggttgagtcggaaccgctggagactgagcttcctgagggatttcttcgaatcccatatcacccctacagacccaaactttttcatgcggcagaaatattctgagatttcgccgaaggataaggcacgctacaaatatgaaaagcgactatttaatgacagaactgatgccgagttctaccaacagtatcccaccatgtaccacctcaggaatcggctgcttacagacccttcaaaagctgatgtgcgtgagatctattttgcaatacatcacatcttaaagagccgcggtcatttcttgaccagtgggtacgccaaagactttaacactaataaggtagctctcaacgaaattttcccagccctgcaggatgcgtacgcacaggtgtatcccgacctggatatcacatttgacgagaataaggtcaacgaatttaaaaccgtgctcttagacgagaaggccacgccttccgatactcaaagagctctggttaatcttttgctggccgaggacggagataaagacattctaaagcagcagaaacaggtgctcaccgagttcgcaaaggctgtcgtgggcctgaaaatgaaacttaacgtagccctgggcacagaggttgattctagcgaagcgactgcctggaatttttccttggggcaactcgacgataagtgggcaggaatcgagtcagctatgaccgacgaaggtacagagatactggatcagattagggacttataccgggcccgactgctcaacggcatcgtgccagctgggaaaacccttagtcaggccaaggtcgatgactatgagcagcaccacgaagacctggagttgttcaaagattacctaaagcaactggaagacgatggaatggcaaaagtgattcgccagctctatgacagatacatcgatggcgacgatgccaagccctttgtgagggaggacttcgtcaaggctctgacgaaagaagttactgcgcatcctaatgcaaagagcccagagcttctggagcggttggtgcagccggattttatgctcaaacaacgcaacaaggccaacggtgctatccccgtacagatgcagcagagagaactggaccaaattataaagaatcagtctgtgtattacgattggttagccgcacctaacccagtcgagaagcacaggcagtccatgccctaccagctggacgaactactcaatttccgtatcccttattacgtggggccactggttacagccaaggagcaaaaagctgcccagggaggcgtgtttgcatggatggtccggaaggatcccgacggcaacattaccccgtataatttcgacgaaaaagtggatcgagaggcgtcagctaacacttttatccagagaatgaagacaaccgacacgtaccttataggggaggatgtattgcctaaacagagcctgctctatcaaagttacgaagttctgaatgagcttaacaatgtgagggtcaacgacaataagctgtctttcgatcagaagcaacaggtgttgggagaactctttgagcgccataacaccgtcacaattaaacagttcgtggacaatctgttagcccacggtgattatgaccggatccccgaggttagaggcctggcagatgaaaagaggtttctatccagcctctcgacttacaaccagctgaaagggatccttcacgaggccattgacgattctgacaagcagaccgatatcgaaaagattatagcttggtccacaatcttcgaggacaaggccattttcaaaactaagttgaatgaaatctcatggctgaccgcaggaatgatcaacagtctcgctaacattcgctaccgaggctggggtcaatttagccataagctgttaaatgagctgacactttccaccgggcggactgtgttcgaggaattgctcatatctagccacaacctgatgcagatcctaacggacgaggtactgaaacagaagattgccgaactcaatgcgcatgagctgaaagcctcaggcatctatgctgcaattgatgacgcctacacaagtccatccaacaagaaagcccttcgtcaggtcttgagcgtgatcgatgacataaccaatgctgcaggacaagcgcctaactggctgtatatcgaaactgccgatggcgacggggttcccggaaagagaaccaattctaggcagcgcaagattcaggagatctacgctaacgccgcacaggagttaattacaggttcagtgcggggcgaactcgaggataaaatcgctagtagagccgactttaccgataggctggtcctttatttcatgcaagggggacgagacatatacactggcgaaccactgaatattgataacttgagctcctatgacatcgaccacattctcccccagtctctgatcaaggataattcgctagacaaccgcgtgctggtacatcctctcgtgaatcgggagaaagatacaatatttgcaagcacgagattcgccaagcagatgaacggtatgtggaggcagtggcacgctgcggggctgatctcctcacgtaaacttcgcaatttgcaaatgcggccagacgaaattgataagtacgccagtggctttgttgcaagacagctggtcgagaccaggcagatcattaagttaactgagcaaatcgtggctgaccagtacccggatgccaaaataattgccgtgaaggctggactctctagccagctgcgaaaagaacttgacttccccaagaaccgggaggtcaaccactatcatcacgcatttgatgccttcctggcggctcgcatcggcacatacctactcaaaagatatcctaatctggaaccatttttcacctacgggaagtttaagaaaacagaggttaagaaattgaagtccctgaaatcattcaacttcatcagggacatgactcatgccaaggataaaattgtggcaaaggagaccggagaaatcgtgtgggacaatgccagcgatattaacgagttagaccggatatataattttaagcgaatgctcatcacgcacgaagtaagattcgagaccgcttctctgtttaaacagacactttacgcagccaagaactccaaaaatcgcggtggcagtaggcaactgattcccaagaaaaaggggtatttggtcgacatctacggaggctacactcaggaaaccggtagctatctctctgtggttcgtctgacaaagaaagcgatgtacgctgtggtcaaggtgtccactcgggatgccgcaaaactagccgttgctaagtcaattagtgagcagaaagagaacgaaaccctgaagaagatcatagacgggaaacttagcaagacgtcgaaaaagggcaaaacaacccaccaactcttcgagatcgtgctgcctagagtaggacagaagactttgtttaaaaattccaaatataaccagttcctggtcaattctgatacatacatgcataactatcaggaattatggatgccaagggagtaccagcgcatgtggaaggacattctcctgagcaatcacggcgatgcccaacttgaagggcagctggaccagatctttaaattcattgtgtcacaggtgaacagttattttaatttgtacgatatcaaccaattccgaaagaaaatagcagacgctaccgataagtttgccaagctccccactcatgacaccgataacgcgagaggaaaaattgccacaatcggccagctgctaatcggtctgcaggcaaatgctatgcggtccgaccttaggaacctcgatattaagacgccgttcgggctgttgcaaataggaaccggcatcactttagacctggacacatctattatctaccagagccctaccggtctcttcgagcgcgaggtcccactgacagatctttga

SEQ ID NO: 3076 - RNA, 4092 nt, synthetic construct
  misc_feature 1..4092: note = Cas9 variant
  source 1..4092: mol_type = other RNA
atgagaggcaactaccacatcgggctggacattggaaccagctccataggttgggccgtgatcgatgacaatgctaaggtcatgagggcaaaaggcaagacagccattggggcgcggctctataacgagggacagactgctgccgatcgccgacttttccgtacgaccagaaggcggctgaatcgcagaaaatggaggttgaagttactggacgaaatctttgatccctacattacacctgttgacgcagccttctttgctcggctaaaacaatctaacctctcaccaaaggatcagaatcgcgactggactggcagtatgctgttcccggatcgaaccgacagaaagtttcataaagattatcccacaatctaccaccttaggcataagctgatgaccgaggaccaccagttcgatatacgggaaatctatttggcaattcatcacatcgtgaaataccgtggtaactttctcaatactacacctgtaagctccttctctgtgtcggacgtcaagtttgacgagcagttcgatcgcctgaacgaactgtatgccgctgtgtcaccagacgagccctttgccattaatggggataacagcaaagcgatcgagaccctcttactgagtgacgaaacgaagaagttcgataaacaaaagcagtccgcaaaacttatattgtctgagactggagacaaggccctggataaagaaaataccaaggttgctacacagattagcaaagccatcctaggctacaagactcagctcgacgtgctgcttaagtacgatgcaattaactcctcagcttggaaaatcgagctggacgatgagaatatcgacgacaccttgcctggcctcctgagtcaattagatgaaaacagacaggagatggtcagcattatacagaatctgtatgcccaggtgacactcaaccaaatcgtaccaaacgggatgtctctttccgaatcaatgattgagaagtacaatgcgcacagggaccatctgaaattgctaaagcagctggaagataaaatcgacgatcccaagaagaaaaagggactcgaggccgcatatgacgcttacgttggtaaaaacatgaaggtggccaatcaggatgtcttttatgctagcgtgaaaaagaacctggacgatagtgaccttgccaagcaaatagcagatctgattgaggcccagaaattcatgcctaagcagcggacctctcagaatggcgtgatcccacaccaattgcatcagctcgaactggaccagatcattgagaaccagtccaaatactatccgtggttaacggctgcgaatcccaaccctaagcgaatccaccaagcaaaatacaagctggatgagctagtcgccttccgcattccatactatgttgggcccctcgtgactcctgaggaacaggaaaagagcgctaatcaggtatttgcctggatgaaaagaaagcagccaggaacaataaccccctggaacttcgaccaaaaagtggacaggatggcatcggccaatcggtttatccgcagaatgactacaaaggatacctacctgattggcgaggacgtccttccggatgcttctttgatctatgaaaggttcaaagtgctgaacgagctcaatctggttaaggccaactaccaccgtcttgcacccgcgcagaaacaggctgcctatcgggacctgtttgaaaatcagaagtccatctcaacgaagaaattgcaaaactacctcgtggatcagggttatttcaccgcaaagcccaaaattacagggctgagtgacccagagcgatttaacagctccttaggaacttacatagatttcaaggaaatctttggcgaccaggtcgataatcctgacagacaagatgactacgagaaaattatcgagtggtctaccgtgttcgaagataggcagatttatgaggccaagctgcgcacactagactggctcactgaagaccagatccaggctctgaagaccaaacggtacaacggctgggggagacttagcaagaaattgctgacaggaatagtagatgagaatggtgagaggatcattgacgttctctggaacaccaatcaaaactttatgcaagtgcagtcacaggaaagtttcgccaagcgcatccatgaggcaaatgctaaacagatgaaggtcactggcgtggaagatattctggccgacgcgtatacgtcccctcagaacaagaaagccatccgacaggtcatacgggtggttgatgacattcagaaggctatgggaggggtggcaccaacaagcgtatctatcgagtttacccgttcagaagatcaaaatcccagaaggactcagagtcgcgagagccagttacaaaacaccttcaaagtcgacgccaaggagattgtggattccgacctggttacagaacttgagaccgtgtctaaatcgaagaagggcttgactgatcggctctacctgtatttcacacagctaggtaaagacatgtacacgggggaccctctgaatatcgatgaactcagcacctatgacatagatcacatcctgccacaggcttttattaaggacgattcccttgacaacagagtcttggtgtcaaaagccgtaaataacggcaagagtaataacgtgccggttaaactgttcggaggcaagatgggagggttttggaaagagttagcagatcataggctcatctctaagcgaaagctgaaacaccttctgactgaccccgatacaattgacaagtacaccatgcgcggtttcatccggagacagttggtcgaaacaagccaagtgataaaactcgtggcgcagattctgggcgataagtaccagaacgacgatactaaaatcatcgaggtcaccgccaagatgaatcatcagatgagggagaactttaagctaattaaaaatcgtgaagttaacgactatcaccacgctgtggacgcctacctgacggcattcgtggggcaatatctctacaagcgctatcctaaactgcggccatactttgtatatggaaatttcaagaaatttaacgaggatcatgtctccttcagatactttaatttccttcacgaattgatggacgagaacaataagaggatcgtggaacccgagaccggcgaggttgtgctggaacgagagcctgctattgcctacatgaagcgggtctatcattttaaattcatgttaatatcacaggaagtgtacacacgcagagatgcaatgttcaaccagactatctatccagccaaggaggctaataggcggaaactcattgcgatcaagcacggtaaacccgttgacgtgtacgggggctatagcggatctgtagatgcctacatggcaattgtccgaatccacgacaagaagggcgataaatataaggtggtgggggtcccgatgagagctctggagatacttaacgccacccatgacaaaaaggattacgacgccaaactgaagcagatcctagttcctaagtttacaaaagtgaagaaatcccgcaagactggagaaattaccaaaaaggtagaggatttcgaaatcgtgctcggtaaagtcatgtacaggcaactggtgattgacggcgataagaagtttatggttgggagtagcacgtatttgtacaatgctcgtcagctggtgttatctgactcctcactcgacacactggcaagtaaaggaacccttgatagcgacgccgattcgaagcggctggtcgcggtgtatgacgagatcgttgaaaaagtggataagtacttcccattgtatgacaaaaacgcttttagatccggcctccacaagggtagggataagtacctgctactgcccaatcgctctactttcaacggggccaaaaaggtccatagcggcaaacgagagatacttaacgagattctcaatggactgcacgcaaacgccacattgggcgggctgaaggacttaaaaatctcaaccccttttggaaagatgcagggccagagtggtatccccctctcctctaatactattatatgctatcaaagcccaaccgggctgttcgaacatagagtatcccttaaggatctgtga

SEQ ID NO: 3077 - RNA, 4092 nt, synthetic construct
  misc_feature 1..4092: note = Cas9 variant
  source 1..4092: mol_type = other RNA
atggagaacaatagatacaacgtgggcctggacatcgggaccagctccattggattcgccgtcacagatgaacaggacgagctcgttcaagtgaagggtaaaaattatataggcgtaaggctttttaaggaagggcagactgcttctgagcggcgctcattccgaacgacccgtagaaggctgaaacggcgcaagtggagattgggattactggaagagatctttgcaccctacctagcccagggcgatccttatttcctcgcgaggatgaaagagagtaacattagcccacgggacgaacgcaagaagtactatggttccctgcttttctctgatgacacagtgttctacgataaatatccgactgtctaccatctgcgacacgctttgatgaccgaggacagaaagtttgatatcagggaaatttacctcgccgtgcaccatatcataaaatatcgggggaatttcctgatcaacacactgattaatgagttttcgtcaaaggcagttgacttcaaaaaggatgccgacatcctcaacgatttatttgagcagttctacattagcgacatcaatgacagttttcaactgaacaccgctgatatgaatgaaatatccgagcttttgctggacaactctaagactcgtctagatcgccagagagaaagcctcaaaaagctggcaaagaaggtggacgatatttccgtcgccaaaaagcaccagaaaatcgctacagagttctcaaaggccattcttggaaataaggcgaaattcgacgtgatcctgaacgtaaccacggatagtagcaatgactggtcttttaagttggaagatgaggacgcagatgagaaaatcgttgtgctcctggaagagttaaacactccccagcaagaagccctgaacattatacatcagtggtattcccagatctcactcaatggcattgtccctgacggcaagagcatcagtgaggctatgatatcttcctacgaacttcacaaagagcacctggccttgctaaagcagcaaattaacaataccaaggacaaaaagaaagcacatgggctgcacgaggcttataacgaatacgtgcatggaaataacaataagaaactcaaccaggccgatttctatagcaaggtgaagcagaatctggagtcgtctcttatcacagacgaaatcctggagttgattaacgcggaaaattttatgccaaaacaaaggacttccgccaacggtgtcatcccccaccagctccaccagcaggagctggatcggattatacaaaatcaggcaaagtactaccctttcttagctgagaccaacccaaatgaaaaacgatcaaaggttgccaaatataagctggacgagctagtggcttttcgcgtaccctactatgtgggccctctcatcacagccaccgatcagaagaaaacgagtgggaaggaatttgcatggatggtcagaaaacagccaggaaggattactccgtggaactttgacgagaaggtgaacaaaatggagagcgccaatacattcatccggcgcatgaccactaaggattcctacctgatcgctgaagacgttcttcccgatgagtctttgctgtatcaaaaatttaaggtgctcaacgaactgaataaccttagagcggacggcaggaagctgaaagtcagcgtgaagcagaaagtattcaaggagttgtttcagcagcagaaaacaattaccatagttaagctccaaaattacctgaaggcagaatgctcattcttaacgacccctgagatcagtggtctgtccaaaccagagcattttgtgagctctctagccacatatattgatctcaagaaaatcttcggggaagacattgataaccccgctcgtcagaatgacttcgagcggatgatcgaatgggccactatatttgaggacaagaacatctactcagaaaaactgaatgagattaagtggcttaacgatcgacagaagaaagagttgaagaataaaaactaccacggatggggcaagctgagtgcaaaactcctgaagggcttaagagacagcgatgaatgttccatcattgagcatatgtggaatacccaacagaacttcatgcaggtccaagccgaagaggactttgctcagaggatccaggaagagaataaccagcacctgaaggggaacacacttgaggaagtgttggccgatgcatatacttctcctcaaaataaaaaggcgatacgccaggtcgtgaaagttattgaggacatccagaaggctatgggaggtattgccccacagaaaatctcgatagagttcacccgggcacccgaagagaagccgagaaggagcgtggaacgccaacagcagatcgagaaaatttacaagtccgtagccaacgaagtcgagaatgctggcgtgaaggatgaactccagcgattttcagaccggaaacaaacactgaccgataagtatttcctatactttactcagctggggaaagacatgtatacgggaaagagtatcaacattgatcagatcggcaattaccaaatagaccatattctccctcaggccttcatcaaagatgactctctggacaaccgtgttcttgtgagcgcagctgtcaataacggtaagtccgataatgtgcccacaaagaacgacagatataaagtaagggagcacgggcagcgcttgtacgatcagggcctgatctcaaagcggaaatttaataacttaattaccgacccagatagcatcaataagttcactgccagaggatttgtgaaaaggcaactcgttgagacctctcaggtcattcgactggtggcggagttcctttacaacaagtatcagtccaagagtgaaataatcgaagtgcgcgccaaaatgaatagccagctgcggaaggactttggcttgattaaaaacagaaacgtcaatgattaccaccatgctctcgacgcatatctgacaaccttcatcgggaactacctatataggcgttaccctaagctgcgcgcctatttcacttacggatgctttaaaaaggttgatgactctcaactcaagtacttcaattttctgcacgatattgaggacgacaaaaagaaaatcataaaggataacgacacaggtgaaatcctttggcatcgggatgagggcattgctagattcaaaaggatctataattttaagtacatgttggtgacgcacgaggtgctgacccgacagggggccatgttcaagcagactgtatattccgcagcggtcgccggaagtaaaaagttaattcccgtgaaagaagaccggccaatcgatatatacggcggttatacaaacaataacgacgcttttctcgccattgttaaggtgaccaaaaagaaacagtacatggtcgtggggatcccccaacgcgcagttgtgaagctgaatgatgctgccaagcagggctcaaaagcatatcagaaggtactttacaacgtcatcaaacctcagttcattaagaaaaagaaggacagaaaaacaggaaagataactcaaaaactggagaattttgaaatcgtggtgagcaagaccctatacaggcagctcattatcgatggcgaccagaaatatatgctggggtcgtccgcctacaagtataacgctaagcaattggtcctgtctgagtacgcgttagaagttctcgatcggagcattttcgagaaaaaggagtatacgaccgtggacctggataatgtatacgacgaaatccttgcccaggtggacaaatatttttcactgtacgataagaacaaattccgacagaagttgcacgagagtagaaagatattcacagaactcccaatcaataacctgttttccggaactaaactactgaagtctggtaaacgcgagacccttaatgagattctcgaaggcctgcatgcaaacgctacaaagaaagacttgaaaagcctgaaattctccactccgttagggatgatccagtacccctcaggaattatcctcagcgagaacgccatactgtgttatcaaagtcctaccggcatttttgaaaggcgtgtcacgcttaaggatctgtga

SEQ ID NO: 3078 - RNA, 4092 nt, synthetic construct
  misc_feature 1..4092: note = Cas9 variant
  source 1..4092: mol_type = other RNA
atgaccaagctgggcaaaccctacgggatcggagtggacattggtagcaactccataggcttcgccgctgtcgatgaaaattctcacctcatcagacttaaggggaaaacagttattggagcaaggctgtttgaagagggcaaggccgcggctgaccggcgcgcctcacgaactacgcgtagaaggttgagtcggaaccgctggagactgagcttcttaagggactttttcgaatcccatatcacccctacagatccaaactttttcatgcggcagaaatattctgagatttcgccgaaggataagtcacgctacaaatatgaaaagcgactatttaatgacagaactgatgcagagttctacaaatatgagaattgccccaccatgtaccacctcaggaaccggctgatgacagaccctagcaaggccgatgtgcgtgaaatctattttgctatacatcacatccttaaaagtcgcggtcatttcctgaccccaggggacgcaaaggattttaatactaacaaggtagccgtgaataaaattttccccgctttgcaagacgcctacgcgcaggtctaccctgatctcgacatcacatttgacgagaacaaggtgaatgagttcaaaaccgttctgctgaacgagaaggcaacgccatccgatactcagagagccctcgtgaatttactgcttgctaaagagggagacagggatattttgaagcagcaaaaacaggccctgaccgagttcgcaaaggctgtcgtgggcctaaagacaaaactcaacgtagccctgggcactgaagttgactctagcgaagcgaccgcctggaatttttcccttgggcagctggatgacaagtggacaggaatcgagtcagcaatgaccgatgaaggtacggagatattggaccagattcgggatctctatcgagctcgcctgttaaacggcatcgtgcccgccgggaaaactctgagtcaagctaaggtcgacgattacgcccagcaccacgaggacctcgaacttttcaaagactatctgaagcagttggaggatgacggaacagcaaaggccattagacagctatacgataggtatatcgacggcgatgacgctaaaccttttgtgcgggaagatttcgtgaaggcgctgaccaaagaggtcactgcacatccaaacgccaagagcccggaactcctggagcgccttgctcaacccgactttatgctgaaacagagaaataaggccaacggtgcaatccctgttcagatgcaacagagggagttggatcagattataaagaatcagtctgtgtactatgactggctcgccgctccaaaccccgtagaaaaacaccgtaagtccatgccttaccaactggatgagttactgaatttccggatcccatactatgtggggcccctagtcacagccaaagaacagaaggcagcgcagggaggcgtgtttgcttggatggttcgaaaagacccggatggcaacattaccccttacaatttcgacgagaaggtggacagagaagcctcagcaaacacgtttatccagaggatgaagaccacagatacttatctcataggggaggacgtcctgcccaaacaaagccttttgtaccagcgctatgaggtgctgaatgaactcaacaatgtacgggttaacaatgagaagctgagtattgaacagaaacagcaagtgatcagagagcttttcgagaggcataactctgtcaccatcaagcagtttgccgaaaatctgcgcgctcacggagattacgcccacatgccagagattcgaggtttggcagacgaaaaacggttcctctccagcctgtcgacatatcgtcagttaaagtctctgctacctgaggctatcgatgaccccgccaaacaggcggatattgaaaacataatcgcctggtccactgtgtttgaggacgctgcaattttcaagaccaagctcaaagagatcaactggctggattcacaaacaatcaccaaacttagtaatattagatacaggggctgggggcagttcagccataaatttttgaacggactgactctcggcaatggtcacacgataatccaggaactgttcttatccaacaataacctgatgcaaattcttacagacgagaccttgcagaagaaaatgactgaactcaatgccgataagctgaaggctgccaacatcaatgacgcaattgatgacgtctacacctctccaagcaacaaaaaggcgctacgccaggtgctgcgggttatcgaggacataaaaagagccgctgatgggcaggacccctcatggctctatgtggaaacagccgatggcggaggcacccctgggaagaggactcgagcacgccaacatcagctgcaggagatctacgctaatgccgcacacgagcttattgacagtgccgtacggggagaattggaggataaaatcgctgacaaggcggattttaacgacagactggtcttatatttcatgcagggtggcagggatatttacacagggacgccactcaatatcgaccaactgtccagctatgatatagaccatattcttccgcagtctctgatcaaggacaactcattggataatcgtgtgctcgttcacgccattatcaaccgcgaaaagaacgcaacctttgctagtactatatacgcccagaagatgaatgccacatggcggcagtggcacgaggctggactgatcagcggcagaaaactaaggaacctgcaaatgcgacccgaccagattgataagtatgcatccggtttcgtggcccggcagctcgtcgaaacccgccaaatcattaaactgacagagcagatcgtggcggctcagtaccctgagactaagataattgccgtaaaggcagggctttctcatcagttgagagaggaactggaatttcccaaaaatagggacgtgaaccactaccatcacgccttcgatgcatttttagctgcccggatcggcacctatctcctgaagcgattcccaaatcttcaagcgtttttcacgtacggaaaatttaagaaagctgacgttaagaaactgagaggcttcaacttcatccgcgatattacccacgccgaggacaagatcgtcgtgaaggatacaggggaggtgatttgggacaaaaagagggatgtcgacgaactagatcgtatatataattttaaacggatgctcatcactcatgaggttcacttcgaaaaggcagacctgtttaaacagaccgtgtacggagccaaggactcgaaggaggctggtggcaaaaagcagttgattagcaaaaagaaagggtatcctgtggatatctacggaggctatacacaggaaactggttcctacctgtcagtagtcagattaaccaagaaggccatgtacgcagtggttaaagtgagtacgagggacgctgccaagctcgcggtcgccaaatctattagcgagcaaaaggagaacgaaacactgaatgatatcatagacgagaaactttccaagatctcaaagaacgggaaaattacccatgaactgttcgaggtggttttgccacgcgtgggccagaagactctctttaaaaatagcaagtataacctgttcctagtaaattctgatacatacatgcacaactatcaggaactgtggatgccccgagagtaccagaaaatgtggaaggacatctcccttagtaagtatggagatgcacaaaccgaggaccagctcgatcagatttttggcttcatcgtcagccaggtcaattcttactttaacctgtatgacataaaccaattccggaaaaagttgaatgatgctgccgacaaatttgctactctgccgatgagagataccgacgacatgcaggggaagattgcaacaatcggacagttactcatcggcctgcaagccaacgccgctaggtccgatcttcgcaatctggacattaaaacgcctttgggtctcctgcagataccaaacgggatctcactagatagtgacaccagcgtggtgtaccagtcgcccactggactgcttgaacgtgaggttcatctctccgatctgtga

SEQ ID NO: 3079 - RNA, 4092 nt, synthetic construct
  misc_feature 1..4092: note = Cas9 variant
  source 1..4092: mol_type = other RNA
atgaccaagctgaaccagccctacggcatcgggctcgacattggaagcaattccataggtttcgccgtggtcgatgctaactctcaccttctgagattgaaaggcgagacagcaatcggggccaggttatttcgggaaggacaatcagcggctgaccgccgagagagtcgtactacgagaaggcggctgagccgcaccagatggaggctatccttcctccgggatttcttcgcccctcatattacaaagatcgacccagactttttcctgcgccagaaatattctgaaatttcgccgaaggataaagatcgatttaagtacgagaagagacttttcaatgacaggactgatgcagaattttatgaggcctacccctcaatgtatcatctgcggttgcgtctcatgaccgacgctagccaggcagatcctcgcgagatcttcctggccatacaccacatcctgaaaagtagaggccattttctcacaccaggtgctgccaaggacttcaacaccgatgaagttgacttaaaacacatttttcccgcgctggcagaggcctacgctcaggtgtatcctgaccttgaattgaatttcgattccgccctggcagacgatttcaaggctaaactactcgacgaggatgccaagccatctgacatccaaaaggcgctggtaaaccttctgttgagctccgatggggagaaagaaattgtgaagaaaaggaagcaggtcctcactgagtttgccaaagcaatcacaggactgaagaccaaattcaatttagctctgggcacggaagtggacgaggccgatgcttcaaactggcagtttagtatgggccagctcgacgataagtggagcaatatagaaacttctatgaccgaccaagggacagagattttcgagcagatccaggaactttaccgggcccgactgttgaacggaattgttcccgcaggtatgtccctatcacaggccaaggtggctgactacggccaacacaaagaggatctggaactctttaagacttatatcaaaaagctgaatgaccatgagcttgcgaaaaccatccgcgggctgtacgatagatatattaacggagacgatgcaaagcctttcttgagggaagactttgtcaaggccctcacaaaagaggtgaccgctcacccaaatgaggtaagcgaacagctgttaaaccggatgggccaggccaatttcatgctgaagcaacgcacgaaagcaaacggtgccataccggttcagctacagcagagagagctcgatcaaatcattgctaaccagagtaagtactatgactggctggccaaacccaatcctgtggaaaagcatagggcatctaagccataccagcttgatgagttgctgacttttcgtatcccctattacgtcgggcctctcataacaccaaaacagcaagcggaatccggagagaacgtgttcgcttggatggtgcggaagaatcccagcggcaacattaccccgtacaattttgacgagaaagtcgatcgagaagcctcggcaaacactttcatccagagaatgaagacaaccgacacgtatctgatcgatgaggacgttcttcctaaacagtctctgttgtaccagaagtatgaagtgctcaatgagctgaacaatgtaaggattaacaatgaggccttatccaccgaccaaaagcagcgcctgatccgggaagtgtttgagagacactcaagtgtcacaattaaacaggtggctgataacctagttgcccacggcgacttcgcacagaggcccgaaatacgcgggctcgctgatgagaagcgattcctgagctccctttctacttaccatcaattgaaagaaatcctgcacggagccattgacgatccaaccaagctccatgacatcgagaatatcattacatggagcactgtgtttgaggatgcggccatattcaaaaccaagctggctgaaatcgactggttagatcctgcaacaattaaaaagctgtcaaacatccggtatcgtggttggggccagtttagtagaaaacttttggacgggctcaaactgggaaatggccacaccgtcattcaggagctaatgctgtccaaccataacctcatgcaaatcctggccgatgaaactcttaaggagacgatgacagaattgaatcaggacaaactgaagaccgatgacatagaggacgtgatcaacgatgcttacactagcccctctaataaaaaggccttaaggcaggtactccgcgttgtggaggacattaagcacgcagcgaacggtcaggatccatcatggctgtatatcgaaaccgccgacgggcccggcacagctggaaaacggacccaaagtagacagaagcagattcagactgtctacgccaatgcagctcaagagcttatcgatagcgccgtgaggggcgaactggaggacaaaatagcagataaggcctccttcacagaccgattggtcctctactttatgcaagggggacgcgatatttatacgggtgctcctctgaacatcgaccagctatctcactacgatattgaccatatcctgccacagtcgctcataaaagacgatagcctggacaatcgggtgcttgttaacgcgaccatcaatagagaaaagaacaatgtgttcgcctccactttgtttgcaggcaagatgaaagctacatggaggaagtggcacgaggccgggctgatttcaggacgtaaattacgcaacctcatgctgcggccggatgagatcgacaagttcgccaaaggctttgtagctagacagcttgtcgaaaccaggcagattatcaagctgacagagcagatagcagccgcgcaatatcccaatactaagattatcgctgtgaaagccggtctaagtcatcagctccgagaagaactggatttccctaagaaccgggacgttaatcactaccaccatgcatttgatgccttcttggctgcacgcatcgggacctatctgttaaaaagatacccaaagctcacgccctttttcacctatggcgagttcgccaaagtggacgtcaagaaatttagggaatttaactttattggagcgctgacacacgctaagaagaacatcattgccaaagatactggcgagatagtgtgggacaaggaacgggatatccaggagcttgaccgaatttacaatttcaaaagaatgctgatcacccatgaagtacactttgatatggcagacttgttcgaccagacaatttacgccgctaaggattctaaagagcgcgggggaagcaagaacctcatccaaaagaaacagggttatctgactggcatatacgggggatattccaccgagaggggctcatacgtgagcatcattcgtacgtttaagaaaggtgcccctatctataatattgttaacatctctacagcagacgtctccctactgagtgataagcagcgggtgagcgaggcttctgccgacgtgcttctcaaagagctgataaagaagaaattggcgaagagaaaatccggggaaaataccaagtcaggcgccttcgagattgtcctgccaagggttggaaagaacactttatttaagaataagaaatacggcctcttcctggtggaaagtacaaccgagtttcataactatcaggagctttggctgccccgcaatgatcaaatgttgatcaagagcatccagtcgcacaaaattgaagagtccaaggcagactacgaactcactcgaatgtacagaaacatagcttctcaggtggatcactatttcgggctgtacaccatccggaaattcagcgagaagctaacagcctcaattaatgactatggagctctgccggtatacaagagtgaaacgaccgatggcaaatatgaggtcctttccaacctctttgagggtctggggtctggaactagcacaggcaatttgaccgcagtgaagttacagcctaacttcggtagggtttacctgacatccggcatcgtgctcgaagacgatacttcaattatctatcaaagcccaaccgggctgtttgagcgcagtgtcaaacttgccgacctgtga

SEQ ID NO: 3080 - RNA, 4092 nt, synthetic construct
  misc_feature 1..4092: note = Cas9 variant
  source 1..4092: mol_type = other RNA
atgaccaagctgaaccagccctacggcatcgggctcgacattggaagcaattccataggtttcgccgtggtcgatgctaactctcaccttctgagattgaaaggcgagacagcaatcggggccaggttatttcgggaaggacaatcagcggctgaccgccgaggcagtcgtactacgagaaggcggctgagccgcaccagatggaggctatccttcctccgggactttttcgcccctcatattacaaagatcgatccagactttttcctgcgccagaaatattctgagatttcgccgaaggataaagatcgatttaagtacgaaaagagacttttcaatgacaggactgatgcagagttttatgaagactacccctcaatgtatcatctgcggttgcacctcatgacccacacacataaagccgatcctcgtgagatcttcctggctatacaccacatcctgaaaagccgcggtcattttctcaccccaggggcagccaaagacttcaacactgataaggttgacttagaggacatttttcccgctctgacagaagcctacgcccaggtgtatcctgatcttgagttgaccttcgacctggcaaaagccgatgacttcaaggctaagctactcgatgaacaggccacgccaagtgacactcaaaaagcactggtaaatcttctgttgtcctctgatggagagaaggagatcgtgaaaaagagaaaacaggtcctcaccgaatttgctaaggccattacaggcctgaaaactaagttcaacttagcgctgggcaccgaggtggacgaagccgatgcaagcaattggcagttttccatggggcagctcgacgataagtggtcaaacatcgagacaagtatgaccgaccaaggaacggaaatattcgagcagattcaggagctttacagggctcggctgttgaatggtatcgttcccgccggcatgagcctatctcaggctaaagtggccgactacgggcaacacaaggaagatctggagctctttaaaacttatctgaagaaacttaacgaccatgaactggcaaagacaattcgaggattgtacgatcgctatatcaatggcgacgatgccaagcctttcctcagagaggactttgtcaaagctctgaccaaggaagtgactgcgcacccaaacgaggtatccgagcagttactgaataggatgggtcaggcaaacttcatgctaaaacaacggacaaaggccaatggggctatcccgattcagctccagcagcgcgaactggatcaaataatcgccaaccagtcaaaatactatgactggcttgcagcccccaaccctgttgaggctcacagatggaagatgccataccagttggatgaactgctcaattttcatattccctattacgtgggacctctgatcaccccaaagcagcaagccgagagcggcgaaaacgtcttcgcatggatggtgaggaaagaccccagtggcaatataacgccgtacaactttgatgagaaggtggaccgtgaggcgtctgctaataccttcattcagcggatgaaaacaactgatacctatcttatcggggaagacgtcctgcctaagcagtccttgctctaccagaaatatgaggttctgaacgaattaaataacgtgcgaatcaataacgagtgcctgggaacagaccaaaagcagagactaattagggaggtatttgaacgccacagctcggtgactatcaagcaggtcgccgataatctcgtggcacatggtgacttcgcccggagacccgagattaggggcctggctgatgaaaaacgcttcctttcttccttgtcaacctaccaccagctgaaggagatactccatgaagccatcgacgatccaacaaaactgttagacattgagaacatcatcacctggagtactgtttttgaggatcacacgattttcgaaacaaagctggcagagatagaatggcttgaccctaaaaagatcaatgagttgagcgggattcgatatcggggatggggccaattttcccgtaaactcctggatggtctaaagctggggaacggccacaccgtgatccaggaactcatgctgtctaatcataaccttatgcagattttggctgacgagactctgaaggagaccatgacagaattaaaccaagataaactcaagaccgacgatatcgaggacgtcataaatgacgcctacactagcccctcaaacaaaaaggcgctgagacaggtgcttagggtagttgaagatatcaaacacgccgctaatggacaggacccaagttggctgttcattgagacagcagatggcacggggaccgccggaaagcgcactcagtcccggcaaaagcagatccagacagtgtatgctaacgccgcacaggaattgattgacagcgcggtcagaggtgagctcgaggataaaatcgccgacaaggcttcttttaccgataggctggtgctatacttcatgcaaggcgggcgagacatatacacaggagcgcccctgaatattgatcagctctcacattatgacatcgatcacattctgcctcagagtcttatcaaagacgacagcttggataaccgcgtcctggtgaatgcaactataaaccgggaaaagaataacgtttttgcttccaccttattcgccggcaaaatgaaggcaacgtggagaaagtggcacgaggccggtctcatctctgggaggaaactgcgtaatcttatgctgcgcccagacgaaattgataagtttgctaaaggcttcgtggcgcggcagctagtagagaccagacaaatcattaagctcacagagcagatcgccgcagctcagtacccgaacactaaaataattgccgtcaaggccggactgtcgcatcaattgagggaggaactggactttcccaagaatcgagatgtgaaccactatcatcacgctttcgacgcatttttagccgcgcggatcggcacctacctcctgaaacgctatcctaaacttgctccattcttcacatacggggaatttgccaaagttgatgtgaagaaattcagagagtttaatttcatcggagcactgactcatgccaagaaaaacattatcgctaaggacaccggtgaaattgtctgggataaggagagggacatacgggagttggatcgaatctataactttaaaagaatgctcattacgcacgaagtgtacttcgagacagcagacctgtttaagcagaccatctacgccgcgaaagatagcaaggaacgcggcgggtccaaacagctaattcccaagaagcagggatatcctactcaagtatacggcggttatacacaggagtcagggagttacaatgctctggtgagggttgccgaagcagacaccactgcctatcaggtcatcaaaatatctgctcagaacgccagcaagatcgcatccgctaatcttaaatcacgtgagaagggcaaacaactcctgaacgagattgtggtgaagcagttggccaagcggagaaagaattggaagccaagcgcgaactctttcaaaatcgtcattcccaggtttggaatgggcaccctgttccagaatgccaagtacgggttatttatggttaactccgacacatattaccgcaattaccaggaactctggctgagtcgagagaaccaaaaacttctgaagaagttgttcagcatcaaatatgaaaagacgcagatgaatcacgatgcactccaggtgtacaaagctataattgaccaggtggagaagttctttaaactgtatgatatcaaccaattcagagccaagctatctgacgctatcgaacggtttgagaagctgccgattaataccgatggaaacaaaataggcaagactgagacacttaggcagatcctcattggtctgcaggcaaatgggacccgctccaacgtaaagaacttgggaatcaagacagacttaggcctgctccaagtcggttcaggcattaaactggataaggacactcagatcgtgtaccagagtcctagcgggcttttcaaacgtagaataccactggccgatttgtga

SEQ ID NO: 3081 - RNA, 4095 nt, synthetic construct
  misc_feature 1..4095: note = Cas9 variant
  source 1..4095: mol_type = other RNA
atgggcgacagaaagtacaacctggggctcgatatcggaaccagctccattggtttcgccgctgtggacgagaataaccagcccataagggtcaaaggcaagacagcaatcggggttcggctttttgaagagggaaaaactgccgcggatcgccgaggcttccgtacgaccagaaggcggctgtctcgcagaaggtggcggattaatttgttaaacgaaatctttgacgctcacctggccgaggtggatcctacattcctagcacgcctcaaggaatcaaatcgaagtaacctggaccccaaaaagagctttcaaggttcccttctgttcccggagagaaaggattatcagttttacgaggaatatcccactatttaccatttgaggaaagccctcatggagaaggaccggaaattcgattttcgtgaaatctatctggctgtacaccatataatcaagtaccgcgggaatttcctgaacggaacccctatgagatcttttaaagtggagaatattgagctcgacacattattcgatcagctgaaccagctttatgcagaaatcgtcccagacaatgagttggcctttgatctggctcaagtggccgacgttaaggacgtgctatcgtcaaccactatttacaagatggataaaaagaaacagctcgtcaagatgatgctgcttcccgcgagcaacaaagcactgcagagtgaaaataagaaaatcgtgacacagttcgtaaacgccatattgaattacaagttcaagctcgacgttctgttacaagtggagaccgatgctgactggtccctgaaactcaacgatgaaggcgccgacgataaacttgaggagtttacgggcgacctggatgaaaacaggttggagattatcgacctactgcagcggctccacaattggttctctctgaacgaaattactaaagatgggaatagcctttccgcagctatggtcgagaagtatgaaaaccatcaccaccatctgggattgctcaaaaaggtgatcgagaatcaccctgacgccaagaaagcgaaggccctgaaagagacctacacagcatatgtgggtaagactgacgataaaacccagaaccaggacgatttttacaaggctgtcgaaaagaatttagacgattcaccagacgccaaagagatcaagcgactgattcaactagatcagttcatgcccaaacagcgcacaggccaaaacggggctatacctcatcagctccaccagcaggaactggaccaaatcattgagaagcagagtaaatattacccatttcttgccgaaccgaatcccaacgttaagagaaggaaggatgcaccttataaattggacgagctgatcgccttcaagataccatactacgtgggacccctcgtaacccctgaggaacaggctcagaatggcgagaacgtgtttgcgtggatgaaacggaaggcagccggtccaattacgccctggaatttcgatgaaaaagtcgaccgcatggagagcgctaacagatttatcaggcgtatgactacaaaggatacctatctgttcggggaggacgtgcttccggccgaatctatgatctaccaaaaatttgttgtgctgaatgagttgaacaacctcaagattaatggacggcacctgtccttaaaggacaaacaggatgtctataacgacctgttcaagcagcagaaaactgtgtcaatcaaggcactacaaaattactatgtaacaaagaagaaggccgctaccgcccctacggttggcggcctcgcagatcccaaaaagtttctgagcagtctttctacctacattgacttcaaaaacatgttcggggaacgagtgaatgatccacagtttcaggaggacttggaacagatagtcgagtggtccacaatcttcgaggatagaggaatttttaaggcgaaactgcaagctctcggttggctgagcgaaaagcagatccagcaattagtggccaagaggtataaaggctgggggcgcctgtcgaagaaacttttgactggactcaagaacgcagagggctactctatcctggacgaaatgtggcggtccaccggtaatttcatgcagattcagtcaagacctgagtttgccgctctaatacagcaagccaacgaaaaacagttcgaggggaatgatcccgacaacgtctgggagaatatcgaaaacattctgggcgatgcatacacaagtccacagaataagaaggctatccgccaggtggttaaagtggtacaagacattgagaaggccgtcggaaacccacctgaaaagatcgcgatagagtttactagggaagccgctgcaaatccacagcgaacccagagccggctccgtacactggagaaactttatgagtccgccgaagaggtggttgatgctggcttgaccgccgaactggcagagttcaaagagaacaagcatgtgttatctgacaaatactatctctactttactcagctggggagagacgtctatacgggagatacaatcagccttgacaagctgaacgattacgacgtggatcacattttgccgcaatcattcatcaaggacgatagtctcgacaatagggtactgaccattcgcgcggtgaacaatggtaaatccgataacgttcccgccaagatgtttggcaaaaagatggggagcttctggcggtatctactggacaatggaatgatctctaaaagaaagtacaacaatctcataactgatcctgacaacatttcaaagtacgctcagaaaggctttatcaataggcagctggtcgaaaccagtcaagtgattaaacttacagccaacatcttgaatggtatatatgacaaggataccgagatcattgaagtgccagcaaagatgaacagccagatgcgaaaaatgttcgacctggtcaaggttcgcgaggtgaatgattaccatcacgctttcgacgcctatttaactatctttattgggaactacctctataagtgctaccccaaactgcagccttatttcgtgtacgataattttaagaaattcggcaacaaggaagacatcggacataaacggtttaacttccttggcaagatagagagagagaagaaagtagtcgcaccagaaacaggggagattctgtggtccaatgtggcccccaacgaaacgatcaagcagatcaaaaaggtttacgattataaatttatgattgtgtctagggagatcaccactcgtcgcgctgaactattcaatcaaacagtctacccgaagaactatcacggaaagctcattcctataaaagaggaccggccaaccgatctgtacggtggctattcggggaatacagacgcgtacttggccatcgtggcactggaggataagaaaaagggaaaatattttaaggttgtgggcattcccactagagtagctgccaaattagaaaagctcaagcagcaggacagccagcaatacctgcaggcccttcacaaagtcatcgctcctcagttcaccaagtccacgaaaaagggtattaaaaagaccgagtttgaaatcgtgctggataaggtgcattacaggcagttggtccaagacgggcccgttaaaatgatgctcggctcaagtacatataagtacaacgcaaaacagctggtgctatctgagaaggccctgcaggtaatagcggacgatcgaaaattcgacgaaactcagaaggatgacaatcttatcgctgtgtatgatgagattctcagcatcgtcaaccaatccttcgacctgtacgatattaatggatttcggaagaaattgaacgacaatcgcgatcagttcatcgacctgccagccgagaccaagtatgaaggcagaaaagtggttgcacacgggaagagggagatgatattagaaattctcaaaggactgcatgccaacgctgcatttggcaatcttaagcctatcggtttctcaacagcctttgggcagctgcaagtgcccaacggaatcattttgagcaagaatgcgatactcatccaccagtctccatccggcctgttcgagcggaaaattaagctaagtgatctgtga

SEQ ID NO: 3082 - RNA, 4095 nt, synthetic construct
  misc_feature 1..4095: note = Cas9 variant
  source 1..4095: mol_type = other RNA
atggagaagcaggaatactatctgggcctcgacatggggatcagctccgtgggatgggccgtcaccaacgataaatacgagcttctgagaaagaaaggtaaggacatgtggggcattagggagttcgaggaagctgattcttcagcagagcggcgcacacaccgagttaatcgtagaaggcggcaacgccaggtggccagaatggggttgttaaaagagtattttagtgacgcgatagaaaaggtagatagcaacttctttatcaggattgaaaattccaagtacttctttgaagacaaagatggacggctgtcttcgaagaacggcatcttcgacgatgctgactataaagatgtggactactatactgagtaccccacgatttttcatctacgcaaggccctcctggatatcgaggacaccggtaaagaatacgacgtccgacttgtgtatctggcattggttaatatgttcaagcacagagggcattttctcctgaacacagagggagatgccctgtcaagcgaacaggtgaatactacctaccaggagctcttagaaatactggagaacaattatgacatcagtcttgagtccagggatattaaggacgtcatcgatattatctctagctccgacaacggccggaaaaagaaacacgaacaaatattggagctgttcggcgtgaagaaatcagataagcgtgctaatgaactactcaaatgcctgtgtgggcttagtgtaaacgcaaagctgatttttgacgagaattacgaagagaaggttgatttgtgcttccatgactttagctatacagataaaatccctgacctcatggagaagctgtctgaagaggaatactatgtggtcgagcagttaaaatccatttacgactactcaatcctggccggaaccctcaagggttatgattaccttagctgtgctcgcgtggaactgtatgagaaacacagagaggacttgaagctactgaaggccctctacaggcggtataaaactaacgaagagtacaatgatatgttcaagagtgacaaagaaggcacatattctgcgtacgtgaactccttcaacagctcggattcttccgtcaagatcaaaaagtaccgatggaatatgaaggggcgcaccattgacaacctgtatggaacgatcaaaaaggcatttaaagataatactgacgataaggacgttcagtcaatgatggagagtatagataaagagcagttccttccaaagcaactgaccggcgccaacggtgtgattccgaatcaggtacacaagaaagaaatggagagaatcttgaagaaagctcagaactacctcccctttctgaaggaaaaagacgagagcgaattaacagtgtccgagaggatactgcggctattcacttttcagattccttattacgtcgggccactcggagaaaattctaagaccggctgggtggttcgcagagaaggcgggagggtgctgccctggaacatcgatgagaaaatcgacatgagcgccacatcagaagcattcattggaaatcttatccgtaagtgcacctatttgagtgacgagaaggtcatgcctaaggcttccctgagctacgaacggtattgtgtgctcaacgagattaataacatatgcatcgatggtgagcgactggacacggaacttaaacagaaaatttacactgagtgttttatgaagggcaaaagagtaacaaggaagcaaatctgcaattacctggttgcccaggggtgtatcaagtctgatgaacaagtgaccggaattgacataaacgtcaattcaagtttgagctcctatggcaaaatgttcgcgatctttggtgagcatctcaaggaagatgccattcgcaaagtggcagaggagatcatttactgggggactatcttctctgactcgaagaaaatgtttcggaagcacctgacaaagtatgtcgaacagggcatattaggagagagccaggtgaaaagaatcctgggctacaagttcaaagattgggggaggttttccaaggctctactcaccctgcagggaattgacaaatcaacgggtgaacttttgagtctggagaacgccatgtgggagtattctctcaacttcatggaactgatcaatagcgatgacttcacctttaaggatgagttagctaaccgccgaacatccgccattaagtcactgagcgagttcacttacgaggaccttgaagatacctatttttctgttccagtgaaacggatgatctggcaaacaatattggtagtccgtgagattgagcagatcatgggctacgcacccaagaaagtgttcgttgaaatggccagatccgaggaagagaagggggacaaaggaaggaaggacagtcgcggcactcagctcctggaactatacaaaaatattaagaacaccgagaatcatgattggaagaaagagatcagcgaagctaacgagtctggtaagctgcggtccaaaaagctctatctgtactatacacagatggggagagacatgtacaccggcgaagagataaatatcgatatgctttatgacgattcaatgtacgacattgatcacatctatcctaggcactacgtgaaagacgatagtattgtcaacaatttggtgctggtaaaccgacgcgcgaatcaagacatcaagaaggatttatacccaataccggacaaaattatcagcaaccccaaggtgcaggaactctggaaaatgctgcataagcagaatcttatcactgacgagaaatataagcggctgatgtcgagatccccttttacggagaagcagttgggagatttcattgcaaggcaactcgttgaaacacgtcagggcaccaaagggatcgccgagctgctaggacagctgtttaaggacactgaaattgtctacgctaaagccaccaacgtgtctgatttccgccgggacaatggttttgtcaagagcagactcgtgaacgatttccaccatgcacaggacgcctatctgaacatagttgtgggcaatgtgtactatacaaaatttaccaagaacccatggaatttcatcaagaaagattttgacaaggataggaacaaaaatgggtacaaccttgctaagatgttcgaccgagatgtagtccggggagacgatactgcctggattgcaagtaaaaaggacacacaaggcacgatcgagaccgtgcgcaagatgatgaggaaaaatactcccttgatgacaagaatgtcattcgagcagcacggtgggattgcgaacgctaccctgtattccgccaagaaagcaaaggttgaaaattacatccctttaaaatctagcgacatacggctctccgatgtgaagaaatacggcggatttacatcagccactgtcgcttattacttcatcgtgcatcacaaggagggcaagaaagaaaacaccacgattgaggccctgccactttattgcaagcgaaaagttgaaaatgaggagaacgggctgctaaagtactgtgaagaggtgctcggatatggcgacgtaaaaatcctgtttaataagttgaagattcagagcctgttagatatcaacggttaccaagcacacctcagtgggaaaaccggaaatcagctgacacttagaaacgctatgaacctgtgcgtccccgaaaagtggactgcctatattaaaaagttggagaaactcgtggtgggccatgtcaaggaacaggagatatcttccgaggcgaatatcgaactgtacgacctactgaccgataagcaccttaacagcgtttacgccaaacgcccgaatgcttatggtcagaagctcatcgacaacaggtcgcgtttcgtgaatctgaaacctgagtcacaatgcgaagcaattttgcagatactgaagttaacaaaaatcggcaacaatgagactaacctcaagctgattggggaatctgagcatagtggaaagatgcttatctccaaaaatctgaaggataccgacaaacccgccattatctgtcagagcgtaacgggcttgtacgagcggaagatatatatctttgatgaacagctcgacaaatga

SEQ ID NO: 3083 - RNA, 4095 nt, synthetic construct
  misc_feature 1..4095: note = Cas9 variant
  source 1..4095: mol_type = other RNA
atgaacaagagatacaatatcggcctggacattgggaccaacagcataggatggtccgtggtcaatgatcagtctcaactcgttaggatcaaaggtaaacttggctatggggtgcggctgtacgacgagggacagacagccgaagatcgccgattgttccgtactacgagaaggcggttaaaacgcagaaagtggaggctgggcctactccgggagatttttgaaccctatatcacccctcaggacgctacattctttctgcgccagaaacaatcaaaccttagtccaaaggatctgcagaagcagcagccgcaaattggtttgttcaatgaccgactcgatagcgactttcactaccagtatcccactatctaccatctgagatatgcactgatgaccgagaaaaggcagttcgatctccgggaaatatacttagccatgcaccatatcgtaaagtaccgtgggcactttctgaacgcggctgccgcatcctctttcaaatcgggagagattgaccttgccaaggattttgctgcattgaatcagatcttcggcacaatcttttcagaggtgggcttcagcctgagtgaatccaacctagacgagattaaatctatactcctggataataaccttagcgcctccgtccgccaaagaaaggctctgcctttgatttatcagaccgccgcgtcaaaggacagtgaaaaacagtacaaggcaatcgccactgagctcctgaaagctattttagggctgaaggccaaatttaatctcatcacaggaatcgaggtggaagacgttaaggcatggacccttagcttcaacgctgaggatttcgacgccaaactgtctgatttgaatattgcggacaacgatgacgccgtgcaaataatcgaaattctaagggcactgtattccggtgtcctcctgacgggcatcgtgccagaggggcagtcaataagccaggctatgattgataagtacgaagcccataaggctcaccttatcatgctgcggagtatccgagagcagttgtctgacaaagagaataaggccctcgaaaaagcatatgatgactacattgatcaccccgaggacaagcaacatggatcccgcgaagacttttatgccgctatcactaaagtactgaagaaggatagcgaggacaccaacattatagaaatcttaaaactgattgagctagatcagttcatgcctaagcagagaacaaaagacaacggcgcgatcccacaccagctccatcaacaggagctggatcagatcattgaaaatcagaagcaatactacccctggcttgcagacataaaccctaatgagcagaggcagaaaatggccccatataagttggatgaactggttacttttcgggtgccgtactatgtcggtcccatgatcaccgctgaggaacagttccaaacatcgaacaagaaatttgcctggatgattcgcaaggagcctggggcaatcaccccatggaatttcgaccagaaagtggatagacaggcctctgctaacgagtttattaagaggatgacgactacagacacctacctcctggccgaagatgtgcttcccaaacaatccctgttgtatcagcgtttcgaggtcctcaatgaactgaacggaatcaagatagacgatcagcctatcactgttgagcagaagcaagcaatttttaatgacaaattcatgcagcaggcgcacgtgacagtaaagaacatccaggcttacttagtgtcagagggccaatatgccagtcggccaaatattaccggcctgagcgacggggaaaaatttaactcctctctaagcacgtaccacgatctcaagaaaatcttcggagacatgatagatgaccccaataagcagaccgattttgagaaaatgattgaatggtcaacaatcttcgaggacggtaagattttcgcagataagctgcgagaaatcaactggcttactgacgagcagagacagaggttgagtaataaacgctaccggggctgggggcaactgtccaccaagctcctgacaaaaatagtcgatcagaacggacagagaatcattgacatcttatggaacactaatgataactttatgaggattatccatagcgacgatttcgaccaagccgtgacccaggctaatcagatgctgcttgccgacaacgatacacaggacgttataaatgagttgtatacctctccgtcaaacaagaaagcactccgccaaattctgctagtggtcgctgatatccagaaggccatgaagggccaggcgcctgcccgaatcctgattgaatttgctcgggagaaacaggcaaatccccgtctcagtactcaaagaaggcgccaggtggaacaggtataccaggagctgaacaatgaccaacttaacaaggaattggccgatccacagtatgctaatctgagcaaagaccggttattcctctactttatgcagggtgggagagatatgtatacgggcgagtccctgaacatcgacaggctttctgagtacgatattgaccacatactgcctcaggccttcatcaaggataattcgttggacaaccgagttctcgtgagcgcaaaaatgaatcgctccaagtcagaccatgtccccctggattttacagaggaacggttcggacaaaagatgagaagtcagtgggaacagatgctaagggcgggcctgctcacccgtcgcaaatataacaacctgactcttaatccagactctttgaacaagtacaccatgagcgggtttattaatcggcaactggtggagacaagacaggtcatcaaattagccaccaacctcctggtggatcagtacgctgacgaagatgttcagcttgtgactgtaaagtccggactgacacaccaaatgagggaggacttcgattttcccaaaaatcgaaacctaaataactatcatcacgccttcgacgcatacctcacggcttttgtcggtctgtatttgctgaagaagtaccctaaattagcccactatttcgtgtacggccagtatcagcaggggttcaaggcaaatgatcaatggcggaactttaatttcctcaacggactgcgccaggagcagcaggttgacgccgaaaccggcgagcttatttggcaaaaagatcatgacctggcttacatgaataagatctacgattttaaaaagatattggtgactagagaagtccacacaaaccatggtgcgctctataatcagaccctgtacaaagccaaggacgacaaggcatcagggcagggcggaaggcaactaatcgctgccaaagagaaccggccaacagccatttatggcgggtacagcggaaagactgtggcttatatgtgcctggtacgaatcaccgagaaaaagggtgatttctacagaatttgtggcgtgcagacggcatgggttgacgaacttgagcacatcgaagatgccaccataaaactccagcgcctgacagcgttgctgactccgcagttttctgctaccaagaagcaaaaagacgaggtcgtgacagtggtcaagcccttcgaagttttactccctaaaattctgatcaaccagaggttttatgatgggggacaggagcttactctggcctccgcaacctacaagaataacgcccaggagttggtgctcgacaaaaaggctgtgcaagtactgaatggccagctaccaaaggcagaactggaggcccaggcgacggtcgtgtacgatcagatccttgaacgtgttcaaaaatatttccccctctacgacatgaacagttttcgggagaagctgttcgtgggtagagataaatttaatgaattgccttggcaggaccagtgggagaaccacaagttaattcaggtcgggcaaaagacaatactggataggatcctcattggcctgcatgctaatgccgcaatgggagaccttaaggccctgaacatgagcaccccattcggcaagttgcagaaatctaatgggatctccctatcacccgagactcagattatctatcaaagtccgacaggactgttcgaacgccgagtggctctcaaggatctgtga

SEQ ID NO: 3084 - RNA, 4095 nt, synthetic construct
  misc_feature 1..4095: note = Cas9 variant
  source 1..4095: mol_type = other RNA
atgaagaacctgaaagagtactatatcggcctcgacattgggaccgccagcgtgggatgggctgtcacagatgaatcctacaatatacccaagttcaacggtaaaaagatgtggggcgttagactttttgacgatgcaaaaactgccgaggaaaggcggacgcagcgcgggtctcgacgtagactgaataggcggaaggagcgcatcaacttgttacaagacctgttcgcgaccgaaatttcaaaggtggatcctaatttcttcctaagactcgacaacagtgatctgtatagggaggacaaagatgagaaacttaaaagcaagtacacactgtttaatgacaaagatttcaaggaccgggattatcacaagaaatacccaactatccatcacttgattatggacctcatcgaagacgagggaaagaaagatatacgcctgctgtatctcgcttgccattacttactgaagaaccgaggccactttatcttcgaaggtcagaaatttgacaccaaaaattccttcgataagtctattaacgaccttaagatccatttgagagatgagtacaatattgacctggagtttaacaatgaagatctaatcgagataattacagacaccactctcaacaagacaaataaaaagaaagaactgaagaacatcgtaggggataccaaattccttaaggccatttcggcaatcatgatcggatcaagccagaagctggtggacttgtttgaggatggcgaatttgaggagacgactgtcaaaagtgtggacttctccaccacagcctttgacgataagtattctgaatacgaggaagctctcggcgacactattagcctgttaaacatactgaaatccatctatgattcaagtattctcgagaatcttctgaaggacgcagataaaagcaaggacgggaacaagtacatctctaaagccttcgttaagaaatttaataagcacggaaaagatttgaagaccctaaagaggataattaaaaagtatctgccgtccgaatacgctaacatcttccggaataaatcaatcaacgacaattatgtggcctacacaaagagcaacattaccagtaataaacgtacgaaggcgtctaaatttactaagcaggaggatttctacaagtttatcaaaaagcacctcgacacaattaaagagaccaagctgaactccagcgaaaatgaggatcttaaactgatagacgaaatgttgactgatatcgagttcaagacatttattcccaagctcaaatcgtctgacaacggtgtcatcccttatcaactgaagttaatggaactgaaaaagatcctagacaatcagtccaaatactatgatttcctcaacgagtcagacgagtacggcaccgtgaaggataaggtagaaagtattatggagtttcgcataccatattacgttgggcccctgaatcctgacagcaaatatgcatggatcaagagagaaaacacgaaaattaccccatggaacttcaaggatatcgtggaccttgattcctctagggaggagtttattgaccggttgatcggacgatgtacatacctgaaagaagagaaggtcctccccaaggccagcctgatatacaatgagttcatggtgcttaacgagctgaataacttgaaactcaatgagttcctgatcactgaagagatgaagaaagctatttttgaagagttattcaagaccaaaaagaaagtgacactgaaggccgtctcaaacctactcaagaaagaatttaatctgactggcgatatccttttgagtggtaccgacggggatttcaagcagggactgaactcctatattgactttaaaaatatcataggcgataaggttgaccgcgacgattacagaattaaaatcgaggaaattatcaagctcatagtgctgtatgaggacgataagacataccttaaaaagaaaatcaagagcgcatataaaaacgacttcaccgatgacgagattaagaagatcgctgccctgaattacaaagattggggcaggctttctaagcggtttttgactgggattgaaggagtagacaaaacgacaggtgagaagggctcaatcatatatttcatgcgcgaatacaacctcaatctgatggagctaatgagtgggcattacacctttactgaagaggtggagaaactgaaccctgtcgaaaatagagagctctgctatgaaatggtggatgagctgtaccttagcccatccgttaagaggatgttgtggcagtctctgcgtgtggtcgacgagattaagcggatcatcggaaaagatccgaagaaaattttcatcgaaatggcgcgagccaaggaggcaaagaactcgagaaaggaaagcaggaagaacaaattactcgagttttataagttcggcaaaaaggcttttattaatgaaataggtgaggagcgctacaactatctgcttaatgaaatcaactccgaggaagagtcaaaattccggtgggacaatctgtacttgtattacacccaactcgggagatgtatgtacagtctggaacccattgacctagccgatctgaagtctaacaatatctatgaccaggatcacatttaccctaaaagcaagatctatgacgattccctcgagaacagggtgctggtaaagaaaaatcttaaccatgagaagggcaatcagtacccaatacccgaaaaagttttgaacaagaatgcttatggattctggaaaatcctgtttgacaagggcttaattgggcagaagaaatacacacgcctcacccgacggactcctttcgaggaacgtgagctggccgaatttatcgagagacaaattgtggagacaaggcaggcaacgaaggaaaccgccaaccttctgaaaaatatctgccaggattcagagatagtctatagcaaggctgaaaacgcgtctcgcttccggcaagagtttgacattatcaaatgtagaactgtgaacgatctacaccacatgcatgacgcatacctcaatatcgtcgtgggaaacgtttacaatacaaagttcaccaagaacccactgaattttattaaagataaggacaacgtgaggtcctataatttggagaacatgttcaaatacgatgtagtccgaggtagttatacagcctggatagctgacgacagcgaaggcaatgtgaaggccgcaactatcaaaaaggttaagcgcgagctggaagggaaaaactaccggtttaccagaatgtcttatattggaacgggcggtttatacgatcagaatctcatgaggaaggggaaaggccagatcccccagaaggagaacaccaataaatccaacattgaaaagtatggaggctacaataaagcctcaagtgcttacttcgccctgatcgagagcgacgggaaggcaggacgtgagcgcacacttgaaactataccgatcatggtgtataaccaagagaagtacggtaataccgaagcggtcgataaatatctgaaggacaacttggagctccaggatcctaaaattctgaaggacaaaatcaagattaactcgctaatcaagctggatggctttctttacaatataaaagggaagacaggagactccctctctattgctggcagcgtgcagctgatcgtaaacaaagaagaacagaagttgatcaaaaagatggataagttcctggtgaaaaagaaagacaataaggatattaaagttacttcattcgacaacatcaaggaggaagagttaataaagctctataaaaccctgagtgataaacttaataacggtatttactccaataagcggaacaatcaagccaagaacatctctgaagcactggacaaatttaaggagattagcatcgaagagaaaatagacgtcttgaatcagattatcctcctgttccagtcctataacaatgggtgcaacctaaagtcaatcggcctgagcgccaagacgggagtggtgtttattcccaaaaagttaaattacaaagagtgtaagctcatcaaccagagtattacaggcctgttcgaaaacgaggtcgatttgttaaatctgtga

SEQ ID NO: 3085 - RNA, 4098 nt, synthetic construct
  misc_feature 1..4098: note = Cas9 variant
  source 1..4098: mol_type = other RNA
atgtacaagaaagactataccgtgggcctggatatcgggagcacatccgtcggattcgccgctattgacgatgactaccagcccataagactcaagggtaaaagggttatcggcgtgcggctttttgaggaagggaagactgcagccgagcgccgaaacttccgtacgaccagaaggcggctgaatcgcagaaaatggaggttgtctttactggaagagatttttgatccttatatggcgaaggtagacccaacattctttgctcggctaaagcaatcaaacctcttcccgaaagataagaataaaaagtttactggaagtctgcttttccccaaaaccacagacagcaagttttacgatgaatatcctaccatctaccatctgcgctatcacttgatgaacgactcccgaaagttcgatctcagagagatttttctggccatccaccatatagtgaaatacaggggcaatttcctgaactctgcaccaatcgcctcgttttcaactgacaagattaatctcgtcgatgacttcgagacagtgaacgctgcatacttacagatcaatagcagtaaccccgttcagctggacaccgatcaggccgaccaagtgtcccggattcttttggataataaactgtctaacctagacaagcagaaacaggctgccaaggcgctcgcacagaaaagcggtgataagaagcaagacaaaatcaataacacgactataaagcagatttgcaaagccctgcttgggtataagttcgatctggctgtcgtgttgaatatcgactccgatgaccacaacaaatggaagctccagctgtcagatgaaaacattgacagtcgtttagccgagctgaccggagaactcaatgaggcacagcttgacatcctgaacgtattgagccgcctatactctcaaatcacactgaatgatattgttccttccggcatgactctctcagaggctatgatagaaaagtataaagcccataagaaacacctgaagatgcttaaagactttgcgagaagcctgagtaagaaggattacggccaggtgatggaggcctatgcagaatacatcgggaacattccagagtctgcttccagcaaagcccagaagaaaatctcgcaagacgatttctataagaaaataaagaggtacttggacgattctaagctcggacagaaaattgctgaactgatcgccaagaatgagtttatgcccaaacagcggaccaaccagaatggtgtcatcccttaccaattacacctgaaggagctaaaccagattatcgaaaatcagtccaaatattacccatggctcgcagagctgaacccgaatgaaaagcgacgcggcaaagccaagtataaactttcagagttggtggctttcaggattccctactatgtggggcctctgataacacaggaggagcaacagaaaaccagtaacgcgaattttgcatggatgatcagaaagagcgagggacggattacgccatggaacttcgacgaaaaagtcgatcgcatcgccactgctaatagatttatcaagaggatgacaaccaaagacacttacctcattggcgaggatgttctgcccgcccattcccttctgtatgaacgtttcaaggtgttgaacgagctcaacatgatacgggtaaataaccaccgactgtctgtgggtcagaagcaggacgtctttgaaaaattattccaaaagcataaaacagtgaagaccagagagctgatcaaacagctaatggcaagcgggctccctacgcagccaaggattaccggactgtcagatcccgccaagtttaatacaagtcttggcacttacaacaatttcgctaagatcttgggcgacgagattaaccagccggaccgccaagaagattttgagaaaatcatagaatggatcaccattttcgacgataaggacatcctgaaaacaaagctctccgagctgagctggttagatgagaaacagattaatgccctgatcaacaagaattactctgggtggggacggctttcaagaaagttgctcactgaactgaccaacaaaaagggtcagagtataattgacaggatgtggaatacacaaaagagcttcatcgagattatcaacgaacctgtttttgcagagcagataaaggatgcgaatcaggaccagctagatgaagacgattatgagaccgtgctgcacgacgcttacacttctccccaaaacaaaaaggccatccgccaggtcattaaagtggtagatgacatcgttcgagcagccggccgggctccaaagttcatttccctcgagtttgcccgtgaagaccaggagtcgagaaggacgcagagccgcctgtcccggatcaagaaaatatatgaaacaaccactaaggagcttgtggcaaatgatcaaattagagaagagttggggaacgtcaaagacctgaacgataggttattcctctactttacccagctgggacgagacgcttatacaggcgagcgcatcaatatcgatgacatttcaaccaagtacgatatcgaccacattttccctcgggcctttataaaagatgacagtcttgataacaaggtgctggtcaagagagcggtgaataacggtaaatctaataacgttcccttgaaactcttcggggccaaaatgaagccaatctggaaaatgtggaaggaccatcagctgattagcaagaggaaatatgaacacctaatgactaatcccgacgctatcgataagtacaaagcaaacggctttattaatcgtcagctgatcgagacacgccaaataatcaagctcgccgctaacattctggccaatcggtactccacggaagacaccaaaatcattgaggtgaaggcaaaccttaatcatcagttgagacagtcactgcacttatataagaacaggcaagtaaatgattaccatcacgcggtcgacggatatctcagcgccttcgtgggccagtacctgtatcaccgatacccttctcttcagtcctattttgtttacgggcagtaccaacggttctttgataaacaggtgcaggaaaacatgaagttcaaccgcttcaattttctgtatgacctaactgatagagacaacgatcagatcgtcgtgaaaagtacaggagagatagtaggtgaaaagagcaaactcattgaacaaatcaagtgggtgtacaggtataagttcatgctggtttctcaggaggtctttaccaaaacaggcccattgttcgaccagactatctacccggctgggtccaataagtcacggctgattcccataaagaaggatcgacctaccgacatctatggaggctacagtagctcgacggatgcctatatgtccttaattagagtgccagacaaaaaggaagacaaatacaaggtggtcggtgttccctctcgcagcctcgcatcactgaacagggctgagaagcgtgggcatgatgcctaccttgaccagctgcggcaagtgatcgcaaaaagtcagaagaaagagtttcagattatcatacctaagttgagatataggcagctcatcattgatggcggactgaaatacaccctaggctcctctgcctatcaatacaatgctcgccagctggtgcttagcgaaaagtccatggaggtactcgtcacagacttctcaaaggtgactaccgatctggacaaacagaaccaaaagttgatcgcggtttatgatgacattctggataaagtgaatcgatgtttaccactctacgacaagaaccagtttagaaaagccctgaatggggcacgggataagttcgtccagcttcccatcctgccgaagtttaacggaaataaaaaggaagaggctggtaaagtggaaatattgaacgagattctcctgggcctacacgacgatgccagcacagggaatctgaagcctcttggaatcaaaactccattcggcatgctccagacccaaagtggtatcacgatgtcttccaacgccgttattgtgaatcagagccccacagggctgtttgagcataggatctatttgaaggctttactgaacaagctcaataaatga

SEQ ID NO: 3086 - RNA, 4098 nt, synthetic construct
  misc_feature 1..4098: note = Cas9 variant
  source 1..4098: mol_type = other RNA
atgaccaagctgaaccagccctacggcatcgggctcgacattggaagcaattccataggtttcgccgtggtcgatgctaactctcaccttctgagattgaaaggcgagacagcaatcggggccaggttatttcgggaaggacaatcagcggctgaccgccgaggcagtcgtactacgagaaggcggctgagccgcaccagatggaggctatccttcctccgggactttttcgcccctcatattacaaagatcgatccagactttttcctgcgccagaaatattctgagatttcgccgaaggataaagatcgatttaagtacgaaaagagacttttcaatgacaggactgatgcagagttttatgaagactacccctcaatgtatcatctgcggttgcacctcatgacccacacacataaagccgatcctcgtgagatcttcctggctatacaccacatccttaagagccgcggtcattttctcaccccaggggcagccaaagacttcaacactgataaggttgacttagaggacatttttcccgctctgacagaagcctacgcacaggtgtatcctgatcttgagttgaccttcgacctggcaaaagccgatgacttcaaggctaagctactcgatgaacaggccacgccaagtgacactcaaaaagcactggtaaaacttctgttgtcctctgatggagagaaggagatcgtgaagaaaagaaagcaggtcctcaccgaatttgctaaagccattacaggcctgaagactaagttcaatttagcgctgggcaccgaggtggacgaagccgatgcaagcaactggcagttttccatggggcagctcgacgataaatggtcaaatatcgagacaagtatgaccgaccaaggaacggaaatattcgagcagattcaggagctttacagggctcggctgttgaacggtatcgttcccgccggcatgagcctatctcaggctaaggtggccgactacgggcaacacaaagaagatctggagctctttaagacttatctgaaaaagctgaatgaccatgaactggcaaagacaattcgaggattgtacgatcgctatatcaacggcgacgatgccaaacctttcctcagagaggactttgtcaaggctctgaccaaagaagtgactgcgcacccaaatgaggtatccgagcagttactgaacaggatgggtcaggcaaatttcatgctaaagcaacggacaaaagccaacggggctatcccggttcagctccagcagcgcgaactggatcaaattatagccaatcagtcaaagtactatgactggcttgcaaagcccaaccctgtggagaaacacagagccagcaagccataccagttggatgaactgctcacctttaggatcccctattacgtcggacctctgattacgccaaaacagcaagctgagagtggcgaaaacgtgttcgcctggatggtgcgtaagaatccctctggcaacatcaccccgtacaattttgacgagaaagtcgatcgggaggcatccgcgaacacattcatacagcgaatgaagactaccgacacatatcttattgatgaagacgttctgcctaagcagagcttgctctaccagaaatatgaggtgctgaatgaattaaacaatgtaagaatcaacaatgaggctctgtcgactgaccaaaagcagaggctaatccatgaggtgtttgaacgccactcttccgtcaccattaaacaggtggttgataacctcgtggcccatggggacttcgcacagcggcccgagatcagaggactggccgatgaaaagaggttcctttcaagtttgagcacataccaccaactgaaagagattctccatggtgctatagacgattccaccaagctgcacgacatcgaaaatattatcacttggtctacggtctttgaggatgccgcaatcttcaaaacaaagttagctgagattgactggctggatccagccaccataaagaaacttagcaacatccgctatcgaggctgggggcagttttcacggaagttgctcgacggactgaaactaggcaatggtcacactgtgattcaggaactgatgctcagtaaccataatctgatgcaaatccttgcggatgagaccttgaaggaaacaatgaccgagctgaaccaggacaaattaaagactgatgacattgaagacgtaatcaacgatgcctacacatcccctagcaataagaaagctctccgtcaggttctgagagtggtcgaggacataaagcacgcagccaacgggcaggatccctcttggctttatatcgagacggctgacggcaccggaactgccggcaaaaggacacaatcacgccagaagcagattcagaccgtgtacgcaaatgcggcccaagaactgatcgatagtgctgtcagaggggagttggaagacaaaattgccgataaggcgagcttcacagaccggctcgtgctgtactttatgcagggaggtagggatatctatactggcgctccactaaacatagaccagctgtcccattacgatattgaccacatcctcccccagtctctgattaaggacgattcgcttgacaatcgagttttggtgaacgccaccatcaatcgcgagaaaaacaatgtattcgcaagcacgctgtttgcctccaagatggctgcgacctggcggaaatggcacgaagccgggttaatatcaggaagaaagctcaggaacctgatgcttcgtcctgatgagacagacaaattcgcacatggctttgtcgctcgccaactggtggagactcggcagatcattaagctaaccgaacagatcgccgccgctcaatatccaaatacaaagattatcgcagttaaagccggtctcagtcaccagctgagagaggaattggatttcccgaagaacagggacgtgaatcattaccaccatgcgtttgatgctttcctggccgcacgaatagggacttatttactcaaacggtaccccaagctggccccatttttcacctatggcgagttcgctaaagtcgacgtgaagaaatttcgcgagttcaactttattggagcacttacgcacgccaagaagaatatcatcgcgaaagatacaggcgaaattgtatgggacaaggagagagatatccaggaactggacaggatttacaacttcaaacggatgttgataacccacgaggtgcattttgaaactgctgatctcttcgaccagacaatctacgccgcaaaggactctaaagagcgagggggaagaatgagcctgattcctaagaagctaggttatctgaccggcatctacgggggatatcaaactgagcgcggctcctacgtttcaattatcaggacctttaaaaagggtgaaacaatatataaagtcgtgaacatccttacggccgatgtgagcctcctgtctgagaaggaaaaagtctccaagaccttggctgacatttacctgaaggagttaatcgccaaaaagctcagtaaaggcaagagcgggaaaaatattgcatctgaacccttcgagatcgttctgcctcgtgtgggaaaggattccctttttaagaacaaaaagtatggcctgttcttgatagagtcagctactgaactccacaattaccaggagctgtggctaccacggaacgaccagctgcttattaaaagaatccaggccaggcaaatcgaagagagtaaggcggattacgaactcacacgcatgtatcgaaatattgcctggcaagtggaccattactttagactgtataaaatacggaagttcgcagagaagttgcaggctagcgtagaggatttcgccgggttacccgtctacaaaaacgaaacctcggacggaaaggtggaggttctggcttccgtgctcaaaaggctgaatggcgcagccgataagggtcgcacaaacccgactaccgtcaaacttcagtctgactttgggcgtacgctgttgacaaatggaatcgtgctagaagatgacagctcaattgtttatcagagtcctaccggcctgttcaagagatccgtgaaactcgtagatctgtga

SEQ ID NO: 3087 - RNA, 4098 nt, synthetic construct
  misc_feature 1..4098: note = Cas9 variant
  source 1..4098: mol_type = other RNA
atgaccaaggagtactatctgggcctcgacgtggggacaaacagcgtcggatgggccgttactgattcccagtacaatctttgcaaattcaagaaaaaggacatgtggggtatcagactgtttgaatctgctaacacggcaaaagataggcggttgcaacgcggcaatcgacgtagattagagaggaagaagcagcggattgacctgctacaggaaatattctcaccagagatctgtaaaattgatcctacctttttcatccgcctcaacgaaagtagactgcaccttgaggacaagagcaatgattttaaatatccactgttcattgagaaggactactccgatatcgaatattacaaagagtttccgacaatattccatttgaggaagcacctcatcgaatctgaggagaagcaggacattcggctgatctatctggccctccataacattatcaaaactcgcgggcactttttaatagatggagacctgcaatcggcgaagcagcttcgacccattttggataccttcctgctatcactccaggaggaacagaatctgagcgtgagtctttccgaaaaccaaaaagacgagtacgaagagatcctgaagaatagatctattgctaaaagcgagaaggtaaagaagttgaagaacctctttgaaatctccgacgagctggaaaaagaggaaaagaaagcccagtcagcagtgatcgagaatttctgcaagtttattgtcggcaacaaaggtgatgtgtgtaagttcttaagggttagtaaggaggaactggagatagacagcttctctttttccgaagggaaatacgaggatgacatcgtgaagaatctcgaagagaaagtccctgagaaggtgtatcttttcgaacagatgaaagccatgtacgattggaacattctggtagacatcttggagacagaagagtatatatcatttgctaaggttaagcagtacgagaaacataagaccaatctacggctgctccgtgatattatcctgaaatattgcactaaggacgaatacaaccgcatgttcaacgatgagaaagaagcaggaagctatacagcctacgtgggcaaacttaagaaaaataacaagaaatactggatcgagaagaaaagaaatccagaagagttttataagagtctgggcaaattgctcgacaagattgagcccctgaaggaagatttagaggtcctgaccatgatgatcgaagagtgtaaaaaccacacgctactccctattcaaaagaataaagacaacggggtgataccacaccaggtgcatgaagtcgagctgaagaaaatccttgagaatgctaagaagtactattctttcttgactgaaaccgacaaagatggatactccgttgtgcagaagattgagagcatctttaggttccggatcccctattacgtaggtcctctgtcgacacgacaccaagaaaaaggctctaacgtgtggatggtccgcaagccagggagagaggacaggatttatccgtggaatatggaagagataatcgattttgagaaatccaacgaaaatttcattactcggatgaccaacaagtgcacatacctcatcggagaggacgtgctgcccaagcattcacttctgtacagtaaatatatggttttgaatgaactcaacaatgtgaaggtccgcggcaaaaagctgcctaccagcttaaaacagaaggtgtttgaggatctgttcgagaacaagtccaaagtaacgggtaagaacctactcgaatacctgcagattcaggacaaagatatccaaatagacgatctttctgggtttgacaaggatttcaaaactagcttgaagtcatatctggacttcaaaaagcagatctttggagaggaaattgagaaggaaagtatccagaatatgattgaggatatcataaaatggattacaatctacggcaacgacaaggagatgctcaaaagagttattagggccaattattccaaccagctgaccgaggaacaaatgaagaaaatcactggcttccagtacagcgggtggggaaatttttctaagatgttcttaaagggtatatcaggcagtgacgtgagcacaggggaaacctttgatatcattacggcgatgtgggagaccgacaacaatctgatgcagatcctttccaaaaagttcacatttatggataacgtcgaagacttcaattctggaaaagtgggcaagattgataaaatcacttatgactcgaccgtcaaggagatgtttttgagcccagagaacaagcgtgcagtgtggcagacaatacaagttgccgaagagattaaaaaggtgatgggttgtgaacccaaaaagatcttcatcgagatggctcgagggggcgaaaaagtaaagaagcggactaaatccagaaaggcccagctcctggagctatacgcagcttgcgaggaagattgtagggagctgattaaagaaatcgaggaccgcgatgagcgggactttaattcaatgaaactcttcctgtactatacccagtttggaaaatgcatgtacagtggcgatgacattgatataaacgaacttatcagaggaaattctaagtgggacagggaccacatttatcctcagagcaagatcaaagatgactccattgataacttggtcctggtgaataagacatacaacgccaaaaagtcaaacgagttactcagcgaagacatccaaaagaagatgcactctttctggctgtcccttctgaataaaaagttgataaccaagagtaaatatgatcgcctcactcgaaagggggacttcacggatgaggaactgagcggttttatcgcgcggcagctagttgagacacgtcagtctaccaaagccattgcagacatcttcaagcaaatttactcctcagaggtggtctatgtgaaaagtagcctggtatcggattttagaaagaagccactcaactacctgaaatccaggcgcgtgaatgactaccatcacgctaaggatgcctatcttaacatcgttgtcggcaatgtgtacaacaaaaagttcacttctaatcccatacagtggatgaaaaagaaccgggacaccaattatagcttgaacaaggtgtttgaacatgacgtcgttattaatggggaggtgatctgggaaaaatgtacataccacgaggataccaacacttatgacggaggcacactggatagaatcaggaagattgtggaacgagacaatatattatacacggagtatgcttactgcgagaaaggtgaactcttcaacgccaccatccagaataagaacgggaactcaactgtaagtctgaaaaagggccttgatgtcaagaaatacggaggctatttttccgcaaatacatcttacttcagcctgattgagtttgaagacaagaaaggggatcgcgcccggcatatcattggagtgccgatctatatagctaacatgctagagcactccccttcagcgttcctcgaatactgcgagcagaagggttatcaaaatgttagaatcctggtggagaaaattaagaaaaacagcttgctgatcattaatggctaccccttaaggatccgtggggaaaacgaggtcgacaccagttttaagcgcgcaatacagctcaagctggatcagaaaaattatgaacttgtgcggaacattgagaagttcctggagaaatacgttgaaaagaaaggaaattacccaatcgacgagaacagagatcacatcacacatgaaaagatgaatcagttgtatgaggtgctcctgtctaagatgaaaaagttcaacaaaaagggcatggccgacccttccgataggattgagaaaagcaagcccaagtttatcaaactagaagacctgatagacaagattaatgtaatcaacaaaatgcttaatctcctgcgatgtgataacgacactaaggctgatttgtcgctgattgagttacccaaaaatgccggttcattcgtcgtgaagaagaacaccatcgggaaatctaagataattctcgtgaaccaaagtgtcacgggcctgtacgaaaatcggcgcgagctttga

SEQ ID NO: 3088 - RNA, 4098 nt, synthetic construct
  misc_feature 1..4098: note = Cas9 variant
  source 1..4098: mol_type = other RNA
atggacaccgccaagacaaacaaacagccctactatatcggcctggatatggggactagctccgtgggatgggctgtcacggacgcatcttacaatgttgtgaagaaacacggtaaggccctctggggcgtaagacttttcgaggaagcgcaaaccgctgccgataggcggctgcatcgcacagcacgacgtagaatacagaggcggaaacagcgcttggccttactgcaggagctatttgctaaggaaatttgcaaggtggaccctgggttctttatcagactccacgagtcaaggctgtggcaagaagataaaagtattgaccagccaaacactcttttcaatgatgaggactttgatgacaaggcatatcataaagcctacccgaccatctatcatctgcggtacgctttgatgacagagaacaagagcttcgatgtccgcctcgtgtatctggccattcaccacatcataaaacaccgaggacattttctgctcgaaaattacgacttatccaaccaggagacctctggcttcgatgaatcgtacatcgcgctgactaatgcaattaaggagcttttgcagaaggagatccccgttggtcacgtggaaaagattcaaatcatactgaaggacaaatcactaagcaagagagagaaaacagaaaagattctccaggtctgggacgtgatcaaagataagcagctgaaggaggtagttcagcttatttgtgggggaaccgccaacctgagtacgttgtttatggacgaatccctcaaagaggctctgaaggtgttcgagatcaaagattctaagatcagcttttccactgccgtctatgaagagaaagaatcagacttacaaagtgtgctggagcagaggttcgatctcgtgtacgcagctaagatgctttatgactggagcctgttggccgaactaatgggcgatcggaagaccctgtctgaggcgaaaattgccatatacgagacacataagaaagacctcgaagtcctgaagcgtcttactcgccaggataaatccctgtatagaaagttgtttaggggcaccgacaaggattcatacagcgcatatgttgggagttgcatgatccacggagagaaactcgtgattgaaaagcggggttctacagaggagttctacaaattcctgaagaaagagatctccaagttacctgactgtgaggacaagatatacgtactgagcaaaattgaagctgagaattttctaccaaaggccgtgtcgaccatcaacggcatcattccctatcaactccaggaacaggagctggatatcattcttaaaaaggctgagcagtacttgcctttcctgatggaaaaagacgcctatgggacgatatctgagaagatcaaacaactcctgacttttcgcattccattctacgtcggaccccttaatcgacactccgataagtcatgggcagtgcatacagacaaggaaggcagaatcctgccttggaactttaatgagaggatcaacgaagagaaaagtgccgagaagttcattacccggatgactaataaatgcacatatttgctcggtaaggatgttctgccgaaaaacagcttactgtacaccgaatatatgctatttaacgagctcaataacgtgaagatagggaaggctggaacgtacctgaccgaagaacagaaagaaaaactttggaaagagttgttcctgacaactaagaaagtcaccctctccaagttttctaagttcctgatcaaagagggcattgacaaggaagaggcggtggaaatcaaaggcttagatgggggatttaagagctcactggcaccatggattgaccttaaaaatatcttgggtgaggatttcacacgcgacaaggccgaagagataatcaaggctattactctctttagtatggataaaaagatcctgaaaaagtacctaatgagaattgtatccgagcccgttgccaaacagctgagcaagctcaggtataccggctgggggcgtttctctaaagagttcctgacagaaatcacccctcgggtgactgacgatgtccaggtgcttgtcgacacgtcaacaggagaaataatgaacattatcaccgcattgaagaagaccagtctgaatttaatggagattctcagctccacttacggctattctgccgctatctcggaggccaacaaagaactggtgggtaatacagttcttagctacgagaccgtgaaggaactgactgtatccccagcagtcaaacgacccatatggcaaacattgaagatcattaaagagatcacgcacattatgggggcggaacctgctagaatctttatagagatggccagggacaagcagccagataagggccgcaccgactcacggaaaaagcagctcattgagctgtataaaaagtgtaaagaagatgtgagaagttggtctaacagggagagcaaggactgggttgaagagatcgaatccaagtcagatagccagctacgctctaataaactgttcctctactatactcaaatgggaaagtgcatgtacacaggcaaacccatcgacctgggggcacttttgaagggacagctgtacgatcgagaccatatttatccgcagtcccagaccaaagatgacagtttagataacctcgtgatcgtcgacaatcgggagaaccgtgataagagcaatacataccctctgtctaagaacattagagagaggcaaataggtttttggaaacttctgcgcgacaagggcttcatctccaaagaaaagtattttcggctaactagaaatacccccttctcagacgccgagaaagctgaatttattgccaggcagctcgtggagacgcgacagagtaccaaggcagtagctgaaatcctgaagcgcgtgttgccaaaaagcattatcgtttacgtcaaggccgggctgacatcgcggttcagacaatatggagagtttataaaagtgagggatttaaacgactaccaccatgcgaaggatgcctatctcaacatcgtgactggcaatgtccactacaccaaattcacatccaaccctattcgttttgttaaggactgtcagatctactctctgaatgagcacgctctttataaatacactgtggaacgcaacggtgtggtagcatgggcccccaatgaggaagggatgatgccaagcgtcacccggtggatgaacaagaataacattctggtgacgagaatgtcatatgttggccagggagagttgttcgatcagctccccctgaagaaaggcaaggggcaagtgagtctgaaaaaggagggagctatctccgacatatctaaatacggtggctataatagcgcctccacagcatactttatgtatgtcgaaggggaggataacaagggaaagcctgtgtacgttattgaaaccatgccactacatcttgcggccaggctcactacactggaggaaaaacagaagtactgcgaggagttgtggatgtcaaccggcggtaaactgaagaatccgaaagtgttaatcgaacagatccccattcagagcctcttcagtgtagacgggttccgagtcactatagctggcaagaccggaaagcaatatggctgtcggctggccgaggaacttgtgctgaacaatgggtacgcaatgacattgaaagctgtgctcaagtttgtcaaccgcagaaaaatgaataaggaggccctgatcacgtcttatgatcacctagaagagtcccagctgcttgcactctacgacgttttcctggataaattggagcatagctgcttttcgaagaggttctcaacccagcgggacgtgttaaagaacggacgagaatcttatattgccctgagtctcgaggacaaatgtcagatcctgtccgaaattcttcacctgtttcaatgcaacgctactttgagcaatctatctctgctcggcagctccaagcagtcaggtagactgtacatgagtaaaaaccttagcgataaggactcttggtatatcatacaccagtccgtaacagggttctacgagcaacatatccctttagcgccatacaaaaagtcatga

SEQ ID NO: 3089 - RNA, 4098 nt, synthetic construct
  misc_feature 1..4098: note = Cas9 variant
  source 1..4098: mol_type = other RNA
atggtgaagaaaaagtacgccatcggcattgacatagggaccaacagcgtcggatggtccgttgtgacagatgactataaagtaccctctaagaaaatgaaggtgttcggtaatactgagaagagatacatcaaaaagaacctgctcggcacgcttctgtttgatgaagggaataccgctgagaacaggcggttgaaacgcacagcacgacgtagatatactaggcggcgcaatagaattttatacctgcaggaaatcttcgccgaggaaattaacaagatcgacgattcatttttccaaaggctagacgatagttttctcatagtcgaggacaaacagggaagcaagcaccctatcttcggcaccctgcaggaggaaaagaaatatcataagcagtttccaacaatttaccaccttcggaaacaactggcggattcctctcagaaggctgacatccgcttgatttatctcgccctggcacatatcataaaataccgaggtcacttcctgtttgagggggatctcaagtcggaaaataaagacgtgcagcatttattcaacgattttgttgagatgttcgacaagaccgtggagggatcatacctgagcgaaaatcttccgaacgtcgccgacgtgttggtagagaaggttagtaaatccagaaggctggaaaatattctacactattttcccaacgagaagaaaaatggcctcttcggcaacttcctggctcttgcactggggttgcagcctaattttaagactaacttcgaactcgccgaggatgctaaaatccaattttctaaggagacatacgaagaggacctggaagagttactgggaaagattggtgatgactatgccgatctcttcatcgcgaccaaaagcctttacgacggcatcctgttggcagggattctatccacgactgattcaaccacaaaggccccactgagtagctctatggtgaaccggtatgaggaacacaaaaaggacctcgctctgcttaaaaattttatacatcagaacctgtccgattcatacaaggaggtcttcaatgacaagttgaaagatggatatgccggctacatcgaaggtaagactacccaggagaacttttaccgtttcattaaaaaggcaatcgaaaagatagaggggagcgactattttattgacaagatcgatcgcgaagacttcctcagaaagcagaggacatttgataatggaagtatcccccaccaaattcatctgcaggagatgcacgctatcattcggcgacaggccgagttctaccctttcttagtggaaaaccaagacaaaatagagaagatcctgaccttccgcattccatattacgtgggccccctagcgagaggcaaatctgaatttgcctggctcaataggaagtccgatgagaaaatccggccttggaactttgacgagatggtcgataaggaaacgagcgcagagaatttcatcactcgcatgacaaactatgaccagtacctgccagatcagaaagttcttccgaagcactcgttgctgtatgaaaagtttgctgtgtacaatgagctcaccaaagtaaagttcattgccgaagggatgagagactaccagtttctggattctggacagaaaaaggacatagtgaaaactcttttcaagacaaagaggaaagtcaccgctaaggatatcaaagcctatctggagaactccaatggttacgcaggcgtggagttgaaggggctcgaggaacaatttaacgcctcactgcccacgtatcatgacttactgaaaattctacgtgacaaggctttcatcgatgcggaagagaatcaggaaattctcgaggacatcgttctgacccttacattgtttgaggatcgggaaatgatacgaaagagactggagaaatacaaggacatcctcactgaggaacagaggaaaaagctggaacgccggcactataccggatggggcagattaagtgcaaaactgattaacggtatccttgataaggtgacaaggaagactattttggggtacctcatcgacgatggcaccagcaaccgcaatttcatgcaactgataaacgacgatacactatcctttgtcgacgagattcgactggcccagggatctggcgaggctgaagattatcgggccgaggtgcagaatctcgcagggagccctgccatcaaaaagggtattctgcagtcacttaaaatcgtagacgaattgatagaggttatgggatacgatccagagcatatcgtggtcgaaatggctcgtgagaaccaattcaccaatcagggcagaaggaacagtcagcagcgctacaagaaaattgaaaatgccatcaagaacctggactccaatttaaacagcaaaattctcaaggagtatcccactaataaccaagcactgcagaatgaccggctttttctgtactatttgcagaacgggaaggatatgtacacggacgaggaactcgatatcgaccaactgtctcagtatgatatagaccacattatccctcaggcgttcatcaaagatgactcactagataataaggtgctgacaaaaagtgctaagaacagaggaaaaagcgacgatgtcccatccctcgagattgtgcataagaagaaaaacttctggaagcagctgcttgactctcaattgatctcgcagaggaaatttgacaatctgaccaaggccgaacgaggcggtttaactaacgaggataaagcacgcttcattcagcggcagctcgttgaaaccagacaaataacaaagcacgtggccaggatcctggacacccgttttaatactaaacttgatgaggctgggaaccgcattcgggaccccaaagtaaatatcattacactcaagagcaacctagtctcccagttcagaaaagattaccagctctataaggtgagggaaatcaataactaccaccatgcccacgacgcatacctgaatgctgttgtggccacggcgttgctgaaaaagtatccgcagttagcccctgagtttgtctacggcgattatcccaagtacaactcatataaaagtcgaaagtctgctaccgagaaagtgctgttctacagcaatataatgaactttttccggcgcgtactggtgtattccaagactggagaagttagaatcaggccagtcattgaggtgaataaagaaacaggcgagatcgtgtgggacaagaagtcagattttcggaccgtccgaaaagttcttagctaccctcaagtgaacgtggtaaagaaagtcgaaatgcagacagggggattctctaaggagtccattctgcagcatggtgacagtgataaattgatccccagaaagactgagaaattttacctcgacaccaagaagtatggcgggttcgatagcccaacgatagcatactctgtgctgctaattgccgacatcgaaaaaggaaaggctaaaaagctgaaacgcgttaaggagcttatcggcattaccataatggaaaggatggccttcgagaagaatcccatcgagtttctcgaacacaaaggttataagaacattctggagaaaaacatcattaagttgcctaaatactccctgttcgaattagagaatgggcgtcggagactcctggcatcagcgaaggaacttcaaaagggcaacgagatgatcctgccaccgcacttggtgacactcctgtatcatagtagcaatatacacaaaatcactgagcccattcatctaaactacgtcaataagaacaaacacgaatttaaggagctgcttaggcatatctcggacttctccacccgctatattctcgcccaggatcgactgtctaaaatcgaagagttgtacgacaagaatgatggagacgatataagcgacttaacatcaagttttgtgaacctgctcactttcaccgctattggcgcccctgcagcttttaagttcctggggtccgttatcgatagaaaacggtacacgtctatcgccgaaattcttgaggcaacactgatccaccagagcgtgaccggattgtatgagactaggatagacctatccaagctgggcggtgattga

SEQ ID NO: 3090 - RNA, 4101 nt, synthetic construct
  misc_feature 1..4101: note = Cas9 variant
  source 1..4101: mol_type = other RNA
atgaagaaaccctacagcatcggcctggacattgggaccaactccgtgggatgggccgtcataacagatgactataaggttcctgctaaaaagatgaaagtgctcggtaatactaacaagaagacgatcaaaaagaatcttattggcgcactgttgttcgatgccgggaacaccgcggctgacagaaggttaaaacggacagcccgccgacgttacactagaaggcggaatcgcatcctgtatctacaggagatttttgcagccgaaatgaacaagctcgatgagtctttctttcacagactggacgattcattccttgtaccagaagacaaaggaggcagtaagtacccgatctttggtaccctggaggaagagaaggagtatcataaacaattccccacaatataccacttgagaaagagcctcgctgattccaaagaaaaggcagacctgcggctgatctatctcgccttagctcatattatcaaataccgcgggcactttctgtacgaggataccttcgacattaagaataacgatatccagaaaatatttaatgagttcacttctatttataacaatatctttgaagagtcgtcacttagcaacgaaaatgcccaggtggaggaaattttcacagacaagatcagtaagtccgcgaaaaaggaccgagtcttgaaactgtttcctgatgagaagtctaccggactattcagcgagttcctcaaactgatcgtgggcaacaaggcagactttaagaaacatttcgatcttgaagagatggccccactgcagttttccaaggacacgtacgatgaagacttggagtcactcctgggccaaattggggatgactatgctgatttattcgttgtggccaaaaagctgtacgacgcaatactccttgctggaatcctgagtgtcaaagatcccgccactaaggcgcctttgagcgcctctatgattgaaagatatgacaatcaccagaacgacctatccgcactgaagcagtttatcaggtcaaacctcccagagaaatacgctgaagtgttcagcgatgacagtaaggatggttatgccggctacatagacgggaaaaccacacaggagggattttacaagtatattaaaaatcaaatctctaagttcgagggcactaagtactttctggagaaaatcgaacgggaagatttccttcgtaagcagcgcacctttgacaacggttccattccccaccagatccatctgcaggagatgaatgctattttgcaaaaccaagggggatattaccctttcctcaaagccaataaggaaagaatagagcagatcctgacatttaggattccatattacgtaggcccgttagcacggggcaacagcgatttcgcctggctgacccgaaattcggacgatgctatccgcccctggaacttcgaggaagttgtggacaaagcgtcttccgcagaggattttatcaataagatgacgaactatgacctatacctccctgaagagaaagtcctgccaaagcactcacttttgtacgagactttcgccgtgtataatgaactgacaaaggtgaaatttattgctgaggccatgaaggattacgagttcctcgacagtgggcagaaaaggaagatagtcgaaaacatctttaaaaatcataggaaggttaccgaaaaggacattatcaactatctgcacaatgtggatggatacgacggtattgagatcaaaggcatagagaagcagttcaacgcaagcctttccacttatcacgatctgttgaaaatcattaaggacaaagaatttatggataaccccaagaatggggagatcctcgaatctattatccatacactgaccatattcgaggaccgggaaatgattaagcagttactggcccagtacaacagcgtatttgatgagaaagtgatcaaggctctatcacgcaaacactatacgggatggggcaagctcagtgccaaactgattaatggtatcagagacaagcaaaccgggaactccatacttgattacttgatggacgatggcaagagcaataggaacttcatgcagctgatcaaagacgatggactctcttttaaggagattatcgacaaagcacaggtcgtgggcgaaacagacaatctgcgtcaggttgtgcaaaacttacctgggtcaccagcgattaagaaaggaatcctgcagagtataaaacttgtcgatgagttggtgaaagtaatgggtagcgaccccgaatccattgttatcgagatggctcgggaaaatcagactaccaacaagggcaagtctaaatcgcagcaacgactcaagacactgagcgatgccatctccgagctagggtcaaatattctgaaagagcatccgactgacaacatccagctccagaatgatagactgttcctttactatttgcagaacggaaaggacatgtacaccggcgaagcactggatattaatcaattaagtaactatgacatagatcacatcattcctcaggcctttatcaaagacgattctctcgacaacagcgtgctgacatcctcaaaggacaataggggtaagagcgataacgtcccctctcttgagattgtggagaaaatgaaggggttctggcagcaactgttggactccaaactcatcagtgaacgcaagttcaataacctgaccaaagtcgagcggggcggactagatgaaagagacaaggtgggctttataaagaggcagctggttgagactcgccagatcacgaaacatgtggctcagattctcgatgcccgattcaatgcagaagtaaacgagaagaatcaaaaactgcggagcgtcaagatcattacacttaaatctaacttggtgtccaattttcgtaaggagttcgggctgtacaaggttagagaaatcaacgactatcaccacgctcatgatgcctacttaaatgcggtgatagccaaagctattctcaaggagtatccaaaactggaacctgagtttgtctacggagactaccagaagtatgatcttaaaaggtacatctcacgcaccaaggaccccaaggaaatcgagaaagcaactgaaaagtatttcttttacagtaacctgctaaatttctttaaagataaggtgtattacgccgacggtaccattatacagcggggcaacgtagagtatagcaaagatacaggggagatcgcttggaataagaaaagagacttcgccattgtgaggaaggttctctcgtacccacaggtcaacatcgtgaagaaaaccgaggaacaaactggaggcttttccaaggaatctattctgcccaaaggtaacagcgacaagttgatccctcgaaaaacaaagaatatacagctggatacgaccaagtacgggggcttcgactcaccagtgatcgcatatagtattttactcgtcgcggatgttgagaaaggaaagtccaaaaagctgaaaactgtgaagtctcttatcggcattacaatcatggaaaaggtgaaattcgaggccaacccggtagcttttctggaggggaagggataccagaatgtcgtggaagagaacataattcgcttgcccaaatatagcctcttcgaactggagaatggccggagaaggatgctagcctcctcaaaggagctgcagaaaggtaacgaaatggttcttcctagctacctcctggcattgctgtatcacgctaagaagatccaaaagaaggacgagccagaacatttagagtacatcaaacagcaccacagtgaatttaatgatctcctgaacttcgtgtctgacttttcccagaagtatgtccttgccgagagcaatctggagaaaattaagaacttgtacatcgataatgaacaaaccaacctcgaggaaatagcaaattcgttcattaacctgctaacatttactgccttcggggctcccgcggtgtttaaattctttggaaaggacatcgagcgtaagcgctactcaaccgttacggaaattctgaaagccacccttatccatcagtctataacaggcctctatgagactcggattgatctgagtaagttgggtgaggaatga

SEQ ID NO: 3091 - RNA, 4101 nt, synthetic construct
  misc_feature 1..4101: note = Cas9 variant
  source 1..4101: mol_type = other RNA
atggacaagaaatacaacatcggcctggatattgggaccagctccataggattcgtggccacagacgaggataatcacgtcatcagagctaagggtaaaaacgttattggcgtgaggctctttgacgaagggcagtctgcagccgagcggcgcggattccgaactacgcgtagaaggcttaatcggcgcaagtggagactgaacttgttaagggaaatctttgagccccatatttatcctatcgatgcgtcattctttatgcggcaaaaatacagtaatctgagcaagcaggacccaaaccagaagatagagttcaaagatatcctattttccgacaagtctgatgctgagttctatcgccagtacccgaccatttatcacctccgacaagccctgatgacagagaaaagacagtttgaccttagggaaatctacctggcaattcatcacatcgtaaagtatcggggccatttcttggatgagactcccaccgacaaattttcgttcgatcagctcgacctgacacaggaatttgagcgtctgaatgtcctcttctcagagcaaaaccctgaagaaccattcgaaatagtggtgaatcagaaccagagcattgaggacatcttaagtaatcagtccatgaccgcctctgatcgcagaaagcaagctctggttgtgttttaccagcagagcgaaaacaaggagaatgagaaacaatacaaggcaattgccactgaaatccttaacttgctgctaggtaataaagctaagctcaacgtcatcctggcccaggaggtggacaaagaagcggcaaaggattggtccctttcactgagtagcgagacattcgacgatgacttggaaaaagcctcttccgggctcaacgattcacagctggagatggtaggaatttttgagaggatatatagcagtttaatcctgaagtctattatcggcgaccacaattccctcagcgctgccatggttgataagttcaaaacccacgcacagcatcgggaccttctgaaggatgtgataaagaactcggacgctacgaagggcgaacaattgcagtttgcctacgaccactatctacagcgacattctgcggatgggaaagcctacggaaaggacgatttctataaggaggtcaaaaagaatctggacgattccgacgcagctcagcaaattcagcagctcatcgatactgaccagtttatgcccaaacaacgcaccaaggccaacggtgctatccctcaccaggtgcagcagaaagaactggatcttattatcgagaatcaatgccagtactatccatggctggccgaagagaaccccaattcagagagacacaacgtggcaaagtacaagttggacgaactcgtcagtttcagggttccttactatgtgggcccactgattagcccggccgatgacgagacagatccccaggctatacaaaatactaaatttgcgtggatgatccggaaggacgcacaggggcgcattaccccttggaacttcgacgataaagtagacagagaaaagtccgccgataaatttatcaagaggatgacaaccacggacacttacttaatcggagaggatgtgctgccagaccagtctctaatttatcagcgttacaaggtcctcaatgagctgaacaatgtgcggataaacggccgacccatcgaagttcaaattaaacagaatatctatacagatcttttcaagaaatttaagagcgtgtcagtcaaaaagttgagaagttacctggaggaaatgtcctattaccctggtagcttcaaaatttctgggctcaccaacccaggaaagttcgacaacggcctgacttcataccttgattataagaatatcctgggcgacagtgtggatgctaacgacaaaagggccgatatagagcagatgatcgaatggagcacaatttttgaggacaataagatcttcgcacagaaattggagtccatgacctggctcacggccgaacaacgcaaggctatttctcggaaaagatacaccgggtggggaaggctgtcgaacaagttactgacacagctaaagaatcaggacaaccgcagcatcatggatctcctgtgggagactgaagagaattttatgaaaatacagtccgcccccgacttctcaaagatgattgaagcacataaccaacagtttatcaaaaatgaggcgaacattcagcaagtaatcagtgatctttatacctctccgcagaataagaaagctatacgacagatcttgctggttgtggacgatattcagaaggccgtcggtcacgcacctgagcatatcgccattgagttcgctaagggcgaggacaaaaacccccggcgtacaatcagcagagaaatgaagatacaagatgtgtaccagcagatttccgacgatatcctcgtctcaccagaggtgagggcccagctgaatgagaaaatcgaaaaccgccacgggcggttaagcgacagactgtttctttatttcatgcaaggaggcagggatatgtacactggtaagcctattaatatcaacaacatttctcattatgacatagaccacatcttgccccaggcatttattaaagatgactccctcgataatcgagttctggtgagtgacaagctaaaccgcgaaaagagcgataccgtaccacgggacctgttcgggagagaaatgatgtctacatgggagaaaatggctgataggggcctcatcaccaagcgtaaactggccaatcttaagactattcccggatccatcgacgcgcacaaagcccagggctttataaaccgccagttggtcgaaacgcggcaagtgatcaagctggctgttgggattatgatcgatcagtaccctgagacacagattgtgtcagtcaaagcaaatttaacccatgagatgagagaaatgttcgacctcgtgaagaacagggatgtaaatgactaccaccatgcctttgatgcttatctgactgccttcgtgggaaactaccttctgcagcgatatccaaagttggagccgtacttcgtttatgacaaatttaagaaactcaaggaccaaaatatcagtatgcgggatttcaacctgctatacgacctgaaaaagaatgaagatgtctatgaccagcgcaccggtcacagcgcacacaagatatgggatcagcatggctcgattgactacatcagacacctctttgcgtacaaaaagatcctggtgtcccatgaggtgcaccaaaacgggggagccctttataatatgacagtctacggcaaagctgatgacgccaagaggaaattgattcccataaaggcagataagcctaccgaactgtatggtgggtacacttctcggaaattagcttatatggccatcgttaagacgaaaaagggcaaaaaggagcagtaccaggtgacaggagtgccagtaagcgcactcaccactctgcgacagttcaaggaggactcacccgaacaaaaacaggcccttgaggaaattgtcagacgcaactttgatgagaagacagaagtggagatcattgttcctaaagtgctgttcaatcagctaatcgtcgacgagaagtgtaggtttatggtgggcagtgatacctatcgttacaacgctcagcaactcgttctgtccgcggacgacttggaaataatcaacgcctctcataaagatattcagacaatcgacagctccgattactcacagcagctggaccaagtgtatcagaatattttaactatcgtagataagcacttcccaatgtacgacataaacaagtttcggaccaaactccacgatatttatgagcagtacatcgaactgcccaatgaggacgtctgggaaaacaataaacttacgaccctggggaaacatacaatcattatcagaatattgcaaggactccacgcaaacgctactgtggtggatctgaagcagctaggtattaaaaccccgttcggctttatgcagcaggccagggggatcgtcgttagccctgacgcccaactgatttatcagagtccaacaggactttacgagcgccgagtgagactcggcgatctgtga

SEQ ID NO: 3092 - RNA, 4101 nt, synthetic construct
  misc_feature 1..4101: note = Cas9 variant
  source 1..4101: mol_type = other RNA
atgggggacagaaagtacaacctggggctcgatatcggaaccagctccattggtttcgccgctgtggacgagaataaccagcccataagggtcaaaggcaagacagcaatcggggttcggctttttgaagagggaaaaactgccgcggatcgccgaggcttccgtacgaccagaaggcggctgtctcgcagaaggtggcggattaatttgttaaacggtatctttgacgctcacctggccgaagtggatcctacattcctagcacgcctcaaggagtcaaatcgaagtaacctggacccgaaaaagagctttcaagggtcccttctgttcccagaaagaaaggattatcagttttacaaagagtatcccactatttaccatttgaggaaggccctcatggaggaagaccggaaattcgatatccgtgagatatatctggctgtacaccatatcattaagtaccgcggaaattttctgaacggcacccctatgagatctttcaaagtggaaaatatcgagctcgacacattatttgataggctgaaccagctttatgaggaaattatcccagacaatgagttggcattcgatctggaacaggtcgccgacgtgaaggaggttctatcgtcaaccactatatacaagatggacaaaaagaaacaactcgtgaagatgatgctgcttcccacaagcaacaaagctctgcagagtgaaaataagaaaattgtcacccagtttgtgaacgccatcttgaattacaagttcaagctcgatgtactgttacaggttgagacggacgcggattggtccctgaaactcaacgacgagggcgcagatgacaagctggaagagttcactggggatctggacgaaaaccggttggagattatcgatctactgcaacgactccacaattggttttctctgaacgaaatcaccaaagacggaaatagcctttccgccgctatggtggagaagtataaagatcatcgccaccacctggagttgctcaagaaggtcattgaagaccatcctgacgccaaaaaggcaaaagctctgaaggagacatacactgcctatgtgggtaaaaccgatgacaagacacagaaccaggatgacttctacaaggcggtggaaaagaatttagatgactcaccagatgccaaggagataaaaagactgatccagctagaccaatttatgcccaagcagaggaccggccagaacggggcaattcctcaccaactccatcagcaggaactggatcagatcatagagaaacaaagtaagtattacccattccttgctgagccgaatcccaacgtcaagcggcgcaaagacgccccttataagttggatgaactgattgcttttaaaatcccatactacgttggacccctcgtgacgcctgaggaacaggcccagaatggcgagaacgtattcgcatggatgaagagaaaagtggccggtccaatcactccctggaattttgacaagaaagtcgataggatggagagcgctaaccgtttcattcggcgaatgacaaccaaggacacttatctgtttggggaagacgtgcttccggcggagtctatgatctacgaaaagttcgttgtgctgaatgagttgaacaatctcaaaattaacggaagacacctgtccttaaaggataaacaggacatatataacgatctgtttaagcaacagaaaacagtctcaatcaaggcactacagaattactatgtgaccaagaaaaaggccgctacggcccctaccgtaggcggcctcgcagaccccaaaaagttcctgagcagtctttctacatacattgattttaaaaacatgttcggggaacaggttaatgacccacaattccaggaggatttggagcagatcgtggaatggtccactatctttgaggacaggggaattttcaaggccaagctgcaggctctcggttggctgagcgaaaaacaaatacagcagttagtcgccaagcgctataaaggctgggggcggctgtcgaagaaacttttgaccggactcaagaacgcagagggctactctatcctggatgaaatgtggagatccacagagaattttatgcaaattcagtcaaggcctgagttcgcggctctaatccagcaggccaacgaaaagcaatttgagggtaatgaccccaacaatgtgtgggaaaacattgagaatatcctgggggatgcatacaccagtccacagaacaaaaaggccatacgccaggtcgtgaaagttgtgcaggacatcgaaaaggctgtaggcaatccccctgagaaaattgccatcgagttcactcgagaagcagctgccaacccacaacggacacagagccgtctcagaaccctggagaaactttatgaatccgcggaggaggtcgtggatgccaggttgactgctgaactggcagagtttaaagaaaataagcacgttttatctgacaagtactatctctacttcacgcagctgggacgcgacgtgtatacaggcgataccattagccttgaccggctgaacgattacgacgtcgatcatatcttgccgcagtcatttataaaagacgatagtctcgacaacagagtgctgactattagggccgtaaataacgggaagtccgataatgtgcccgctaaaatgttcggaaagaaaatgggtagcttttggcgatatctactggacaacggcatgatctctaagcgcaagtacaataacctcattaccgatcctgacaatatctcaaaatacgcccaaaaggggttcataaaccggcagctggttgagacaagtcaggtcatcaaacttaccgcaaatattttgaacggaatctatgacaaggatactgaaattatcgaggtgccagcgaaaatgaatagccaaatgagaaagatgtttgacctggtgaaggtcagggaggttaacgattaccaccatgccttcgacgcttatttaacaatattcattggcaattacctctataaatgctaccccaagctgcgtccttattttgtgtacggtaaattcaagaaattttccgataacgaagacatcgaggtgggggatggccgcttcaattttcttaaccggatcgaaagactgaagaacgtaacggacccagagaccggagaaattctatggtctaatgtcgcccccaacgagactatcaagaggattaaaaaggtgtacaattataaattcatgatagtttcgcgagagatcacaacccggcgcgcagaactctttaaccagacagtgtacccgaagaattatagaggcaaactgattcctatcaaggaggataggccaactgacttgtacgggggatatagcggtaacaccgatgcttacctggccattgtcgcattagaagacaagaaaaagggcaaatatttcaaggtggttgggatccccacgcgggccgctgcgaaactcgagaagctgaaacagcaggattcccaacagtaccttcaggccgtgcacgaagtaatagcacctcagtttaccaagtcaacaaagaaaggaatcaagaaaactgagttccgaattgtcctggacaaggtgcattacagacaattggtgcaggacggccccgtcaaaatgatgctcggtagttctacctataagtacaatgctaagcagctggttctaagcgagaaagcccttcaggtgatcaaggatgaccgcaaatttgatgaaacacaaaaggacgataaccttattgccgtatatgacgagatcctctccatagtgaatcagtcattcgatctgtacgacattaacgggttcaggaaaaagttgaatgataaccgtaatcagtttatcgacctgccagctgaaactaagtatgagggccggaaagtcgtggcacacggaaagagagagatgatcttagaaattctcaaaggcctgcacgccaacgcgagcttcgggaatcttaagcctataggatttgctacccccttcggccagatgcaatctaaaaacggtatcgagctgtccgaaaatgcctttttgattcatcagagtccaagcggcctcttcgagcacaagatcaagctgtctgatctatga

SEQ ID NO: 3093 - RNA, 4101 nt, synthetic construct
  misc_feature 1..4101: note = Cas9 variant
  source 1..4101: mol_type = other RNA
atgaccaagctgggcaaaccctacgggatcggagtggacattggtagcaactccataggcttcgccgctgtcgatgaaaattctcacctcatcagacttaaggggaaaacagttattggagcaaggctgtttgaagagggcaaggccgcggcttatcggcgcgcctcacgaactacgcgtagaaggttgagtcggaaccgctggagactgagcttcctgagggactttttcgaatcccatatcacccctacagatccaaatttcttcatgcggcagaaatactctgagatttcgccgaaggacaaggcacgctataaatacgaaaagcgactatttaacgatagaactgacgccgagttctatcaacagtaccccaccatgtatcacctcaggacacggctgcttaccgatccttcaaaagctgacgtgcgtgagatctactttgcaatacatcacatcttaaagagccgcggtcatttcttgactccagggtacgccaaagattttaatacaaacaaggtagctctcaatgaaattttccccgccctgcaggacgcgtatgcacaggtgtaccctgatctggacatcacctttgatgagaacaaggtcaatgaatttaaaacggtgctcttaaacgagaaggccactccaagtgacacccaaagagctctggttaatcttttgctggccaaagagggagacagggatattctaaagcagcagaaacaggtgctcacagagttcgcaaaggctgtcgtgggcctgaaaactaaacttaacgtagccctgggcaccgaggttgactcctctgaagcgacagcctggaattttagcttggggcaactcgatgacaagtgggcaggaatcgagtccgctatgaccgatgaaggtacggagatactggaccagattcgggatttatatcgagcccgcctgctcaacggcatcgtgcccgctgggaaaactctttcacaggccaaggtcgacgattacgcacagcaccacgaggacctggaattgttcaaagattatctaaagcaactggaggacgacggaacagccaaagctattagacagctctacgataggtatatcgacggcgatgacgcgaagccttttgtgcgggaagatttcgtgaaggcactgaccaaagaggtcactgcccatccaaatgctaagagtccggaacttctggagcgcttggcccagcccgactttatgctcaaacaaagaaacaaggcaaacggtgccatccctgttcagatgcagcagagggagctggatcaaattataaagaatcaggctgtgtactacgactggttagccgcaccaaaccccgtagaaaagcaccgtcagagcatgacatatcagctggatgagctactcaatttccggatcccttactatgtggggccactggtcaccgcgaaggaacaaaaagctgcccagggaggcgtgtttgcatggatggttcgaaaggaccccgatggcaacattacgccgtacaatttcgacgagaaagtggatagagaagcctctgctaacacctttatccagaggatgaagacaactgacacctatcttataggggaggacgtcttgcctaaacagtccctgctctaccaatcatatgaggtgctgaatgaacttaacaatgtacgcgttaacgataataagctgagcttcgaccagaagcaacaggtgttgggagagctctttgaacggcataacacagtcactattaaacagttcgtggataatctgttagcccacggtgactacgatagaatccccgaggtcaggggcctggcagacgagaagcgctttctaagttctctctccacctacaaccagctgaaagggatccttcacgaagctattgatgacgccgataagcagacagacatcgagaatattatagcgtggagcaccatcttcgaagataaagccattttcaagactaaattgaacgagatctcgtggctgaacgctggaatgatcaattctctcgcaaacattcgatatcggggctggggtcaattttcccataagctgttaaatgaactgacgctttcaacagggcgtaccgtgttcgaggagttgctcataagtagcagaaacctgatgcagatcctaactgacgaagttctgaagcagaaaattgccgagctcaatgctcacgaactgaaggcctccggcatctacgcagcgattgatgacgcctatacctctccaagcaacaaaaaggctcttaggcaagtgttgtcagtaatcgacgatataacaaatgccgcaggacaggctcctaactggctgtacatcgagaccgccgacggcgatggggtccccggaaaacgcactaatagtcggcagagaaagattcaggaaatctatgcaaacgccgctcaggagttaattacaggttccgtgaggggcgagtttgaagacaagatcgcgagccgagccgatttcacggaccgcctcgttctgtactttatgcaagggggacgggatatatataccggcgagccacttaatattgacaacctgtcttcatacgatatcgaccatattttgccccagagtctcatcaaagataatagcctggacaacagagtgctagtccaccctctggtgaatagggaaaaggacactatattcgcatccacacgttttgctaaacagatgaacggtatgtggcgccagtggcatgccgccgggctcatctcttcgcggaagctgagaaaccttcaaatgaggccagatgagattgacaaatacgctagcggcttcgtagcacgacagttggtggaaacccggcagatcattaagctgacagagcaaatcgttgccgatcagtatccggacactaagataattgcggtcaaagctggattatcctcacagctccgcaaggagctggattttcccaaaaatagagaagtgaaccactaccaccatgccttcgacgcatttcttgccgctaggatcggcacctatctgctaaagcggtaccctaatctcgagccattctttacgtatgggaaattcaagaagaccgaagtgaaaaagctgaaaagtttgaagtctctgaaatccttcaactttatccgagatatgacacacgcaaaggacaaaattgtcgccaaggagactggagagatcgtttgggataatgcgagcgacattaacgaattagatagaatatacaatttcaagcgcatgctcatcacccatgaggtgaggtttgaaacagcttcactgttcaaacagactctttatgccgcaaagaacagcaaaaatcgtggtggctctcggcaactgattcccaagaaaaaggggtacttggtggacatctacggaggctatacccaggagacgggttcctacctcagtgtagtcagactgacaaagaaagccatgtatgctgtggttaaggtgagcaccagggatgccgcaaaactagctgtcgccaagtctatttccgaacagaaagagaacgagactctgaagaagatcatagacgggaaactttcaaagacaagtaaaaagggcaaaaccactcaccagctctttgaaatcgtgctgcctcgcgttggacaaaagaccttgttcaagaatagcaaatacaaccagtttctggtaaattcggacacatatatgcacaactaccaggagttatggatgccacgagaatatcagagaatgtggaaggatattctcctgtccaatcatggcgacgcgcaaatcgaggggcagcttgatcagattttcaaatttatcgtgtctcaggtcaacagctacttcaacctgtacgacataaatcaatttcggaagaaaattgccgatgcaacggacaagttcgctaagttgcccacccacgatactgacaacgccaggggaaaaatcgctacaatcggccagctcctgattggtctacaggcaaatgccatgcgctcagatctgcgtaaccttgacataaagaccccgttcgggctcctgcaaatcggaacaggcattactttggatttagacaccagtatcatttatcagtcccctacgggtctgtttgaaagagaggtgccactcacagatctgtga

SEQ ID NO: 3094 - RNA, 4101 nt, synthetic construct
  misc_feature 1..4101: note = Cas9 variant
  source 1..4101: mol_type = other RNA
atgaccaaggactacagcctgggcctcgatatcgggacaggatccgtgggtttcgccgctcttgacactaactatagactgttgagggcaaaaggcaataacgtcattggggttcggttatttacgcccgccgagaccgcggaggagcgccgaggattccgtacagctagaaggcggctgtctcgcagaaggtggcggctaggcgccctcaatggtatatttgcacctgaactggccaaggtggatccaaacttccttcaccgcctgaaatacgcttgggtacatccggcagaccagcaaaataaggggaaatattcagccgctcccttgtttaacgatgccgcgctcgaccgacagttccacgatgactaccctactatctatcatctgagactgaagctcatgaccgatacaagtcagcacgacttaagggaggtgtacctggcaattcatcacatcattaagtttcggggaaatttccttcgtggcgaaggcccaatcaacgccagcgaggcttttgatataaataccttcatcgaccagatgactgccttttatgatcaagcattccccgactttaaaattgtcgaccaggtggatcagcagatcattttcaaggggttgacagacatgaccctgtcccctgctgatcgcgccaacaaagcgctaatgggattcaataacgccgcacaacagccaaataagagaatctttaaagctatactctctggtctggttggcaaccaggtggaccttatggccattttccagctggatgggatccccaaggaggaccaaaaggaatttaaattcaagtttgtcgataatgacattgaggaaaaattggctgccctcggagataaccctgcactgtcggacgagcagaacgagttcttaacgactctgtacgccgctttttcaggcctcacccttaagggtctgttgggggatgcgacaagcatcagtgcagccatggtggctaggtacgcctcccaccggactgactggacctatatcaaagaccatgtactaacaccacagaataaccgagaactgcgcctcgcatacgccgatctgatgaccgacaatgaggatgttagacttaaggctggaaagaagttcgccaaggcaattgaagcggctgacataccggccgcaaagaagtctgagtttagcctgaaaatcgataacaatgagttcttgcccaggcaacggacgaaggccaacggcactattcctcaccagctccatctgaatgaattacagcagatcatagagaaccaaggccagtattacccatttctgaaagctacattcgaacaggacgggcacaccctaaataagattgagggactcgtgaagtttcgcgtcccctattacgtgggtcctctggtgccaaaacacaaggtcgccggcaacaatgcaaaccattggatggttcccaaagaaccgggggctatcactccttggaattatacagagaaggtggatagagacaaatccggaaacgagttcatcaggcgtatgaccggcacggatacctaccttttgggtgaacccacactgccaaagaactcactcgtataccaggagttcaatgtgctgcaagaacttaacaatctgcggattgagaagcgaagattggacatcgccgtcaaacaggatatttttgaacacgtgttcaagactaacaaaaccgttacagtgaagaggatagaggaatatctcactaccgagtttgggagtcctgtcacactgagcggcttcgcgaatgtgaacgagcgcaaattaaattcttccctgtcaacctaccattattttgtaggaatcttcggcgccgaatttgttgacgatcccaagaacctaactctcctggagcagattgtggaacttcagacggtcttcgaggaccggaaggctttgcaaagacagctgaaactcaggccagagctgagcgaaaaacaggtgaaacagttagcacgcacacactacaccgggtggggacgactgagtcaaaaacttttgacttctaaaatcgtccatgtggccctcgagggtgaacgggagcccggccagtattccatcctggaaaccctatacgggacacagatgaattttatggagattgttaacgacatgaaggatcgttatggagtgaaaagctggctggaccaagaaaattcgggctctgaaaacaatctctccctgaagcagagaatacttgatatgcctggtccaaagaacatcaaaagggggattaatcaggctttccacatcattgacgagatcacccgcgccgtaggcaacgcaccgtcacggatatacatcgaatttgcgagagagagtcagcaaagcaatttgactaacgccagggtcaaccgactgaagcagttatactccaatcaggctctcaaaaaggagttcgccaaactggcatctgaaattaaggatcttacaaaggagcagctgaaagacgatcgcttgtatctctactatctgcaacagggaaaggacatgtacacggaaaccgatatcgacattactaaaatcagctcaaactatcagatagatcacattatcccccaggcttacacaaagaataacagtctagacaatcgggtgctggttaactccgagatgaatgccagaaaaagcgattctcctacctttctcccatcactgattcaagaaaggaaggcatggtggcgtcagcttcgcgacacaggcttgatgagtactatcaagtataacaatctgacccggacgagcgacgatttctccgccgaccagaaagagagattcatagctaggtctttagtggaaacccgacaagtcatcaagaacgtggcgacactcattaaagagtactacgatgactcgcaggtagaggccctgcccagcgaaatcactgcagagatgcggcgctatcttaatgtgagaaagaacagggatattaatgactaccatcacgctcatgatgccctgctatttgccaccgctggggagttctcccggaaagttggaatcatggaaaagggtcgagtctcagacggcgcagggaacatatataatagatacacaaaggatattatccagcgcgccagggcgaaagctggacaggacaagaaagtgcgtccttttactttcatcgtgggcagtatggccaacccagataccaagtttcaaacgaaccagacaaccggtgagattgtctggactcccgaagacgttgcatatctccggaaagtgatcgactacaagaaaatgctggtgacaaagatgaccttggatcagactgggaccctgtataatgagacaagatacggctctggagacaagcacgtagccgtcgctttaagcaaagataaggcagccgacctctacggcgggttcggatccctgaaaccggcgtatgctgcccttgtgtactcaaagaaaaagtttaggctggttaacgtgttgcgcctctggctgcctgaaattaagaaaaatgcaagcgtcctagagcgaaaggtgcagtctgttctgggcgatgacaacgccaaagtgataagagctcacgtaccatgcggtcaacttctcatcaaggatggggccctggtcacggtgtccagtgcaaccgaattgcataatttccggcagctgtggttacccaaagctgactatcaggatattagcatcctcctgggagcccctgacaaggtgactgcggagaacaggcttcaggccgagtctcactttgatgacgtcgatcaacgcttcgaatccctgttgaaggacgttattgaccaggcacgtcagtactatcccctcaaaacacatcagacctcactggagaagctaatcggcaaaataggtaagtttgatgaactgaaattcgctcaaaagcaacaggtgttcagtagacttctcagcgccctgcacgctaatgcaacaaactcggacttgaagcagatcggcttatccactgcctgggggcggctgatttacccaaaaggagtatctctcaccgatgaggacaagctgatcaatagctcatttacgggccttttcaacgatgtgatgagtattaaagaatttcatgacttctccatcaattga

SEQ ID NO: 3095 - RNA, 4104 nt, synthetic construct
  misc_feature 1..4104: note = Cas9 variant
  source 1..4104: mol_type = other RNA
atgaagaaacagaagttcagcgactactatctgggctttgatatcgggaccaactccgtgggatggtgcattacagacctcgattacaatgtccttagattcaacaaaaaggacatgtggggttctaggctgtttgaggaagccaaaactgctgcagagcggcgcgttcaacgaaattcacgtagaaggttgaagcggcgcaagtggagattaaacctgctagaagagatattcagtaatgaaatcctcaaaattgatagcaactttttcaggcggctgaaggagtcctctctttggctggaggacaaatcgtcaaaggaaaaatttacgttgttcaatgatgacaactataaggattacgacttttataagcagtaccccaccatcttccacctccgcaatgagctgattaaaaaccctgaaaagaaagatatccgactggtgtatctcgccatacatagcatctttaagagtagaggccacttcttatttgaggggcagaatctgaaagagattaagaacttcgaaacactttacaataacttgatcgcgttcctggaggacaatggaattaacaaaatcatagataagaacaatattgaaaagctagagaaaatcgtatgtgactccaagaaaggcctcaaggacaaagaaaaggagtttaaggagattttcaactctgataaacagctggtggctatctttaaacttagcgtcggttcctcagtgagtctgaatgacttgttcgatactgacgaatacaaaaagggggaggttgaaaaagagaagatcagctttagggaacaaatttatgaggatgacaagccaatatactattctatcctcggagagaaaattgaactgttagatatcgccaagtccttctacgactttatggtgctgaacaatatactcgcagattcacagtatattagcgaggccaaagtcaaactttacgaggagcataaaaaggacctgaagaacttgaaatatatcatccggaagtacaataaaggcaactacgataagctattcaaagacaagaatgaaaacaattatagtgcttacattggcctgaacaaagagaaggggaagaaagaggtggtagaaaagtctcgtctcaaaatcgacgatctgattaaggttataaaaggatatcttccgaagcccgagcgcatcgaagagaaggacaaaaccgtgtttaatgagattctgtccaagatcgaattgaaaacaatcctccctaagcagagaattagcgataacggtaccctgccataccagatacacgaggtcgaattagagaaaatcctggaaaatcaatcgaagtattacgacttcctaaactatgaggagaacggcgtgtctactaaggataaactcctgaagacatttaaattcaggattccctactacgtggggcctcttaattcctatcataaggacaaaggaggcaactcatggatcgtccggaaggaagagggtaagattttgccatggaattttgaacagaaagttgatatcgagaagagtgcagaagagttcataaaacgaatgaccaacaagtgcacgtacctgaatggggaggacgtgatccccaaagatactttcctctatagcgaatacgtaattctgaacgagcttaataaggtgcaggtcaacgacgaatttctgaatgaggaaaacaaacgcaagatcattgatgagttgttcaaggagaataaaaaggtgtccgaaaagaagtttaaagagtatctcctggttaagcagatcgtggacggaaccatagaattaaagggcgtcaaagattctttcaacagcaattacatttcatatatcagatttaaggacattttcggcgagaaactgaacctagacatctacaaggagataagtgaaaaatccatcctctggaagtgtctgtacggggatgacaagaaaatttttgagaagaaaatcaagaatgaatatggagatattcttacaaaagacgagatcaagaagataaacactttcaaatttaacaattggggtaggttgagcgaaaagctgctcaccggcattgagttcatcaacctggagacaggggaatgctactcttcagtgatggatgccttacggcgcaccaattataacctgatggagcttttgagtagcaaatttacgctccaagaatccatcaataacgagaataaggaaatgaacgaggcttcttacagagacctgattgaggaatcgtatgtaagcccttccctaaaaagggccatcttccagactctgaagatttacgaggaaatacgtaagatcacaggacgggttccaaagaaggtgtttattgagatggcgcgaggcggtgatgaatcaatgaaaaataagaaaatcccggcaagacaggagcaactcaagaaactgtatgacagttgtgggaacgatattgccaatttctctatcgacataaaggagatgaagaacagccttatctcctacgataataactcattgaggcagaaaaagctgtacttatattacctccagttcggcaaatgcatgtataccggacgcgaaattgacctggatcggcttctgcagaataacgacacttacgacatcgatcacatttatcccagaagcaaggtcatcaaagacgattcttttgacaacttggtgctcgtcctgaagaatgagaacgctgaaaagtccaatgagtaccctgtgaaaaaggagatacaagaaaagatgaagagtttctggaggtttctaaaagagaagaacttcattagcgatgaaaagtataaacgcctgacaggcaaggacgattttgagctccgagggttcatggcccggcagctggttaatgtgcgtcagaccacgaaagaagtaggaaagatccttcagcaaatcgagccagagattaaaatagtctactctaaggcagaaatcgcttcctcatttagagagatgttcgactttattaaggtgagggaattgaacgatacccaccatgccaaagacgcgtacctgaatatcgttgccggtaacgtgtataatacaaagttcactgagaaaccctaccgctatttacaggaaattaaggagaactacgatgtcaaaaagatctataattacgacatcaaaaacgcatgggacaaggagaatagtctcgaaatagtgaagaaaaacatggagaagaataccgtaaacattacacggtttatcaaagaagagaagggccagctgttcgatcttaatcctattaaaaagggggaaactagcaacgagatcatatcgattaagccaaaagtgtataacggaaaggacgataaactgaatgagaagtacggctactataaatccctaaaccccgcttacttcctctatgttgaacacaaggagaagaataaaagaatcaagtcttttgaaagggtcaacctggtggacgtgaataacatcaaagatgaaaagagcttggtcaaatacctgattgagaataagaagttagttgaaccgcgagtgatcaaaaaggtgtataaacgccaggtaatactcattaaccattacccttattcaatcgtcaccctggacagtaataaacttatggatttcgagaacctgaaacccttgtttctcgaaaataagtacgagaaaattctgaagaacgtgatcaagttcctagaagacaatcaaggtaaatccgaggagaactacaagtttatatatctgaaaaagaaagatcggtacgaaaagaatgagacacttgaatctgttaaggacagatataacctcgagttcaacgaaatgtacgataaatttctggagaagttggacagcaaagattataagaattacatgaacaataaaaagtatcaggagctgttagacgtgaaggaaaaattcattaagctcaacctgtttgacaaagccttcacccttaagtcctttctggatttgttcaataggaaaactatggctgacttttcaaaggtcgggctcacgaagtacctgggcaaaatccagaagatcagcagtaacgtgctatctaaaaatgagctgtaccttctcgaagagtccgttacaggactgttcgtgaagaaaattaagttgtga

SEQ ID NO: 3096 - RNA, 4104 nt, synthetic construct
  misc_feature 1..4104: note = Cas9 variant
  source 1..4104: mol_type = other RNA
atgaagaaacagaagttcagcgactactatctgggctttgatatcgggaccaactccgtgggatggtgcgtcacagacctcgattacaatgttcttagattcaacaaaaaggacatgtggggttctaggctgtttgatgaggccaaaactgctgcagaacggcgcgtgcaacgaaattcacgtagaaggttgaagcggcgcaagtggagattaaacctgctagaggaaattttcagtgacgagataatgaaaatcgatagcaactttttcaggcggctcaaggaatcctctctgtggcttgaggacaaaaattcgaaggagaaatttacgctgttcaatgatgacaactataaggattacgacttttataagcagtaccccaccattttccacttgcgcgatgaactcatcaaaaatcctgagaagaaagacattcgactgatctatctggccctccattcaatatttaagagcagaggccacttcttatttgaagggcagaacctgaaagagatcaagaatttcgagacactttacaacaatttgattagtttcctggaagacaacggaatcaataaatccattgataaggacaacatcaagaaactagagaagataatttgtgattctggcaaaggtctcaaggacaaagaaaaggagtttaaggaaatcttcaacagcgataaacagctggtagcgatttttaaactttccgtggggtcaagtgtcagcctgaatgacttgttcgatactgacgagtacaaaaaggaggaagtggagaaagaaaagatctcttttagggagcaaatctatgaagatgacaagccaatttactattccatactcggagagaaaatcgagctgttagatattgctaagtcattctacgactttatggttctgaacaatatcctcagcgacagtaactatatatctgaagccaaagtgaaactttacgaggaacataaaaaggatctgaagaatttgaaatatattatccggaagtacaacaaagagaattacgacaagctattcaaagataagaacgaaaataactatccggcatacatcggcctgaataaagagaagggcaagaaagaggtcgtggaaaagtccgggctcaaaattgacgatctgatcaaggtaattaaaggatatcttcccaagcctgagcgtatagaagagaaggacaaaaccatctttaacgagattctgaataagatcgaattgaaaacaatcctcccaaagcagcgcattagcgataacggtaccctgccctaccagatacacgaggttgaattagagaaaatcctggaaaatcagtcgaagtattacgacttcctaaactatgaggagaacggcgtgtctactaaggataaactcctgaagacatttaaattcaggattccttactacgtcgggccacttaattcctatcataaggacaaaggaggcaactcatggatcgtgagaaaggaagagggtaagattttgccctggaattttgaacaaaaagtggatatcgagaagagtgccgaagagttcataaaacggatgaccaacaagtgcacgtacctgaatggggaggacgtcatccctaaagatagcttcctctattccgaatacattatcctgaacgagcttaataaggttcaggtgaacgacgaatttctgaatgaggaaaacaaacgaaagattatcgacgagttgttcaaggagaataaaaaggtatctgaaaagaagtttaaagagtatctcctggtgaaccagatagctaatcgcactgtcgaattaaagggaattaaggatagcttcaactcaaattacgtgagttatatcaaatttaaggacattttcggcgagaaactgaacctagatatctacaaggagatatccgaaaagagcatcctctggaagtgtctgtacggcgacgataagaaaatttttgagaagaaaatcaagaacgaatatggggacattcttaataaagatgagatcaagaagataaactctttcaaatttaatacctggggaagattgtcagaaaagctgctcacaggtattgagttcatcaacctggagactggcgaatgctacagtagcgttatggaggcattaaggcggaccaattataacctgatggaacttttgtcctctaaatttacactccaggagtcgatcgacaatgggaacaaggaaatgaatgaggtgagctaccgcgatctgattgaggaatcctatgtctcaccaagtctaaaaagagccatcctgcaaaccctcaagatttacgaggaaataaagaaaatcacgggaagggtgccgaagaaagtattcattgagatggctcgtggcggtgacgaaactatgaagaacaaaaagatccccgcccggcaggagcagctgaaaaagctatatgattcttgtgggaatgacattgcgaactttagcatcgatataaagaaaatgaagtcctcattgagctcttacgacaataactccctgcgacagaaaaagttatacctctattacctgcaattcggcaaatgcatgtatacaggaagagagatcgaccttgataggctgttgcagaataacgacacctacgatattgaccacatctatcctcgcagtaaggttattaaggatgacagcttcgataacctcgtgctggtccttaaaaatgaaaacgcagagaagtctaatgaatacccagtgaaaaaggagatccaggagaaaatgaagtccttttggcggttcctgaaggagaaaaactttatatcagacgagaagtataaaagactcactggcaaggatgacttcgaactgagggggtttatggcccgccaacttgtcaatgtgcgacagacaaccaaagaggttggaaagattttgcagcagatcgaacccgagatcaagattgtgtacagtaaagctgagatagccagctcgttccgggaaatgtttgatttcatcaaggtacgtgagctgaacgacacgcaccatgcaaaagacgcttacttaaatattgtcgccggtaacgtgtataataccaagtttacagaaaaaccttacagatatctccaagagatcaaggaaaactacgatgttaaaaagatttataattacgacatcaagaacgcgtgggataaagaaaattccctggagatagtgaagaaaaacatgaagaaaaatactgtcaacatcaccaggttcattaaggaagagaagggccagctttttgacctgaatccaatcaaaaagggggaaacatctaacgagattatcagcataaaacccaagctatataacggaaaagaagagaagctcaatgagaagtacggctactataaatcactgaacccggcctacttcttgtatgtggaacacaaggagaaaaataagcgcattaaaagtttcgaacgggtaaacctggtggatgttaataacatcaaggacgagaagtccttagtcaaatacctcatcgagaataagaaactggtggaacctagacttattaagaaagtgtataagaggcaggtcatcctgataaacgattacccctattctattgttgcattggacagcaataaactcatggattttgagaacctgaagccactattcctggaaaataagtacgagaaaatccttaagaacgtgattaaatttctcgaagacaatcagggtaagtccgaggagaactacaaattcatctatctgaagaagaaagatcgatacgaaaagaatgagactttggaatcagtgaaagaccgctataacctggagtttaacgaaatgtacgataagttcttagagaaactcgacagcaaggactataagaattacataaacaataaaaagtataaaaacctgcttgatgtaaaggagaaatttattaagctgaatttgttcgacaaggcttttaccctcaaaagtttcctggatctatttaaccggaagacaatggccgacttctctaaagtcgggctgaccaagtaccttggcaaaatccaaaagatctccagcaatgtgctctcgaagaacgaactgtacttgttagaggaatcagttactggactgtttgtgaaaaagattaaactctga

SEQ ID NO: 3097 - RNA, 4104 nt, synthetic construct
  misc_feature 1..4104: note = Cas9 variant
  source 1..4104: mol_type = other RNA
atgaagaaacagcaattcagcgactactatctgggctttgatatcgggaccaactccgtgggatggtgcgtcacagacttcaattacaacgttctcagatttaataagaaagatatgtggggttctaggcttttcgacgaggccaagactgctgcagaacggcgcgtgcagcgaaactcacgtagaaggctgaaacggcgcaagtggagattgaatttactggaggaaatttttagtgatgagatactaaagatcgacagcaacttctttaggcggctcaaagaatcctctctgtggcttgaggataagtcgtcaaaagagaagttcacgctgtttaatgacgataactataaagactacgatttctataagcagtaccccaccatttttcacttgcgcaatgaactcatcaagaaccctgagaaaaaggacattcgactggtatatctggccctccacagcatcttcaaaagtagaggccactttttattcgaagggcagaatctgaaggatataaagaacttcgagacactttacaataacttgatggcgtttctggaggacaatgacatctacaagaacattgattcctcttatatcggaaacctagaaaatattatctgtgacagcaaaaagggcctcaaggataaagagaaggagttcaaagagatatttaactccgacaagcaactggtgggtttctttaaactttcagtcgggagtagcgtgtctctgaatgatttgttcgacactgatgaatacaagaagggagaggttgagaaagaaaagatttcctttagggagcagatctatgaagacgataaaccaatttactattcaatcctcggcgagaagatcgagttcctggacattgctaaatcattttacgatttcatggtgttaaacaatatactggccgacagtcagtatatctctgaagcaaaggtcaagctctacgacgagcataaacgggatcttaagaacctgaaatacattatccgtaagtataataaagaaaactacgacaagttgtttaaggataaaaatgagtccaactatagcgcctacataggcctaaataaggaaaaagggaagaaagaggtgattgaaaagtcgcgcctgaaaatcgacgatttcgctaagatcattaagggatatctcccgaaagcagagaagatcgacgagaaagatagatctatttttaacgaaatactggacaagatcgagcttaaaaccattctgcccaagcagaggatctccgataatggtacattgccttaccaaatccacgaagccgagctcgagaagattctggaaaaccaggctaaatattacgacttcttaaatcatgaggaaaacggcatatcaaccaaggataaactgctaatgactttcaagtttcggatcccatactatgtagggcccctcaacagttaccacaaaaataagggaggcaacagctggattgttcgaaaggaggaaggtaaaatcctgccttggaatttcgagcagaaggtggacattgagaaatccgccgaagagtttatcaagcgcatgacaaacaaatgcacctatcttaatggggaagatgtcataccaaaggactctttcttgtacagcgagtatatcattctgaacgaactcaataaggtccaggtgaacgacgagtttctgaataaagagatcaagaaaaagattatcgaagatcttttcaaaaagagcaaaaagataagtgagaagaactttagagaatacctgttggtgaatcaaattacgaacaaaactgttgagctcaagggagtgaaagacgcgttcaattccaactatgtaagctacatcaagtttaaagatattttcggcgacaagctgaatttagatatctacaaggaaatatctgagaaatcaatcctgtggaagtgtctatatggcgacgataaaaagatttttgagaaaaagatcaagagtgtgtacggggacattctcaccaaagatgaaatcaagaaaataaacagcttcaagtttaacacatggggaaggctgtccgagaaacttttgactgaaattgagttcatcgacctggagaccggtgaatgctattcttcggtcatggatgcactccggcgcacaaattacaacctgatggagttactgagctccaagttcacccttcaggaaaatatcgacaacgagaataaggaagtgtcagagtttagttatagagatttggttgaggaatcttacgtgagcccctccctcaaaagggccattctgcagacgctaaagatctatgaggaaattcgtaaaataactggccggatccctaagaaagtcttcattgagatggctcgagggggagacgaaacaatgaagaacaagaaaatcccagccagacaagagcagctgaagaaactctacgactcatgtggcaaggatattagcaatttttctatcgacataaaagagatgaagaactccctgaatagttacgataacaatagccttaggcagaaaaagttgtatctgtactatttacagttcggtaagtgcatgtacaccgggaaagaaatcgacctcaaccgcctgcttcaaaataacgatacttatgacattgatcacatctacccgcggtctaaggtgattaaagacgattcctttgacaatctggtattggttctcaagaacgagaacgcagaaaaatcaaatgagtatcccctgaagaaggaaatccaggagaaaatgaagagtttctggaaatttctaaaggagaaaaacttcataagcgatgaaaagtacaagagactgacaggcaaagacgagtttgaactcaggggattcatggctcgccagctggtgaatgtccgacagaccacgaaggaggccggcaaaattcttcaacagatcgagcctgaaatcaagattgtgtactcgaaagcggagatagcctcctcttttcgggaaatgttcgacttcatcaaggtccgtgagttgaacgatacccatcacgcaaaggacgcttatctgaatattgtggccgggaacgtttacaatacaaaatttactgaaaagccatatagatacttacaggagatcaaagagaactatgatgtgaagaaaatttacaattatgacatcaagaacgcttgggataaagaaaagagcctcgagatagtaaagaaaaatatggaaaagaacaccgtcaatatcacaaggttcattaaagaggaaaagggacagctgtttgaccttaaccccatccgcaaaggtgagacttcaaatgagattatcgccataaagcctaagttctacgaaggcagtaccgagaaactgaacgaaaagtacgggtattacaaatccctaaatccagcatattttatttacgtggagcataaggagaaaaacaagatcatccggtctttcgaaagagttaacctcgtggatgtcaataagattaaagacgaaaagagcctgatcaaatatttgatagaaaacaagggactgattgagcccaaagtgatcaagaaggtatacaaaaggcaagtgattttaatcaataactttccgtattccatagttgccctcgattcaaataagctgatggacttcgaaaaccttaaacctctgtttttggagcgaaagtacgagaaaattctcaagaatgctatcaaattcctggaagataaccagggcaagacagaggaatactataagtttctatacctgaaaaagaaagaccgcaatgagaagaacgaaaccatcgatagcgtcaaagagcggtataatattgagttcaacgaaatgtacgacaagtttcttgagaagctcgacagtaaagattataagaattacatcaacaataaaaagtattctgaactggtgaacgtgaaagagaagttcattaagttgaacctgttcgacaaagcgtttactttaaagtccttcctcgatctgtttaatagaaaaacgatggcagacttcagcaaggtcggtcttacaaaatacctggggaagatacagaagatctcgtcaaacgttttgtctaaaaatgaactccatctgctagaggagagtgtgaccggcctgtttgtgaagaaaattaaactttga

SEQ ID NO: 3098 - RNA, 4104 nt, synthetic construct
  misc_feature 1..4104: note = Cas9 variant
  source 1..4104: mol_type = other RNA
atgaaggactactatctgggcctcgatatggggagctcctctgtgggatgggcactttcagacgagagatacaacctgttgagggctaaaggtaaggatttatggggcgtccggctgttcgacgaagcaaaaaccgccgcggagcgccgaacatttcgtagtcagagaaggcggctagaacgcagcaagtggagactctccctgcttacttctctgttcgaggaagagatctcgaaaattgatgacaagtttttcgataggttgaaggactcaaaatttttcatagatgacaagagcgatcaacagcccaatacgctctttaacgacgttaatttcaccgataaagagtatcacaagcggtaccctagtatctatcatctgcgcaacgctctgtttaatcagaacgacaaattcgacattcgactcatctttttagccctgtcccacattgtgaagaagagagggcatttcctttttgatggagacaaagcaggcttcggtgaagatatcgacgtaatattggatgagctgaaggcctacctacaggacgctttccacacaaaactcgaatttacttctgagttcaagagcatcatgctggataaaaatcttaggaagaaacaaaaggaggaggaactgaagaactccattaaaatctcaagtgacaccattaatagcaaggatgggaaatctatcttgataaagctctttctgggatatgaagcaaacttaaaaccattctttctggagtacaaggtggaaaaggacaatgagtacaaaattaacttctccaaggaggattatgaagagaaactccttgacatgacatcaaagtttgaagagaccacttacttcatcgaaattgccaaaaagatccatgactattttctgttggaggagatcatgctaggcttcaagaatattagcgctagtaaagtctctatataccagaagcacaaaaacgatctgaagacactcaaaaatatcgtgaagaaccagattaacaattcctataacgccatctttaaggacataggcctggataattacccggcgtatgttagctgctggaactcgaaaaagcacaaagaaaagcagaaagggtgtaccaaggacaaattctacgcatttcttaagacgaagctgaaaaatattaacaatgccaaggagatcttggattctatcgacaacgatgacttcctcccccggctggtggataaaaattccattatccctcatcaaattcacttagctgaactgataaagatcattgacaaccagtcacagtactatccattcctaaaagagatcaaggataagatcattagtatatttaaattccgtatccccttttacgtcggacctctcaataacttccataaggacaaaggtggcaatgcctggattgaaaagctgaaagatgagcgcatctttccatggaacttcaatgacgtggtagaccttaacaagagcgcagctaactttattgagaagatgatcaatgaatgctcctatttgaaaggggagaaggttctggccaaaaactctctcctgtacactaagtatagcgtgcttaatctgataaacaaattgaagatcaatggaaccgcggtctcagtggaaacaaagcagaaaatttacaacgagctcctgttaaagcaaaagaatatcaagaaaactgccattaagaaattcctgatcaacaatagtataattgataagaacgacgagatctccggcattgatgacagcctaacctctaatctcgcagtgtttatcgatttcgaaaagatatcaaacagactgaggtatgaccagaaagaggatatcattaagagtatcagcctttttggttacgacaatgctatgttgaaaaagcagattatcacaatagcccccgatctgtccgaagacgagctcgaaaaactgtctaagttacggtactcggggttcggacgactgagcaagcgccttttgacctccattaaacacaacggcaagtcaatcatcgagatgctctgggatacgaatgacaacctgatggagctactgagtgatagatatacttttattgaacaaatcaacaaacacaatgacggcttcaaggaggacattaacctcaatttccagaacgtcgatacactgtacgtttctcctagcgtgaaaaggcagatatggcaggcttttaaggtaatcaatgaacttatttccgtgatggggcgggagccaaagaaaatcttcgtcgaaatggcccgcgaggagggagaaaagaaaagaacccaagcaaggaaggacaaagtgttggagctgtataagtcaattaagaacaatgaaatcagcactttcttaacaaacttcaaagatataaagaccaaactcgagggtgaatctaatctgaactccaagaaactttacctgtattacttgcagctcggcgttgacatctatacgggggagaagattccgtttgagaagctgttcgatcagaatatctacgacattgatcatgtgatcccccgtagtctgaaaaaggacgatagctttgacaacctagtcctcacctctaaaacaaataacgccaagaaaactgatgaatttcctgtgtcctcagagatacagagtaagatgcaaaccttttggaaagtactgaaggacaaggaccttatgagcgaaattaaatacacaaatttgactcggaagacccacctgtcggatgacgagttaggagatttcatcgctcgacagctcgttgagacaagacagtccaccaaagcgctgactcagatccttaagaacgtgtatgcaaactctgacattgtctacgtgaaagccggcatagtcagcgaatttaggcaacagttcgatatgctgaagatccgcgagctaaatgacttccatcacgctaacgatgcctatctcaatattgtgatcggtaacgtttacaatattaagtttacgaaaaacccacggaattatgtgaaggaatactataaaaagggggagcattacaacctgaaaatcgaaaagatgttggagaaggacatagcaagaggcggaaatttcggctgggataaaaagcactcaatcgagacagtacagaaaaccatgaagaaacagagtcccctgattacttacaggacctttgaaaacaagggggagttctttaatcaacagccttccaaggcctctgctaacttactcgccctgaaaagctccgacaagcgccttctggatacagtccgatatggaggttacaaaggcacccagtatgcacacatgttcttggtggaacattttaatgggaagatcattaaagagatcatgggagttccaatatacctctcaaaggaaattaaagacgataaggcgaagctgctagagtattgtaacgacgtgctgaaacttaagaatcccaaaatcctcttcagcaagatcccgtacaacagtctgattgtctataatggctaccctatcttgctgcggggtttaactggggtgcgtggcgctgcccaactcaaactggaccagacatctacgcaggtagtgaagaacatagttaaactttacgattggctgtcccagaaacaaaaggagttgagcgacctctcgaaaaagattgaatttttccaggagaacaataaaaaggatgaagtcaaggcagccatgctggaggctgacaacatcctatttattctgaatgatagattcaaaaacaccaagatcggaaaagacataatgaatgataaccaccttaataacctctatgacacttttattaataagctggaaaactcaatctacaaaaataagcccggcgggaagcaggatgtgttgatgaaagagaagagggacttattcctgtctttcagtatgtccaaaaagtgcatcacactctataaaattatcaagatttttggaagctgtgatcagggtgtggacttctctgatatagccgagaaaatcagcaagtccggcgggattggaggcaagaacctgggtaaaaatacctttgaccttgtcttcaaggaaaactcaacatacactctggttcaaagtagcgtgaccgggttgtatgccaaaaagacggacctacataaactgtga

SEQ ID NO: 3099 - RNA, 4104 nt, synthetic construct
  misc_feature 1..4104: note = Cas9 variant
  source 1..4104: mol_type = other RNA
atgaagaaacagaagttcagcgactactatctgggctttgatatcgggaccaactccgtgggatggtgcgtcacagacctcgattacaatgttcttagattcaacaaaaaggacatgtggggttctaggctgtttgaggaagccaaaactgctgcagagcggcgcgtgcaacgaaattcacgtagaaggttgaagcggcgcaagtggagattaaacctgctagaagagattttcagtaatgaaatactcaaaatcgatagcaactttttcaggcggctgaaggagtcctctctttggctggaggacaaatcgtcaaaggaaaaatttacgttgttcaatgatgacaactataaggattacgacttttataagcagtaccccaccattttccacctccgcaatgagctgatcaaaaaccctgaaaagaaagatattcgactggtatatctcgccatccatagcatatttaagagtagaggccacttcttatttgaggggcagaatctgaaagagatcaagaacttcgaaacactttacaataacttgattgcgttcctggaggacaatggaatcaacaaaattatcgataagaacaatatagaaaagctagagaaaattgtgtgtgactccaagaaaggcctcaaggacaaagaaaaggagtttaaggagatcttcaactctgataaacagctggtcgctatttttaaacttagcgtgggttcctcagttagtctgaatgacttgttcgatactgacgaatacaaaaagggggaggtggaaaaagagaagatcagctttagggaacaaatctatgaggatgacaagccaatttactattctatactcggagagaaaatcgaactgttagatattgccaagaccttctacgactttatggtcctgaacaatatcctcgcagattcccagtatatatcagaggccaaagtgaaactttacgaggagcataaaaaggacctgaagaacttgaaatatattatccggaagtacaataaaggcaactacgataagctattcaaagacaagaatgaaaacaattatagcgcttacatcggcctgaacaaagagaagagtaagaaagaggtaattgaaaagtctcgtctcaaaatcgacgatctgattaagaatataaaagggtatcttccgaaggttgaggaaatcgaggagaaggacaaagcaatttttaacaagatcctgaataaaatcgaattgaagacaattctccccaaacagcgcatatccgataacggaaccctgccttaccagatccacgaggccgaattagagaagattctggaaaaccaaagcaagtattacgacttcctaaattatgaggagaacggtatcattactaaagataagctcctgatgacatttaaattcagaatcccatactacgtgggcccccttaattcgtatcataaggacaaagggggaaactcttggatagtcaggaaggaagagggcaagatcttgccttggaattttgaacagaaagtggatattgagaagtccgctgaagagttcatcaaacggatgaccaacaagtgcacgtacctgaatggtgaggacgtgattccaaaagatactttcctctattcagaatacgtcatcctgaacgagcttaataaggttcaggtgaacgacgaatttctgaatgaggaaaacaaacgaaagataattgatgagttgttcaaggagaataaaaaggtaagtgaaaagaagtttaaagagtatctcctggtgaagcagatcgtcgacgggaccattgaattaaagggagtgaaagatagcttcaactccaattacatctcttatatacgctttaaggacatcttcggcgagaaactgaacctagacatttacaaggagatcagcgaaaaatcaattctctggaagtgtctgtacggcgatgacaagaaaatctttgagaagaaaataaagaacgaatatggggatattcttacaaaagacgagatcaagaagatcaatactttcaaatttaacaattggggaagattgagtgaaaagctgctcaccggtattgagttcatcaacctggagacaggcgaatgctactccagcgttatggatgccttaaggcggaccaattataacctgatggagcttttgtcttcaaaatttacgctccaagaaagtattaataacgagaataaggaaatgaacgaggcgagctaccgcgacctgatagaggaatcctatgtgtctccctcgctaaaaagagcaatcttccagactctgaagatttacgaggaaatcaggaagattacagggcgtgtccctaaaaaggtgtttatcgagatggcccggggaggcgatgaaagcatgaaaaataagaaaataccagctcgacaggagcaactcaagaaactgtatgactcctgtggtaacgatatcgccaatttctcaattgacatcaaggagatgaagaacagtcttatttcttacgataataacagcttgagacagaaaaagctgtacttatattacctccagttcgggaaatgcatgtataccggcagggaaatcgacctggatcgccttctgcagaacaatgacacttacgacatagatcacatttatccgcggtccaaggtaatcaaagacgattcatttgacaacttggttctcgtgctgaagaatgagaacgcagaaaagagcaatgagtaccccgtcaaaaaggagatccaagaaaagatgaagtctttctggagatttctaaaagagaagaacttcatttccgatgaaaagtataaaaggctgacaggaaaggacgattttgagctccgcggcttcatggctcgacagctggtgaatgtccggcagaccacgaaagaagtggggaagatacttcagcaaatcgagcctgagattaaaatcgtttacagtaaggccgaaattgcgagctcttttcgtgagatgttcgactttatcaaggtgagagaattgaacgatacccaccatgccaaagacgcatacctgaatatagtagctggaaacgtctataatacaaagttcactgagaaaccatacaggtatttacaggaaatcaaggagaactacgatgtgaaaaagatttataattacgacatcaaaaacgcctgggacaaggaaaattccctcgaaattgttaagaaaaacatggagaagaataccgtgaacatcacacgctttataaaagaaaagaaaggtcagctgttcgatcttaaccccattaagaagggcgagacttcaaatgaaatcatcagtattaaacctaaggtctataacgggaaagacgataagctgaatgagaaatacggatactataagagcctaaacccagcttacttcctctatgtggagcacaaggagaaaaataagcggatcaaatcgtttgaaagagtaaacctggtggacgttaataacataaaggatgaaaaatccttggtcaagtacctgattgagaataagaaattagtggagcccagggtgatcaagaaagtctataagcgacaggttattctcatcaacgactacccgtattctatagtgaccctggatagcaataaacttatggacttcgaaaacctgaagcctttgtttctcgagaataaatacgaaaagattctgaagaacgtgatcaaattcctagaggataatcaaggcaagtcagaagagaactacaaatttatctatctgaagaaaaaggaccgctacgagaagaacgaaacacttgagagtgtaaaagatcggtataatctcgagttcaacgaaatgtacgacaagtttctggaaaaattggattccaaggactataaaaattacatgaacaataagaagtatcaggagctgttagacgtcaaagagaagttcattaaactcaacctgtttgataaggccttcacccttaaatcttttctggacttgttcaatagaaagactatggcagattttagcaaggtgggtctcacgaaatacctggggaagatccagaaaatttcctcaaacgttctaagcaagaatgaactgtaccttctcgaggaaagtgtgacaggcctgttcgtcaaaaagataaagttgtga

SEQ ID NO: 3100 - RNA, 4104 nt, synthetic construct
  misc_feature 1..4104: note = Cas9 variant
  source 1..4104: mol_type = other RNA
atgaagaaacagaagttcagcgactactatctgggctttgatatcgggaccaactccgtgggatggtgcgtcacagacatgaattacaacgttctcagattcaataaaaaggatatgtggggttctaggctttttgaggaagccaaaactgctgcagagcggcgcgtgcaacgaaactcacgtagaaggctgaagcggcgcaagtggagattgaatttactggaagagattttcagtaacgaaatactaaaaatcgacagcaatttcttcaggcggctcaaggagtcctctctgtggcttgaggataaatcgtcaaaggaaaaatttacgctgttcaacgacgataattataaggactacgatttttataagcagtaccccaccattttccacttgcgcaacgagctcatcaaaaatcctgaaaagaaagacattcgactggtatatctggccatccatagcatatttaagagtagaggccacttcctctttgaggggcagaacttaaaagagatcaagaatttcgaaacactgtacaacaatcttattgcgttcttggaggataacggaatcaacaaatccattgacaaggataatctggaaaagctagagaaaatcgtgtgtgactctggcaagggtctcaaagacaaggaaaaagagtttaaggagatattcaacagcgataagcagctggtcgctatttttaaactttccgtggggctgtcagttagtttgaatgacctcttcgatactgacgaatacaagaaaggagaggtggaaaaggagaaaatcagctttagggaacaaatttatgaggatgacaagccaatctactattctatcctgggcgagaagattgaattactggatatagccaaatccttctacgactttatggtcctcaacaatatccttgcagattcacagtatattagcgaggccaaggtgaaactgtacgaggagcataagcgggacttgaaaaacctaaagtatatcatacgtaagtacaatcgcgaaaactacgataaactgttcaaggacaaaaatgagagtaactatccggcttacattggcctcaataaggagaaatctaagaaagaagtaatcgagaagtccaagctgaaaatcgacgatcttattaagagcatcaaagggtatctgcccaaggttgaagagattgaggaaaaagacaaggcaatatttaacgagatcttgaataagattgaactcaaaatcatcctgcctaagcagagaatttcggataacggaaccttaccataccagatacacgaggccgaactggagaaaatcctagagaatcaatctaagtattacgacttcctcaactatgaagagaacggtattatcacaaaagataagctgcttatgacctttaagttcaggattccctactacgtgggccctcttaattcctatcataaagacaaagggggaaactcatggatcgtccggaaagaagagggcaagatactgccatggaattttgaacagaaagtggatatcgagaagagtgctgaggaatttattaagcgaatgactaacaaatgcacatacctcaatggtgaggacgtgatccccaaggatagcttcctgtattccgaatacattatccttaacgagctgaataaagtccaggttaacgacgaatttttgaatgaggagaacaagcgcaaaataattgaagaactcttcaaggggaataaaaaggtgtctgaaaagaaatttaaggagtatctgttagtaaaccagatcaccacgggaactattgagctgaaaggcatcaaggatagcttcaattcaaactacataagttatatcaaatttaaggacattttcggcgaaaagctaaatctcgatatctacaaagagatttccgaaaagagcatcctgtggaaatgtctttacggggacgacaagaaaatatttgagaagaagattaaaaacgaatatggagatatcttgaccaaggacgagatcaaaaagattaacacattcaaatttaataactggggtagactgtctgagaagctcctgactggcatcgagttcattaatttagaaaccggggaatgctactcaagtgtgatggaggccctgaggcggacaaactataatcttatggaattgctcagctccaagtttaccctgcaagagaacatagataatgagaacaaagacatctctcagttctcgtaccgcgatctagtcgaagagagctatgtgtccccttcactgaagagagcgattctccagacgctgaaaatctacgaagagattaagaaaatcactggaagggttccaaagaaggtgtttatagaaatggcacgtggcggtgacgagagtatgaaaaataagaaaatcccggcccggcaagagcagcttaagaaattgtatgattcttgtgggaacgacattgctaatttcagcatcgatattaaggaaatgaaatcctcactgagcttatacgacaacaattctctccgacagaagaagctgtacctttattacctgcagttcggcaaatgcatgtatacaggaagagagatcgatttggacaggctcctgcaaaacaatgatacctacgacatagaccacatttatccccgctccaaggtcatcaaagatgacagttttgataacctagtgctggtactcaagaacgaaaatgccgagaaaagcaacgagtaccctgttaagaaggaaatccaggagaaaatgaagtctttctggcggtttctgaaagaaaagaatttcatttccgacgagaaatataagagacttactggcaaggatgactttgaattgagggggttcatggcacgccagctggtgaacgtccgacagacaaccaaagaggtgggaaagatattacaacagatcgagccagaaattaaaatcgtctactcaaaggctgagattgccagtagctttcgggaaatgttcgattttatcaaagtgcgtgagctcaatgacacgcaccatgcgaaggatgcctacctgaacatagttgcaggtaatgtgtataacaccaagttcacagaaaaaccctacagatatcttcaggagatcaaggagaattacgacgtaaagaagatttattcgtacgatatcaaaaacgcttgggacaaggaaaattccctggagattgtcaaaaagaacatggaaaagaatactgtgaacatcaccaggtttataaaagaggaaaagggccagctattcgacctcaatcctattaaaaagggggagacatctaacgagatcatcagcattaaaccaaaggtttataatggaaaggatgacaaactgaacgaaaagtacggctactataaatcattgaaccccgcctacttcctgtatgtggagcacaaggagaaaaataagcgcatcaagagttttgaacgggtcaacttagtggatgtaaataacataaaagacgagaagtccctcattaaatacctggtggaaaataagaaacttgttgagccgagagtcatcaagaaggtgtataaaaggcaagtgattctgatcaacgattacccttattctatagtcgctttggacagcaataagctcatggatttcgaaaacctgaaacccctatttctggagcgaaagtacgagaaaattcttaagaatgttatcaaattcctcgaagacaaccagggtaagtccgaggaaaattacaagtttatctatctgaaaaagaaagatcgctacgagaagaacgaaactttggagtcagtgcgggaaagatataatattgagttcaacgagatgtacgacaaatttctggaaaagttaaatagcaaggattataaaaactacatcaacaataagaaatatcaggacctcctggatgtgaaggagaaattcattaagttgaacctgtttgacaaggccttcaccttgaaaagttttctcgacctgttcaataggaagacaatggcagatttttctaaagtagggctaaccaagtacctgggcaaaatacagaagatctccagcaacgtcctttcgaagaatgaactctacctgttggaggaatcagtgactggattattcgttaaaaagattgagctgtga

SEQ ID NO: 3101 - RNA, 4104 nt, synthetic construct
  misc_feature 1..4104: note = Cas9 variant
  source 1..4104: mol_type = other RNA
atggtgaagaaaaagtacgccatcggcattgacatagggaccaacagcgtcggatggtccgttgtgacagatgactataaagtaccctctaagaaaatgaaggtgttcggtaatactgagaagagatacatcaaaaagaacctgctcggcacgcttctgtttgatgaagggaataccgctgagaacaggcggttgaaacgcacagcacgacgtagatatactaggcggcgcaatagaattttatacctgcaggaaatcttcgccgaggaaattaacaagatcgacgattcatttttccaaaggctagacgatagttttctcatagtcgaggacaaacagggaagcaagcaccctatcttcggcaccctgcaggaggaaaaggagtatcataaacagtttccaacaatttaccaccttcggaagcaactggcggattcctctcagaaagctgacatccgcttgatttatctcgccctggcacatatcataaagtaccgaggtcacttcctgtttgaaggggatctcaaatcggagaataaggacgtgcagcatttattcaacgattttgttgagatgttcgacaaaaccgtggaaggatcatacctgagcgagaatcttccgaacgtcgccgacgtgttggtagaaaaggttagtaagtccagaaggctggagaatattctacactattttcccaacgaaaagaagaatggcctcttcggcaacttcctgactcttgctctggggttgcagcctaattttaaaacaaacttcgagctcgcagaggatgccaagatccaattttctaaagaaacctacgaggaagacctggaggaattactgggaaagattggtgatgactatgctgatctcttcatcgccacgaaaagcctttacgacggcatcctgttggcggggattctatccactaccgattcaacaactaaagcaccactgagtagctctatggtgaaccggtatgaggagcaccagaaggacctcgccctgcttaaaaattttatacatcagaacctgtccgattcatacaaggaagtcttcaatgacaaattgaaggatggatatgctggctacatcgagggtaagaccacacaggaaaacttttaccgtttcattaaaaaggccatcgagaaaatagaagggagcaattattttattgacaagatcgaccgcgaggatttcctcagaaaacaaaggacctttgacaacggaagtatcccccaccagattcatctgcaggagatgcacgcaatcattcggcgacaagctgaattttacccttttctggtggagaatcaggataagatagaaaagatcctgacgttccgcattccatattacgtgggccccctagccagaggcaaatctgagttcgcgtggctcaacaggaagtccgacgagaaaatccggccttggaattttgatgaaatggtcgacaaggagactagcgccgaaaacttcatcacacgcatgaccaattatgatcagtacctgccagaccagaaagttcttccgaagcactcgttgctgtatgagaaatttgcagtgtacaacgaactcactaaggtaagatacgtgacagagcaagggaagtctttctttttcgatgctaatatgaaacaggagatttttgacggagtcttcaaggtgtataggaaagttaccaaggaaaaactgatggattttcttggtaaggagttcgacgaatttcgtatagtggatctgttgggcctcgacaaggacaacaaatccttcaatgcctcactggggacgtaccatgatttaaagaaaatcgtcagtaaggacctgctagataaccccgagaacgaagacattctcgagaatgtggtactgacccttacattgtttgaggatcgggaaatgatccgaaaaagactggagaagtataaggacgttctcactgaggaacagaggaaaaagctggaacgccggcactacaccggatggggcagattaagcgctaaactgattaacggtatcagggataaggtgacacgcaaaactatacttgactatttgatcgatgacgggacctccaatcgaaacttcatgcagctcattaatgatgacacactgtctttcgtcgatgagatccggctagcccaaggcagcggagaggcagaagactaccgtgccgaggtgcagaacctggctggcagtcctgcgattaagaaggggatcctccagtcactgaaaatagtcgacgaacttattgaggtgatgggatatgatccagagcatatcgttgtggaaatggcaagagagaatcagtttaccaaccaaggtaggcgcaattcccagcagcggtacaagaaaattgaaaacgccatcaagaatttggacagcaacttaaattctaaaatattaaaggagtaccccactaacaatcaggctctccaaaacgatagactgttcctttattacctgcagaacggcaaagacatgtatacggatgaagagttggacatcgatcagctctcacaatacgacattgatcacatcattcctcaggcctttatcaaggacgatagtctggacaataaggtactaacaaaaagcgcaaagaacagggggaaatccgacgatgtcccatctctggagatagtgcataagaaaaagaatttctggaagcagctcctggactcgcagcttattagccaacgaaaatttgataacttgaccaaggccgaacgcggaggcctgactaatgaggacaaagctcggttcatccagagacagttagttgaaaccaggcagatcacaaagcacgtggcccgtattctcgatacccgctttaacactaaactggacgaggcaggtaatcggatcagagatcccaaggtcaacattataacacttaagtccaatctggtgtcacaattcaggaaagactatcagctatacaaggtacgagaaatcaacaattatcaccatgcgcacgatgcttacctcaacgccgtggttgcaacggccctgttgaaaaagtacccgcagctggctcctgagtttgtctatggggactaccccaaatataatagttacaagtctcgcaagagcgccaccgagaaagtgttattctattccaacattatgaatttcttccggagagtgctcgtctactcaaagactggcgaagttaggatccggccagtgattgaggtgaacaaagaaacaggagagatcgtatgggataagaaaagcgacttccgaaccgtcagaaaggtgctgtcttatcctcaggttaacgtggtcaagaaagtggaaatgcaaacaggcgggttttccaaggagagtatacttcagcatggagatagcgacaaactgatcccccgcaagactgagaaattctacttggacaccaagaaatacggtggctttgattctccaacgattgcatattccgttctcctgatcgctgacattgaaaaggggaaggccaaaaagctaaaaagggtgaaggagctgatcggaataaccattatggaacgtatggcgttcgagaaaaatcccatcgagtttcttgaacacaagggctacaagaacatcctcgagaaaaatattataaagctgcctaaatattcattgttcgaactggagaacggtcggagaaggttactcgccagtgctaaggaactgcagaaagggaatgagatgatccttccaccgcacctggtaacattgctctaccatagctcgaacattcacaagatcactgagcccattcatctgaattatgtcaacaagaataaacacgaatttaaggagctactgcgccatatctccgatttctctacccgatacatacttgcacaagacagactcagcaaaatcgaggaactgtatgataagaacgacggcgatgacatttcagatttgacaagttcctttgtgaatttactgactttcaccgccatcggagctcctgccgcatttaaattcctcggctctgtgattgaccggaagaggtacacgagcatcgcggaaatactggaggccacacttattcaccagtccgtcaccgggctgtacgagactcgcatcgatttgtcaaagctaggaggcgactga

SEQ ID NO: 3102 - RNA, 4104 nt, synthetic construct
  misc_feature 1..4104: note = Cas9 variant
  source 1..4104: mol_type = other RNA
atggtgaagaaaaagtacgccatcggcattgacatagggaccaacagcgtcggatggtccgttgtgacagatgactataaagtaccctctaagaaaatgaaggtgttcggtaatactgagaagagatacatcaaaaagaacctgctcggcacgcttctgtttgatgaagggaataccgctgagaacaggcggttgaaacgcacagcacgacgtagatatactaggcggcgcaatagaattttatacctgcaggaaatcttcgccgaggaaattaacaagatcgacgattcatttttccaaaggctagacgatagttttctcatagtcgaggacaaacagggaagcaagcaccctatcttcggcaccctgcaggaggaaaaggagtatcataaacagtttccaacaatttaccaccttcggaagcaactggcggattcctctcagaaagctgacatccgcttgatttatctcgccctggcacatatcataaagtaccgaggtcacttcctgtttgaaggggatctcaaatcggagaataaggacgtgcagcatttattcaacgattttgttgagatgttcgacaaaaccgtggaaggatcatacctgagcgagaatcttccgaacgtcgccgacgtgttggtagaaaaggttagtaagtccagaaggctggagaatattctacactattttcccaacgagaaaaagaatggcctcttcggcaacttcctggctcttgcactggggttgcagcctaattttaaaactaacttcgagctcgccgaggatgctaagatccaattttctaaagaaacatacgaggaagacctggaggaattactgggaaagattggtgatgactatgccgatctcttcatcgcgaccaagagcctttacgacggcatcctgttggcagggattctatccacgactgattcaaccacaaaagccccactgagtagctctatggtgaaccggtatgaggagcaccagaaggacctcgctctgcttaaaaattttatacatcagaacctgtccgattcatacaaggaagtcttcaatgacaaattgaaggatggatatgccggctacatcgagggtaagactacccaggaaaacttttaccgtttcattaaaaaggcaatcgagaaaatagaagggagcaattattttattgacaagatcgaccgcgaggatttcctcagaaaacaaaggacatttgacaacggaagtatcccccaccagattcatctgcaggagatgcacgctatcattcggcgacaagccgaattttacccttttctggtggagaatcaggataagatagaaaagatcctgaccttccgcattccatattacgtgggccccctagcgagaggcaaatctgagttcgcctggctcaacaggaagtccgacgagaaaatccggccttggaattttgatgaaatggtcgacaaggagacgagcgcagaaaacttcatcactcgcatgacaaattatgatcagtacctgccagaccagaaagttcttccgaagcactcgttgctgtatgagaaatttgctgtgtacaacgaactcaccaaggtaagatacgtgactgagcaagggaagtctttctttttcgatgccaatatgaaacaggagatttttgacggagtcttcaaggtgtataggaaagttacaaaggaaaaactgatggattttcttggtaaggagttcgacgaatttcgtatagtggatctgttgggcctcgacaaggacaacaaatccttcaatgcttcactggggacctaccatgatttaaagaaaatcgtcagtaaggacctgctagataaccccgagaacgaagacattctcgagaatgtggtactgacgcttaccttgtttgaggatcgggaaatgatccgaaaaagactggagaagtataaggacgttctcacagaagaacagaggaaaaagctggaacgccggcactacactggatggggcagattaagcgccaaactgattaacggtatcagggataaggtgacccgcaaaacaatacttgactatttgatcgatgacgggacttccaatcgaaacttcatgcagctcattaatgatgacaccctgtctttcgtcgatgagatccggctagcacaaggcagcggagaggccgaagactaccgtgctgaggtgcagaacctggcgggcagtcctgcaattaagaaggggatcctccagtcactgaaaatagtcgacgaacttattgaggtgatgggatatgatccagagcatatcgttgtggaaatggccagagagaatcagtttacaaaccaaggtaggcgcaattcccagcagcggtacaagaaaattgaaaacgctatcaagaatttggacagcaacttaaattctaaaatattaaaggagtaccccaccaacaatcaggccctccaaaacgatagactgttcctttattacctgcagaacggcaaagacatgtatactgatgaagagttggacatcgatcagctctcacaatacgacattgatcacatcattcctcaggcatttatcaaggacgatagtctggacaataaggtactaacgaaaagcgccaagaacagggggaaatccgacgatgtcccatctctggagatagtgcataagaaaaagaatttctggaagcagctcctggactcgcagcttattagccaacgaaaatttgataacttgacaaaggctgaacgcggaggcctgaccaatgaggacaaagcccggttcatccagagacagttagttgaaactaggcagatcaccaagcacgtggcacgtattctcgatacacgctttaacaccaaactggacgaggcgggtaatcggatcagagatcccaaggtcaacattataactcttaagtccaatctggtgtcacaattcaggaaagactatcagctatacaaggtacgagaaatcaacaattatcaccatgctcacgatgcctacctcaacgcagtggttgccacagctctgttgaaaaagtacccgcagctggcccctgagtttgtctatggggactaccccaaatataatagttacaagtctcgcaagagcgcaacggagaaagtgttattctattccaacattatgaatttcttccggagagtgctcgtctactcaaagaccggcgaagttaggatccggccagtgattgaggtgaacaaagaaactggagagatcgtatgggataagaaaagcgacttccgaacagtcagaaaggtgctgtcttatcctcaggttaacgtggtcaagaaagtggaaatgcaaaccggcgggttttccaaggagagtatacttcagcatggagatagcgacaaactgatcccccgcaagacagagaaattctacttggacactaagaaatacggtggctttgattctccaaccattgcttattccgttctcctgatcgccgacattgaaaaggggaaggcgaaaaagctaaaaagggtgaaggagctgatcggaataacgattatggaacgtatggccttcgagaaaaatcccatcgagtttcttgaacacaagggctacaagaacatcctcgagaaaaatattataaagctgcctaaatattcattgttcgaactggagaacggtcggagaaggttactcgctagtgcaaaggaactgcagaaagggaatgagatgatccttccaccgcacctggtaaccttgctctaccatagctcgaacattcacaagatcacagagcccattcatctgaattatgtcaacaagaataaacacgaatttaaggagctactgcgccatatctccgatttctctactcgatacatacttgcccaagacagactcagcaaaatcgaggaactgtatgataagaacgacggcgatgacatttcagatttgaccagttcctttgtgaatttactgacattcactgctatcggagcccctgcagcgtttaaattcctcggctctgtgattgaccggaagaggtacaccagcatcgccgaaatactggaggctacgcttattcaccagtccgtcacagggctgtacgagacccgcatcgatttgtcaaagctaggaggcgactga

SEQ ID NO: 3103 - RNA, 4107 nt, synthetic construct
  misc_feature 1..4107: note = Cas9 variant
  source 1..4107: mol_type = other RNA
atggacaagaaatacagcatcggcctggatattgggacctcctctataggattcgtgggtgtcgacgagaacggctggcccctcaatatcaaggggaaaagagccattggagctcacctttttagggaaggcgaggcagccgcggaaacacggggtttccgcactacgcgacgtagatataacaggcggaagtggcgcctgagattgttaagggagatctttgatgaacctatttcacgggttgacccaaccttctttgctcgcatgaaagagagtagcgtgtccccgaaggatcccaattacgacgggctggccaaggagatcctaatacctcgagataaagacggaaagatcctctatccaacaatttaccatctgagacacgcacttatgtatgaagatcatcagttcgacatcagggagatttacctggccatccaccatatagtaaaatatcggggccactttttgctcgatggcgctgcaaagaacttcgaatcttcgaatctggacctgaaatcagatattcacgagatcaacgccattctcgtggggatctttggaaatgagcaagtccagttcaacgaccagtacgtggaaaagttaaaggaggttctgcttgacagcactcagagtcgttccgatcgccaaaaagctgccgcgaaggtgttgctgcccaccaatgacctagataaagacacaaccaagatcctcaaaactgtctctacagaaattaccaaggcaataacgggtctgaaagccaagtttttcgtgatcactggcaacgatattgctaaggaccagcagaaagattggacctttagcatcgacacacttgatgagaagatgtccgtaatagaaccttcattcagtgagaaaaatttcagcctgattactatcttgcagaagctctactcttccgttaccctggccgggatcgtgccaaacggattatcactgagcgaggcaatgattcaaaaatatgacagacatgctagtgatctcgtccttctgaagaagtactgggacacaaaacccaaggtgttgaaacaccagctacagaatacctatgccgaatacatcgagattcatcaggtggtcgacgaattttattctgatctgtccaagctcattaaaaacgacgatgacacgctggcgcaagagatcaagagcaagattactatcggcaatttccttcctaaacagaggacaaccgaaaacggtgttatcccataccagctgcaacagcgggagttggatactattataaagaaccagcaggagtattacccgtggctcgccgaagagaatcccgtggcagaccaccaaatcgcttttccttacaaactggatgaattagtagggttccgaataccatattacgtgggacccatgatcgccaaggaggacacatcgaactctaaaaattccaagtttgcttggatgattcgcaagcagtcaggcgaagtcaccccttggaacttcgatgagaaaatcgacagaacggccagtgcaaccgcctttatagataggatgacaactaccgacacatatctgatcggcgaggatgtgctaccaaagcagagcctcatttaccagcggttcgaagttctgaatgagcttaacaaaatctccattgacgggcaacccatcactcgcaagcagaaacagtctgtgtatacccacgtctttgaaaagaaaaagacagtgcaggtaaaggacgttcaaaaattcttggtgagctcaggagaggtcatgagtctgccgaagataggtggcctcgctaatgagaaacagtttaactccagcctgtctaccctttacgattataataagattatccctgacgcgctggaagatagaaacaaagtggacgatattgagaagatcatattgtggtcaactatcttcgaagacaatagtatttttgtcgagaagctcgatagcatcgactggctgacgtcctctcagaggaaacgtttagcacagaagcggtaccgagggtggggaagactgtcgctaaggctcctgacaaccttcaaaaacaaggatggctacagcattcttgacgaattgtggaactccaatcataatttcatggagatccaagcccagtcagattttagtgagcagatagctactgccaacaacaataacctgtctcaagtgctccccgcaaaatgggaaccaggtcgcaagaatctggccagcttagacgagttcatttccaacctgtatacctcacctcagaataagaaagctctacggaaggccatcagagttgtgcaggatatgatgacagcagcggggcacatgcccgagaaaatctttattgaagtagctagggacaccagcaactctcatcagcaaactatcgcccgccagcgacagttgcagcaactctaccagtccgaagcaaaggaggtcattgacagtagcgtgcggtctgagctggatgacatacttaaaaatcgtgccaacatcaaggatcagctgttcctctattttcagcaaggcggaagagacctgtacacaggcaaggctattaatatcgataaactttccttgtatcacattgaccatatcctgccacagtcattagttaaggatgacagtctcgataacagggtgctggtcagccagaaaacgaatgaagacaagggggtgaccttcgtatcggataaatacatgaacaatatgcttcccacttggaagcgctggcacgagatgggactgatatccgcccggaaattgaagaacctcacaatgagacctgacgaaatcgacaagtatgcaccaggttttattcaaaggcagctggtggagacccgacaggttacaaaacttgtcatcgaactgctcgatgctctgcttggcaattctcagactgagattatcaccataaaggccagcttgtcacaccaattccgccagcagtttgacctggtgaaaattcgggaggtgaacgataaccatcacgcgttcgacgcctttttagctgcaagaatcgggacgtacctctacaagaggtatccgaaactgcgtccctacttcgtctatggacagtacatgcaaaatcataagaaccttaagagtatcaatctgattaaaaccctagattccgacaaggccatagttgatgaaggcacaggtgagatcctctgggacaaaaagtctgatctggctaaaatgattaagatctataactaccagcgcttgctgattactcacgaaagccggacctcctttggggccatgtataagcagaaaatcttaaaggcaacagacgcgaaacagaatggcggaggcttcaagctcgtgcctactaaaagaaactggccagtggatatatacgggggatacaccggtcaaacggccgcttatctgacaatcgtaagggtctactcaaagaagaccagcgagcttcgagtgctgcccatttatactaataaagttcagcagatcgagaaggccatgacacagggcgacaaagcaaccatgttggctttcaagaaagtgattgcccctcaactcgggaaggaaaacaagaaaactcacgagatcaagataccagaatttgatgtcgtgattcccaaagttctgctagaccagctggtgatcgacgatatcgcaggaagtccgcatcggttccgccttggcaccgacacatactatcacaattctcagcaactctttctgcctttgtccatgcagagacagctgatggatagggagagcgacgataaggtatacttagacattttcaacgatgtcctcaaacaggtggactcgtattttaatctgtacgatgtgaacggtttccgggccgctctacaaaagtctaaaaaggcgtttgaacagctgccaatcaatgacttccccaaggatgtccctgacaacaaaaagaaaaaggggaaacgatcaatattgaaggagatttttatcggcctccatgccaatgcaacgctgggaaacctaaagcagatgggcattaaaaccgatttcgggaagctgcagaaaagtaacggacttagaatcactgagaattgcaagataattcaccaatcccccacaggcctctttgaacgcatcgttccaatcaaatga

SEQ ID NO: 3104 - RNA, 4107 nt, synthetic construct
  misc_feature 1..4107: note = Cas9 variant
  source 1..4107: mol_type = other RNA
atgagcagaccctacaacatcggcctggacattgggacctcctctataggatggtcagtggtcgatgaccagagtaagctcgttagcgtgaggggtaaatatggctacggggtacggctttatgatgagggacaaacagccgctgaacgccgatccttccgtactacgagaaggcggctgaagcgcagaaaatggaggttgggcttactgcgggagatctttgaaccttacattaccccagtggacgatacattctttctacgccagaagcagtctaatctctcgccgaaagaccagcgaaagctgtatccccaaacttcacttttcaacgatagaaccgacagggcattttacgatgactatcctacaatctaccacttgcggtacaagttgatgaccgagaaacgtcagttcgatattcgcgaaatctatctcgccatgcatcacatagtcaagtacagaggtcattttctgaatgaggcgccagtgagcagtttcaaatcctctgagatcaacctggttgctcactttgacaggctcaatactattttcgccgatttatttagcgaatccgggttccagctggagacagacaaacttgcagaagtgaaagccttgctgctagacaaccagcaatcagctagtaatcggcagcgacaggcactcagcctgatctataccccctctacgaacaaggccgtcgagaagcagaataaagctattgccactgagcttctgaaggcgatcttgggactcaaagcaaagtttaacgtgctgaccggcatagaagccgaggatgtaaaggcttggacattaactttcaatgccgaaaacttcgacgaggaaatggttaagctggagtcctcactcgatgacaatgcacatcaaattatcgagagccttcaggaactgtacagtggcgtgttgctagctgggattgtccctgagaaccagtctctgtcccaagccatgatcaccaaatatgatgaccaccagaagcacctcaagatgctgaaagcggtgcgcgaagcccttgcaccagaggatagacagaggctgaagcaggcttacgaccaatatgtggatggacaggaaaatacaaaagcctacagcaaggaggacttttacggtgatatcaccaaggctttgaaaaacaaccccgaccatcctattgtctcggagataaagaaactcatcgaactggaccagttcatgccaaagcagcggacgaaagataatggcgccattccgcaccaattacatcagcaggagctggaccgcatcatagaaaaccagcaacagtattacccctggctagcagagctcaatcctaactctaagagacagactgttgccaaatataagctggatgaacttgtggcttttagggtaccatactatgtggggcccttgattacagcggagcagcaacgtcagtcctcagacgcaaagttcgcctggctgatccggaaagctgagggacgaatcaccccttggaattttgatgacaaggtcgatagacaggccagtgcaaacgagttcattaaaaggatgactacaaccgacacgtacctcctggccgaggatgtgcttccaaagcaaagcctgatctatcagcgctttgaagttttgaatgagctcaacggcctgaaaattgacgatcagcccataaccacagagttaaagcaggctatcttcactgacctgtttatgcaaaagatttccgtgaccgtcaaaaatatccaggattacctagtgtctgaaaagcggtacgccagcagaccggcaatcacaggtctctcagacgagaacaaattcaatagtaggctgtccacttatcacgaccttaagatgattgtaggggatgcggttgacgatgtggacaaacaggctgatttggaaaagtgcatagagtggagcaccatctttgaagacggaaaaatttactctgccaagctgaacgagatcgattggctcacagaccagcaacgcgtccagctggcagccaagcgatatcggggctggggccgtttatcagctaaactgcttacccagattgtgaatgccaacgggcagagaatcatggatttgctctgggacactacggataatttcatgaggatagtccacagtgaggactttgataagctgatcacagaagcaaaccaaatgatgctagctgagaacgacgtgcaggacgttattaatgatctgtacaccagccctcagaacaaaaaggccctccgccaaatcctgcttgtggtaaatgacattcagaaagcgatgaagggacaggcccccgaacggatcttgatagagttcgctagagaagatgaggtcaacccaaggctgtccgtgcagcgaaagcgccaagttgaacaggtgtatcagaatatttctaacgaattactcaataacactgagatccggaatgaactgaaagacctttcgaacagcgcactgtccaataccagattgttcctctactttatgcagggtggcagggatatgtatacaggggactcactgaacattgatcgtctaagtacctacgacatcgatcatatactgcctcaatctttcgtcaaggacaatagcctcgataaccgcgtgctggtatcccagaaaatgaatcggtcaaaggccgaccaggtgcccactgactttacaagcgttgagcttggcaaaaagatgcagttgcaatgggaacagatgctgagagctggattaatcacgaagaaaaagtacgataacctcaccctgaacccagaccacatttctaaatatgccatgaagggtttcatcaataggcagcttgtcgagactcgacaggtgattaaactggcaacaaacctactcatggagcaatacggggaagataatatcgagctgataaccgtgaagtccggcttgacacatcagatgcggactgaatttgacttccccaagaaccgcaatctgaacaatcaccatcacgcgtttgatgcctatttaaccgctttcgtcggactctacctgcttaaaagatatcctaagctgaaaccatactttgtttatggcgagtaccagaaggccagtcaacaggacaaatggaggaacttcaattttctgaacgggctcaagaaagatgagctggtggacgaaaatacggaggcagtgatttgggataaggaaagcggactagcttacctgaacaagatctatcagttcaaaaagatccttgtaacccgggaggtccacgaaaattctggtgccctctttaaccagacactgtacgcagccaaagacgataaggcttccggccaagggggaaaacagttgattccggcgaagcaggaccgacccactgccctgtatggcggttactcagggaagaccagtgcatatttatgtctcgtgaaaatcaagaataaaagcgagtacatttatagaatattcggcgttaacacatcgtggtcctctgagctgaagcagatccaagatcctgctgaacgccttgtgaggctggagaaattgctcactccacagctgaccattaacaagaagaaaaagggagaacccgtccctgtgacgaaagacttcaagatcattctaccacgtatcctgataaatcagaaattttacagccggggccaggacatctcaattgccagtgagttctaccttcataacgaacaagagctcgttctggataagtccgacatcaagattttgaatggggccatcaaagtgaacaattctaacaagcaggtaataaatttatttaaccacattctggagcaggtcaatcaatatttccccgtgtacgatatctataaaagcagagaagtgctcaactcctcaaaggagatctttgaaaatctgacatggaacgaccagtggaggaatcgcaaacttattaacgtcggacagaagaccatactgaatcgaatcttgattggtctacatgctaacgcagccagaatcaagattagcgagctgggcttcaaaaatgattttgggctcctgactcagacaagtggaatcaccttcactccggacacccaaataatctaccagtctcctacaggcctttttgaacggagggttgcgttacgcgatctgtga

SEQ ID NO: 3105 - RNA, 4107 nt, synthetic construct
  misc_feature 1..4107: note = Cas9 variant
  source 1..4107: mol_type = other RNA
atgaagagaagctacaacatcggcctggacattgggaccaattccataggatgggccatcgtggatgaccagtctaaactcatttcagtcaagggtaaatatggctacggggttaggctttatgatgagggacaaacagctgcagaacggcgcagtttccgaactacgcgtagaaggctgaagcggcgcaaatggagattgggcttactgagggagatctttgaaccctacattacccctatcgacagcacattctttctacggcagaagcagtccaacctctctccaaaggatcagcgcaaactgtatccgcaaacttcgcttttcaatgaccgacccgatgccgacttttaccagcagtatcctaccatataccacctgagataccagttgatgacagagaagaggcaattcgatatccgggaaatttatctcgcgatgcatcacatcgtgaaataccgtggtcattttctgaacgaggctccagtagcctcattcaagagcagtgagattaatctggcagaacactttgaccagctcaacaccatcttcgccgatttatttcgcgagtccgggttccagctggaaactgacgagcttgtggctgtcaaagcattgctgatggataatcagcaatctgccagcaacagacagaggaaggctctacccaagctctatacaccttccgccgacaaatcaatagagaagcagcggaaagcgattgcaaccgaaatcctgaaggccattcttggactgaaagctaagtttaatgtggttacgggcatcgaggccgaagacgtgaaagcatgggctttgactttcaacgccgagaatttcgatgaagaactcgcgaagctggagagtagcttagacgataacggccatgaagtcatcgggattctgcaagagctctactctggaatacttctggccggtatcgtgccagaaaatcagtccttgtcacaggcaatgattaccaagtatgaggaacaccaggctcacctaaaaatgctgaaggccgtacgagacgatctcgctacagccgaccaacagaaactgaagaaagcatacgatcagtatatcgacggccaggagaacactaaggcctacagcaaggaggctttttacgatgacgttaccaaagcgcttaaggattatagtgaacaacccctggtgtctgagatacagaaattgattgaactcgaccagttcatgcctaagcagcgcacaaaagacaatggggcaatcccacatcaactgcaccagcaggagttagatagaatcattgaaaaccagcaacagtactatccgtggctggccgagctaaaccccaatcctaagaggcagaccgtcgctaagtacaaactcgacgagctggtggcctttcgggtgccatattacgtcggaccccttatcacggcagaacaacagcagcagtccagcaacgccaagttcgcttggatgattcgcaaaactgagggcagaataacaccttggaattttgatgacaaggttgataggcaagcctcggcaaacgagttcatcaaacgtatgaccactacagacacctatttgctggcggaggatgtgctcccaaagcagtctctgatttaccagcggtttgaggtacttaatgaactgaacggtttgaagatcgacgatcagcccatcacgaatgagctcaaacaagctattttcaacgacctgtttatgcagaagacctccgtgtcagtcaaaaatatacaggattacttagtgagtgaaaagcgatatgccagcagaccggcaatcacagggctgtccgacgagaaaaagttcaactctaggctaagcacttaccatgatctcaaagttattgtgggagacgccgtcgacgatgtggacaagcaggctgatctggaaaagtgcatcgagtggtcaaccatttttgaggacggcaaaatctatagtgccaaacttaatgaaataacatggttgactgagcaacagcgcggccagctggcaaccaaacggtacagagggtggggaaggctctccgctaagctgttaacacaaatcgtaaacgccaatggtcagcgcattatggatctgctttgggacaccactgataacttcatgcgaatcgttcactttgaagacttcgataaattgattacggaggcgaatcagatggtgctcgccgaaaacgacgtccaggatgtgatcaacgacctgtatacaagccctcaaaataagaaggctctacggcagatactgctcgtcgtgaacgatattcagaaagcaatgaagggccaggcccccgagcgtatcctgattgagttcgctagaggggcccaaaaagacaagtctcttaccgttaggcgcaaacggaagttggacgaaatgtactcacagatcagtgatgcagtgctggcggacgagagcgtaagacaggaattaaagtcctctaatcaggatgacctcgtcaaagagaaggtgtatctgtactttatgcaaggaggcagggatctttacactggtaacgccctgaatatagaccgattgtcggattatcacgttgaccatatcattccacaggcttacatcaaagatgacagcctcgataacaaggccctggtgtcctcacgcatgaatgaaattaaagcagaccgggtccctctacaggtggtacagaagcaattcgggaagaacatggctagtgagtggggctatatgcacagagccggactgatctctaggaaaaagtacgacaatctcatgtttaaccccgagaatctgaacaaatatcagataaatcgtttcattagccgccagcttgtggaaacccaacaggttatcaagttggtcgcaaacctgttatccaatcagtacgagggcgataacgtgaaaatcattacagtgaagtcaaaactcacccagactatccggagcgaatttgacttcccaaagaacagagaggtcaataactatcatcacgcctttgatgcttacctgacagcgttcgttgggatgtaccttctgaagaggtatcccaaactatcttcctactttacgtatggagagtacctcaagggtaatcaacaggacaaatggagtagcttcaactttctgaatgatttgaagcgagccaaactggaagacaagaccaacaaggagattttctggcataaagaatctggcttagcatatctcaataagatataccagtttaaaaagatcctggtgactcgggaggtgcacgaaaactccggggctcttttcaatcagacactgtatgccgccaaagatgacaaggcttcaggacaaggcggtaagcagttgattcctgcaaaacaggcccgcccaaccgcgctctacgggggctacagtggaaagacagtagcttatatgtgtatcgtcagaattaaaaacaagaaaggcgatctgtacaaggtgtgcggggttgagactagctggctagcccagctgaagcaacttaaagacgaggattcgcagaaggcattcctcaaacagaagatctccccgcaatttaccaaagccaagaagcagaaaggaacgatagtgaaggtcgtggaagacttcgaggttatcgctccccacattctgatcaatcagaggttgtttgataacggtcaggaactgaccttaggctctgcaacatataaacataatgagcaagaactcattctggacaagactgccgtgaaacttctgaacggggagttgcctctcgcgcagagcgaggaactggctgagctagtatacgacgaaatcctggatcaggtcatgcactatttcccactttacgacaccaatcagtttcgggccaagctcctggcaggaaaaacagccttcatgcaattgccctggaagtcaaaccctgatgacaacaagactgtgcagataacccagccaattgtgttaaagaagatcctgcagggcctccatgctgatgccggtcgagtcagtctgaaagagcttgggatgacgacagactttggcatgctgcaaaaggcaaccggaatcactttcacacccgatacccagattatatatcagtccccgactggcttgtttgaaagacgcgttgctctaagggacctgtga

SEQ ID NO: 3106 - RNA, 4107 nt, synthetic construct
  misc_feature 1..4107: note = Cas9 variant
  source 1..4107: mol_type = other RNA
atggacaagaaatacagcatcggcctggatattgggaccaactccgtgggatgggccgtcataacagacgattataaggttccctctaaaaagttcaaagtgctcggtaatactgacagacactcaatcaagaagaaccttattggcgctctgttgtttgatagtggggagacggcagaagccaccaggttaaaacggacagcgcgccgacgttacactagaaggaagaatcggatctgctatctgcaggagattttcagcaacgaaatggctaaagtagacgattcctttttccatcgcctagaggaatcttttctcgtggaggaggacaagaaacacgaaagacatcctatcttcggaaatatagtcgatgaggtggcctaccacgaaaagtatccaaccatctaccatctgaggaagaaacttgttgactcgacagataaggcagacctgcggttgatttatctcgccctggctcacatgatcaaatttcgcggccacttcctgattgagggtgatctcaacccggacaattcagacgtggataagttatttatccaactggtccagacctacaaccagcttttcgaggaaaatcccataaacgcaagcggggtggacgccaaagctattttgagtgcccgactgtccaagtctagaaggctagagaatctcatcgcgcagctgcctggagaaaagaagaacggcctttttggcaatctgattgcattgagcctcgggctgactccaaacttcaagtccaattttgatttagccgaggacgctaaactgcaactctcaaaggatacatacgacgatgaccttgataacctgttggcccagatcggagaccagtatgcagatctattcctggctgccaaaaacctcagtgacgcgatcctgcttagcgacattctgcgggtaaataccgaaataacgaaggcccccttgtctgcatccatgatcaaacgttacgatgagcatcaccaggacctcactctgttaaaggctctggttcgccaacagctacctgagaagtataaagaaattttctttgatcagtcaaagaacggttacgccggctatatcgacgggggagctagccaggaggagttctacaaatttataaagccaattctcgagaaaatggatggcaccgaagaactgcttgtgaagttgaatagagaggacctgctcaggaagcaacggacattcgataacggtagtatcccccatcagatccacctgggggaacttcacgccattctgcgacgccaggaggacttttatcctttcttgaaagataatagagaaaagatcgagaaaattctcacttttaggataccatactacgtcggaccgctggcacggggcaactctcgcttcgcctggatgaccagaaagtccgaagagacaatcaccccctggaattttgaggaagtggtggacaaaggcgctagcgcgcaatcgttcattgagaggatgacgaactttgataagaatttacctaacgaaaaggtcctgccaaaacattctctactctatgagtacttcactgtttataatgagctgacaaaggtgaaatacgtaaccgaagggatgcgtaagcccgcatttctttccggagagcagaaaaaggccatcgtggacttgctgttcaaaactaaccggaaggtcacagtgaagcagctcaaagaagattatttcaagaaaatcgagtgttttgactcagttgaaattagtggtgtggaggaccgattcaatgctagcctgggcacctaccacgatttactgaagataatcaaagacaaggattttcttgacaacgaggaaaatgaggatattttggaagacatcgtcctcacgctgaccctattcgaggatagagaaatgattgaggagaggctgaagacatatgcccatctctttgacgataaagtgatgaagcagctgaaacgccggagatacactgggtggggaaggctttcccgcaagttgatcaacggcatacgagacaaacaatctggtaagaccatcctggatttcttaaagagcgacgggtttgcaaaccggaatttcatgcagctcattcacgatgactcactgacatttaaagaagacatccagaaggcccaggtaagtggccaaggagattcccttcatgagcacattgctaacctggccggcagccctgcaatcaaaaaggggatattgcagactgttaaagtggtcgacgaactcgtgaaggtcatgggacgtcacaagccagagaatattgtgatcgaaatggcgagagagaaccagaccacacagaaaggtcaaaagaactctagggagcgcatgaaacggattgaagagggcatcaaggaactggggtcacagatactaaaagagcatcccgttgagaatacccagctgcagaatgaaaagctctacctgtattaccttcaaaacggaagagatatgtatgtggaccaggagttggatatcaataggctgagtgactacgatgtagaccacattgtcccgcagagcttcttaaaagatgactccatcgataacaaggtgctcactcgatctgacaagaatcgcggcaaatcggacaacgttcctagcgaagaggtggtcaagaaaatgaagaattattggcggcaactgcttaacgctaaactgattacgcagagaaagtttgataatctaacaaaggccgaaaggggtgggctctccgagctggacaaagcaggcttcatcaagcgtcagttggtggagacccgccagataactaaacatgtagcccaaattctggattcacggatgaacaccaagtacgacgaaaacgataaattaatcagagaggtgaaggttatcacactcaagagtaaactggtctctgactttaggaaggatttccagttctataaagtgcgagaaattaataactaccaccacgctcatgacgcctaccttaatgcagtggtcggaaccgctctgatcaagaaatatcccaagttggagagcgaatttgtttacggcgattataaggtgtacgacgtgcggaaaatgattgccaagtccgagcaggagatagggaaagcgactgccaagtatttcttttactcaaacatcatgaatttctttaaaacagaaattacgctcgctaacggagagatccgcaagagaccactgattgaaaccaatggtgagactggcgaaatcgtatgggataaggggagggacttcgcaacagtccggaaagtgctaagcatgcctcaggttaacatagtgaagaaaaccgaggtccaaacaggaggcttttctaaggagtccatcctgcccaaacgaaatagtgataaacttattgcccgcaaaaaggactgggacccaaagaaatatggtgggttcgatagccccactgtggcttactctgttctcgtggtagccaaggtcgaaaaaggcaagtccaaaaagctgaagtcagtgaaagagttgctgggaatcaccattatggaaagaagtagctttgagaagaaccctatcgacttcttagaggcaaaaggctacaaggaagtgaaaaaggatctcataattaagctgccaaaatattcgctttttgagctggaaaatgggaggaagcgtatgttggcgtccgccggagagctccagaaaggcaacgaactggctctaccgtctaagtacgtcaatttcctgtatcttgccagccactacgagaaactcaagggttcacccgaggacaacgaacagaagcagctgttcgttgagcaacataaacactatttggatgaaatcatcgagcagattagtgaattttccaagcgggtgatattagcagacgctaatctggataaagtactctctgcctacaacaagcatagagacaaacctatcagggagcaggcagagaacattatccacctgttcacgcttaccaatctgggggccccagctgcgtttaagtatttcgatacaactattgaccgcaaacgatacaccagcacaaaggaagtgttggatgccactctaatccaccaatccataaccggactgtacgagacgagaatcgacctctcacagctgggcggtgattga

SEQ ID NO: 3107 - RNA, 4107 nt, synthetic construct
  misc_feature 1..4107: note = Cas9 variant
  source 1..4107: mol_type = other RNA
atggacaagaaatacagcatcggcctggatattgggaccaactccgtgggatgggccgtcataacagacgattataaggttccctctaaaaagctcaaaggtcttggcaatactgacagacacgggatcaagaagaacctgattggagctttgttattcgattcaggcgagacggcagaagccaccaggctgaaacggacagcgcgccgacgttacactagaaggaagaatcggatctgctatctacaggagatttttagtaacgaaatggctaaagtggacgatagcttctttcatcgcctcgaggaatccttcctggtagaggaggacaagaaacacgaaagacatcctatctttggtaatatagtggatgaggtcgcctaccacgaaaagtatccaaccatctaccatcttaggaagaaactggcagactctacagataaggtggacttgcggctcatttatctggccctggctcacatgatcaaattccgcgggcactttctcattgagggagatttaaacccggacaattcggacgttgataagctgttcatccaacttgtgcagacctacaaccagttgtttgaggaaaatcccataaacgcatcacgagtcgacgccaaagctattctgagcgccagactaagtaagtccaggcggctcgagaatctgatcgcgcagcttcctggcgaaaagaagaacggcctgttcgggaatttgattgcactctctctgggattaactccaaactttaagagcaatttcgatctggccgaggacgctaaactccaactttccaaggatacatacgacgatgacctggataacttgctagcccagatcggtgaccagtatgcagatctgtttctcgctgccaaaaacctgtcagacgcgacccttctgagtgacatcttgcgtgtgaatagcgaaattacgaaggcacccctctctgcctccatgataaaacgctacgatgagcatcaccaggacctgactttactgaaggctctagtaagacaacagctccctgagaagtataaagaaatcttcttcgatcagtcaaagaacggctacgccgggtatattgacggaggcgctagccaggaggaattttacaaattcatcaagccaatactggagaaaatggatggtaccgaggaacttttggccaagctgaatagggaggacctcctgcggaagcaacgaacatttgataacgggagtattccctatcagatccatcttggagaactgcacgcaatcttgcgcagacaggaggacttctacccttttctcaaagataatagggaaaagattgagaaaatcctgactttccggattccatactatgttggcccgttagcccgcggcaactctagatttgcttggatgaccaggaagtccgaagagacaataaccccctggaatttcgaggaagtggtcgacaaaggggcgagcgcacaatcgtttatcgagcgtatgacgaacttcgataagaatctgcctaacgaaaaggtgctaccaaaacactctctcctgtacgagtattttactgtgtacaatgagcttacaaaggtcaaatatgttaccgaaggaatgcggaagcccgccttcttgtccggtgagcagaaaaaggctattgtggacctgctctttaaaactaaccgaaaggtaacagtgaagcagctgaaagaagattacttcaagaaaatcgagtgtttcgactcagtcgaaatcagtggcgtggaggacagatttaatgccagcttagggacctatcatgatctgcttaagattataaaagacaaggatttcttggacaacgaggaaaatgaggatatcctcgaagacattgttctgacgctaaccctgtttgaggatagggaaatgatcgaggagcgcctcaagacatacgcacacctgttcgacgataaagtgatgaagcagcttaaacggagaaggtacactggatggggccgcttgtcccgaaagctgattaacggtatccgggacaaacaatctgggaagaccatattagattttctcaagagcgacggcttcgccaaccgtaattttatgcagctgatccatgatgactcacttacattcaaagaagacattcagaaggctcaggtcagtggacaaggcgattccctgcacgagcatatcgccaacttggcagggagccctgcgattaaaaagggaatcctccagactgtgaaagtagttgacgaactggtgaaggtcatgggtagacacaagccagagaatatagtgattgaaatggctagggagaaccagaccacacagaaaggccaaaagaactctcgcgagcggatgaaaagaatcgaagaggggattaaggaactaggatcagatatcctgaaagagtatcccgtcgagaatacccagctccagaatgaaaagctgtacctttattacttgcagaacggcagggacatgtatgtggatcaagagctggacataaatcgattaagtgattacgacgttgatcacatcgtgccgcagagctttctcaaagacgattccattgacaacaaggtactgactcgctctgacaagaatcggggtaaatcggataacgtccctagcgaagaggtggttaagaaaatgaagaattattggagacagcttctgaacgccaaactaatcacgcaaaggaagttcgacaatctcacaaaggcagaacgtgggggcctgtccgagttggataaagtgggatttattaagcgccagctggtcgagacccggcagatcactaaacatgtggcccagatattagactcaagaatgaacaccaagtacgatgaaaacgacaaactcattagggaggtacgagtgatcacactgaagagtaaacttgtttctgatttccggaaagactttcaattctacaaggtccgcgaaatcaataactatcaccatgctcacgatgcctacctgaatgcagtggtgggcaccgctttgattaaaaagtatcccaaactcgagagcgaatttgtctacggggactataaggtttacgatgtgagaaagatgatcgccaaatccgagcaggagattggaaaggcgactgccaaatatttcttctactcaaacataatgaactttttcaagacagaaatcacgctggctaatggtgagattaggaaacggccactaatcgaaaccaatggcgagactggggaaattgtgtgggacaagggacgagattttgcaacagtaagaaaggtcctgagcatgcctcaggtgaacatcgttaaaaagaccgaggtgcagacaggcggtttctctaaagagtccatacttcccaagcgcaatagtgacaaactcatcgccaggaagaaagactgggatccaaagaagtacgggggctttgacagccccactgtcgcttattctgtgctggttgtggccaaagtagaaaagggaaaatccaagaaattgaagtcagtcaaggagctgttaggcattaccatcatggaacgtagtagcttcgagaaagatcctattgactttctcgaggcaaaggggtacaaagaagtgcggaaggatctgatcataaaacttccaaagtattcgctgttcgagttggaaaacggaagaaagaggatgctcgcgtccgccggcgagctgcaaaaaggtaatgaactagctctgccgtctaagtacgtgaactttctttatctcgccagccactacgagaaactgaaggggtcacccgaggacaatgaacagaaacagttgttcgtcgagcagcataagcactatttagatgaaattatcgagcaaatcagtgagttctccaagcgcgttattctggcagacgctaacctcgataaagtgctgtctgcctacaataagcatcgagacaaacctataagagaacaggcagagaacatcattcacctttttacgctgaccaacttgggagccccagctgcgttcaagtactttgatacaactatcgaccggaaaaggtataccagcacaaaggaagtactagatgccactctgattcatcagtccatcaccggcctctacgagacgcgcatagacctgtcacaacttggtggcgactga

SEQ ID NO: 3108 - RNA, 4107 nt, synthetic construct
  misc_feature 1..4107: note = Cas9 variant
  source 1..4107: mol_type = other RNA
atggacaagaaatacagcatcggcctggatattgggaccaactccgtgggatgggccgtcataacagacgattataaggttccctctaaaaagttcaaagtgctcggtaatactgacagacactcaatcaagaagaaccttattggcgctctgttgtttgatagtggggagacggcagaagccaccaggttaaaacggacagcgcgccgacgttacactagaaggaagaatcggatctgctatctgcaggagattttcagcaacgaaatggctaaagtagacgattcctttttccatcgcctagaggaatcttttctcgtggaggaggacaagaaacacgaaagacatcctatcttcggaaatatagtcgatgaggtggcctaccacgaaaagtatccaaccatctaccatctgaggaagaaacttgcagactcgacagataaggccgacctgcggttgatttatctcgctctggcacacatgatcaaatttcgcggccacttcctgattgagggtgatctcaacccggacaattcagacgttgataagttatttatccaactggtgcagacctacaaccagcttttcgaggaaaatcccataaacgccagccgagtcgacgctaaagccattttgagtgcgagactgtccaagtctaggcggctagagaatctcatcgcacagctgcctggggaaaaacgtaacggactttttggcaatctgattgccttgagcctcggcctgactccaaacttcaagtccaattttgatttagctgaggacgccaagctgcaactctcaaaagatacatacgacgatgaccttgataacctgttggcacagatcggggaccagtatgctgatctattcctggccgcgaagaacctcagtgacgccatcctgcttagcgacattctgcgcgtaaattctgaaataaccaaagcacccttgtccgcttcaatgatcaagagatacgatgagcatcaccaggacctcacgctgttaaaagccctggtgaggcaacagctacctgagaagtataaggaaattttctttgatcagagcaaaaacggatacgctggttatatcgacggcggggccagtcaggaggagttctacaagtttataaaaccaattctcgaaaagatggatggaactgaggaactgcttgcaaaattgaatcgggaggacctgctccgaaagcaacgcaccttcgataacggctctatcccccatcagatccacctgggtgaacttcacgccattctgagaaggcaggaggacttttatcctttcttgaaggataatcgggaaaagatcgagaagattctcacatttcgcataccatactacgttgggccgctggctagaggaaactccaggttcgcgtggatgactcgtaaaagcgaagagaccatcacaccctggaattttgaggaagtggtcgacaagggcgcatcggcccaatctttcattgagcggatgaccaactttgataaaaatttacctaacgaaaaggtgctgccaaagcattccctactctatgagtacttcacggtgtataatgagctgactaaagtcaagtacgttacagaaggcatgcgaaaacccgagtttctttcaggggaacagaagaaagctatcgtggacttgctgttcaagaccaacagaaaagtaactgtgaagcagctcaaggaggattatttcaaaaagatcgaatgttttgacagtgtcgagattagcggagtggaggacaggttcaatgcctccctgggtacataccacgatttactgaaaataatcaaggacaaagattttcttgacaacgaagagaatgaagatattttggaggacatcgttctcaccctgacgctattcgaagatcgcgagatgattgaggaacggctgaagacctatgcacatctctttgacgataaggtgatgaaacagctgaagagaaggcgctacacaggctgggggcgactttctcggaaattgatcaacggaatacgtgacaagcaaagcggcaaaactatcctggatttcttaaagtcagacggttttgccaacagaaatttcatgcagctcattcacgatgacagtctgacctttaaggaggacatccagaaagctcaggtctccgggcaaggcgatagccttcatgaacacattgccaacctggcaggatctcctgcgatcaagaaaggcatattgcagacagtgaaggtagttgacgagctcgtgaaagtcatggggaggcacaagccagaaaatattgtgatcgagatggctcgcgagaaccagactacccagaagggacagaaaaattcacgggaaagaatgaagaggattgaggaaggtatcaaagagctgggcagtgatatactaaaggagtaccccgtcgaaaacacacagctgcagaatgagaaactctatctgtactatcttcagaacgggcgagacatgtacgtggatcaagaattggacatcaatcgcctgagcgattatgacgttgatcatattgtgccgcagtccttcatcaaggacgattctattgacaacaaagtattaacccggtcggacaagaatagaggaaagagcgataacgtcccttccgaggaagtggttaaaaagatgaaaaattactggaagcagctcctgaacgccaaacttatcactcaaaggaagtttgacaatctgacgaaggcagagcgtggcggtctatcagagctcgataaagccgggttcataaagcgccagctggtggaaacacggcagattaccaaacacgtcgctcagatcttggacagtagaatgaacactaagtatgatgagaacgacaaactgatcagggaagtgaaggtaattaccttaaagtctaaactcgtgagcgattttcgaaaggacttccaattctacaaagttcgggagatcaataactaccatcacgcccacgatgcatatctgaatgctgtcgtgggcacagcccttattaagaaataccccaagctggaatccgagtttgtgtatggagactacaaggtctatgatgttcgcaaaatgatagcgaagtcagagcaggaaatcggcaaagccaccgctaagtacttcttttatagcaacattatgaatttctttaaaactgagatcacattggcaaacggggaaattagaaagaggccactcatcgagacgaatggagaaaccggtgagatagtgtgggacaagggccgggatttcgccactgtgcgaaaagtactgtctatgcctcaggtcaacatcgtgaagaaaacagaggttcagaccgggggattttccaaggaaagtattctacccaaaagaaatagcgacaagctgatcgctcgcaaaaaggactgggatccaaagaaatacggcggtttcgactctcccacagtggcctactccgtccttgtggttgcaaaggtggagaaagggaagagtaaaaagctcaagtcagtaaaagaactgttgggcattactatcatggagaggagctcgtttgagaagaaccctatagatttcctggaagcgaaaggatataaggaggtccgtaaagacttaattatcaagctcccaaagtactccctgtttgaacttgagaatggccggaaaagaatgctggcctctgctggggaattgcaaaagggaaacgagctcgccctgccgagcaaatatgtgaatttcctatacctggcatcacattatgagaaacttaaaggcagtcccgaagataacgagcagaagcaactcttcgtggaacagcacaagcattacctggacgagatcattgaacaaatatccgagttttctaaaagggtcatcttggctgatgccaatttagacaaggttctgagcgcatataacaaacaccgcgataagcctattcgagagcaggccgaaaacatcattcatctcttcaccctgacgaattttggtgctccagcggccttcatctactttgacaccacaatagggagaaaccggtacaaatccatcaaggaggtgcttgatgcaactctgattcaccagtcaatcaccggattgtatgaaacaaggattgacctaagccaactgggcggtgattga

SEQ ID NO: 3109 - RNA, 4107 nt, synthetic construct
  misc_feature 1..4107: note = Cas9 variant
  source 1..4107: mol_type = other RNA
atgaagtacgagagcgaagagtattacatcggcctggacatggggacctcctctgtgggatgggccgtcacagatccccactatcatctcattagaaagaagggtaaagacctttggggcgctaggctgttcgaaaaggcaaacactgcccaggagcggcgcacgaatcgaataaaccgtagaaggaatcaacggcgcaaacagagaatcgcgtttattagggaggctttccggaaggaggttgagaaggtggatgtaaactttttccgccgattggacgaatcacagttatacctggaggataaaagtatcaaggaaccttatctactctttaatgacctgaactacaccgataaagacttctatcaccagtacccaacagtgtttcatcttattactgatctgttgaccagcgacagaaagttcgatatcagggagatatacatcgccgtctcctctctctataatcaccgggggaactttctgaataaatcgctgggaaacgagacacaagacgaagatctcgtgttcaagaatttagacgaggcattttcagcctgcggcatgaactggaataccaaggctgaaaacattgaggttgtgaaacagatcctgtgtgaccgtagccttaataagaaagaaaagcaggatcagttggcacattgcctggagattaacaaaaagactgagaaagaaaagatcgagttcctaaagctcctgacaggtgggaaagccgacagtaagaaaatgtttccgcaataccactatgaacgcgatgagaaactttccttcgctttcgccgacgaaaacggagatgagaattgggaggaaaccctgaacgcgatagaggaaagattgacgtctgacgagtacggcctcattctggcattaaaaagcgtctatgattggtccatcctggccgacctcatgaagaatgaaaagactggcgagacctacccctatctttcaatggctaggaaagatagttacgagaagcacaaagccgacctgcggttgctaaagagcgtgattaaacgactgatccctaacgaatacaatcatttcttccgccagtatgatgggaagggaaagacatacactaactatatcggttctgtacagtaccacgagaaaagacataggtttaagcacattaccacaaaagaattttatgacggcctcaagaaactgcttaagccatactccgaggacgaggaaataaagcagatcctgcaagatattgagtcagaaacctttttgcccaaacagatcacgaatatgaacggggttatacctaatcaggtgcacgcaaaggagctcaaagtcattctggaaaaggctagccaacattatgacttcttaaacgagactaatgagagtggactgacagtgaaagaacagatcatgcagatgtttaccttccagatcccatactacgtgggccccctagccaacctcaatggtaaggggaacggatgggcggtccggtatgttggcaaagagcgcactaaggtgtacccttggaatatggatgaagtaattgacgagaaggaaacagccgatcaatttatcaaaagaatgatttctacctgtacgtatctgggcgacgagtacgtgcttccaaagtccagcatattgtatgagaaattcgcagtcctgaacgaactcaactcgctgaagatcaatgggcagccggtgtctgttgatcttaaacagaagatttacagggacctgtttaccaagggaaaacgtgtgacacagaagggtttgctcctgtatttaaaacgggagggcgtcatctccaagtcagaagagactatcctgagtgggttcgatattgactttaaaaacaccctaagctcctaccgaaagttctgcgaagtgttcgctacaaatgagctcaacgatgagcaaataagaatggccgaagacatcattgagtggctgactgtatttggagattctaagaaattcgttagggaaaagatccacggcaattacccccagattaccgctaaccagcttaaacgcatcttgagctttaatttcaaggactggggtaaactgtcaaagcagtttctcgagctggagggggaagaccgggagacaggcaagagttgttccttaatacaagccctgtgggataccaacaataaccttaatcagttgctcagctctagattcacttataaagaaaacctggagaagaaaaggaagaaaatcgaaatggacctatttgagttcacgcatgaggatctggacgatctctacatttcagcacctgtgaagcgcatgatctggcaggccctgaaaattatgaaggacatcgtcatagtgatgaaggaaagtccaacaaaactttttattgagatgacccgaaataacgaaaatgagaagactcggaccgtcagccgtaaaaacaagttggtggatctgtataaaaagatcaagggagaatccagagactggattaaagagttagagaggtacgaagagaaggatttccgctctaaaaagctctatctgtactatacacagatgggcaaatcggcttacagcggggaacccatcgacatggataaactttttgacaagaacgtttacgatatagaccacatctatcctaagtccaaggtgaaagacgattcactgttgaataactgcgtactcgtcaagcggaaagagaatatggacaagggaaacaatttcccaattgatcccgacatccaaaccaagcaggaacatctgtggaaattttggctagagaagggtctgattactcaggagaaattcaacagactcacaaggaagaaaccgttcacgaatgatgaactggcggactttgtgaaccgacaacttgttgagaccggccaggcaactaagacaatcgccgatttgttcaagatgacctttcctaatagtgacatagtgtacgtcaaagctgggaacgtgacagatttccgccagtatattgaagtatacaagtgtcgggaggtgaataacctgcaccacgcctatgacgcatacttaaatgttgtcgtgggaaacgtgtatgatactaaatttaccaagaatcccatgaactacatcaaagagcagagaaaggaaaactctaatgagaggtaccatatggacaaaatcttcgaatttccagtcattcgtaacggcaaggaggcctggatcacgaagaaagacgaaagcattaatatagttcgcaagaccctcgctcggaaaacacctctggtgactaagagaaacttcgaggccaatggtaccatcgcaaaagcgacaatttatcccaaggggaacgtgaaggatcaaggctaccttccaaggaaaacttccatccccgctctgcgagacatgaagaaatatggaggcgtaacctcaattcagatcgcctactttttcctagtcgagcacgaagtgaagaaaaagcggatacgcacgatcgagtgcgttcctatttatagaaaggaagaactcaaaacaaaggaacagctggagaggtactgtcgggaggaattgaaactgatcaatccaagcattcgattagagaagatcaaaccgtattctctcctgaagatgaacgggaactttttctacataaccggaaagactaatgatagattctcccttgcaaatgccatggaactgtacgtggacaaagtcagtgagaaccatattcgcgatttggtgaagtataaaaattgcggttactttaacgttgacgataaggaagctaggaaacgtaatgagcggctctatacaatcctgaccaagaaacacctaactgtgttcaagggcagccccaagcctatgggggagaaactgcagcaataccagcagctttttctcgaactggaggtatctaagcaggtctatgtgttgctgcaaatcttacagctcaccgccacaaacgtgaaaacgaaggcagacctgaccgctattggaggcaaagccaatgaaggtactatggatatatccaagaaccttgagaacgtcatcaagaatcagattaaaaaggggctggttccagagttgatgctcatcaaccaatcacccacaggcctgttcgaaagtgagattgacctactgaccatctga

SEQ ID NO: 3110 - RNA, 4107 nt, synthetic construct
  misc_feature 1..4107: note = Cas9 variant
  source 1..4107: mol_type = other RNA
atgagcagaccctacaacatcggcctggacattgggacctcctctataggatggtcagtggtcgatgaccagagtaagctcgttagcgtgaggggtaaatatggctacggggtacggctttatgatgagggacaaacagccgctgaacgccgatccttccgtactacgagaaggcggctgaagcgcagaaaatggaggttgggcttactgcgggagatctttgaaccttacattaccccagtggacgatacattctttctacgcaagaaacagtctaatctctcgccgaaggaccagcgaaagctgtatccccagacttcacttttcaacgatagaaccgacagggcattttacgatgactatcctacaatctaccatctgcggtacaaattgatgaccgagaagcgtcaattcgatattcgcgaaatctatctcgccatgcaccacatagtcaaatacagaggtcattttctgaatgaggcgccagtgagcagtttcaagtcctctgagatcaacctggttgctcactttgacaggctcaatactattttcgccgatttatttagcgaatccgggttccagctggagacagacaaacttgcagaagtgaaggccttgctgctagacaaccatcagtcagctagtaatcggcagcgacaagcactcctgcttatctatacccccagcacgaacaaggccgtcgagaaacagaataaggctattgccactgagctgttgaaagcgatcctcggactgaaggcaaaatttaacgtgttaaccggcatagaagccgaggatgtaaagacatggactctgaccttcaatgctgaaaacttcgacgaggaaatggttaaactcgagtcttcccttgatgacaatgcccaccagattatcgagtcactgcaggaattgtacagcggcgtgctactggcagggattgtccctgagaaccaaagtctctctcaggctatgatcacaaagtatgatgaccaccagaagcatctgaaaatgcttaaggccgtgcgcgaagcgctggccccagaggatagacaaaggttgaaacaggcatacgaccagtatgtggatggacaggaaaataccaaggcttactccaaagaggacttttacggtgatatcacgaaggccctcaagaacaaccccgaccaccctattgtcagcgagataaagaagctgatcgaattagaccaattcatgccaaaacagcggactaaggataatggcgctattccgcatcagctgcaccagcaagagctagaccgcatcatagaaaaccagcagcagtattacccctggctcgccgagctgaatcctaactcgaaaagacaaacagttgcaaagtataaacttgatgaattggtggcctttagggtaccatactatgtggggcccctgattaccgctgagcagcagcagcaatcttccgacgcgaaattcgcatggatgatccgtaaggccgagggacagatcactccttggaattttgatgacaaagtcgatcggcaggcttcagccaacgagttcattaagcgaatgacaaccacggacacctacctcctggcagaggatgtgcttccaaaacaaagtctgatctatcagagatttgaagttttgaatgagctcaacggcctgaagattgacgatcagcccataacaactgagttaaagcaggccatcttcaccgacctgtttatgcagaaaacaagcgtgactgtcaagaatattcaggattacctagtgtccgaaaagaggtacgcttctcgcccggccatcaccggtctcagcgacgagaacaagttcaattcacggctgagtacatatcacgaccttaaaaccatcgtaggggatgcagttgacgatgtggacaagcaggcggatttggaaaaatgcattgagtggtccactatatttgaagacggaaagatctacagcgctaagctgaacgagattgattggctcacggaccagcaaagagtccagctggccgcaaaaaggtatcgcggctggggccgattatctgccaagctgcttacacagatcgtgaatgctaacgggcagcggattatggatttgctctgggacaccactgataatttcatgcgtatcgtccattcagaggactttgataaactgataaccgaagccaaccaaatgatgctagcagagaacgacgtgcaggacgttatcaatgatctgtacacaagtcctcagaacaagaaagctctcagacaaattctgcttgtggtaaatgacatccagaaggccatgaagggacaggcgcccgaaaggattttgatcgagttcgcccgcgaagatgaggtcaacccacggctgagcgtgcagagaaaaaggcaagttgaacaggtgtatcagaatatatccaacgaattactcaataacaccgagattcgaaatgaactgaaggacctttctaactcggctctgagcaatactcgcttgttcctctactttatgcagggtggccgggatatgtatacaggggactccctgaacatcgatagactatcaacgtacgacattgatcacatcctgcctcaaagtttcataaaagacaattctctcgataacagggtcctggtgagccagcgtatgaatcgctccaaggcagaccaggtacccaccgactttacttcagtggagcttggacagaaaatgcaaatccagtgggaacagatgttgcgggccggcctgattacaaagaagaaatacgataacttaaccctcaacccagaccatatcagcaagtatgctatgaaaggtttcattaatagacagctggttgagacaaggcaagtcatcaaacttgccactaacctgctaatggagcagtacggggaagataatatagagctcattaccgtgaaatctggcctgacgcaccagatgcgaaccgaatttgacttccccaagaaccggaatttgaacaatcatcaccacgcatttgatgcgtatctgacagccttcgtgggattatacctcctgaagcgctatcctaaacttaagccatactttgtctatggcgagtaccaaaaggcttcccagcaggacaagtggagaaacttcaattttctgaacgggttgaaaaaggatgagctcgttgacgaaaatactgaggccgtgatctggaacaaagaaagtggactggcatacctaaataagatctatcagttcaagaaaattctggtgaccagggaggtacatgaaaacagcggtgctctttttaatcaaacactctacgccgcaaaggatgacaaagcctctggccaagggggaaagcagctgatcccggctaaacaggatcggcccactgcgttgtatggcggttactccgggaagaccgtcgcctatatgtgtattgtgcgaataaagaacaaaaagggcgacctgtacaaagtttgcggagtggagacgtcatggttagcacaactcaagcagctgacagatgaggacagtaaaaaggctttccttaagcagaaaatcagccctcagttcaccaaggtcaaaaagcaaaaaggcactattgtgaaggttgtggaagactttgaggtaatcgccccacacattctgatcaaccagagattctttgataatgggcaggaattgacactcggatcggccacctataagcataacgagcaagaactgatactagacaaaactgctgtcaagctgcttaatggtgcactccccctgacccagtccgaggagttggccgaacaggtgtacgatgagatcttagaccaggtgatgcactacttccctctgtatgatacaaaccaatttcgcgcgaaactctctgctggcaaggccgcattcatgaaactgccatggaaaagccagtgggacgggaataagatggtccaggttggacagcaagtgattcttgatagggtactgatcggcttgcacgccaacgctgcagtgtcagacctaggtgtcctgaaaattagtacgcccctcgggaagatgcagcagccgtccggcatctctctgagccctgatacccagataatttaccaatccccaactggactttttgaacgtcgggtggccttaagagacctgtga

SEQ ID NO: 3111 - RNA, 4107 nt, synthetic construct
  misc_feature 1..4107: note = Cas9 variant
  source 1..4107: mol_type = other RNA
atgagcagaccctacaacatcggcctggacattgggacctcctctataggatggtcagtggtcgatgaccagagtaagctcgttagcgtgaggggtaaatatggctacggggtacggctttatgatgagggacaaacagccgctgaacgccgatccttccgtactacgagaaggcggctgaagcgcagaaaatggaggttgggcttactgcgggagatctttgaaccttacattaccccagtggacgatacattctttctacgccagaagcagtctaatctctcgccgaaagaccagcgaaagctgtatccccaaacttcacttttcaacgatagaaccgacagggcattttacgatgactatcctacaatctaccatctgcggtacaagttgatgaccgagaaacgtcagttcgatattcgcgaaatctatctcgccatgcaccacatagtcaagtacagaggtcattttctgaatgaggcgccagtgagcagtttcaaatcctctgagatcaacctggttgctcactttgacaggctcaatactattttcgccgatttatttagcgaatccgggttccagctggagacagacaaacttgcagaagtgaaagccttgctgctagacaaccagcaatcagctagtaatcggcagcgacaggcactcagcctgatctataccccctctacgaacaaggccgtcgagaagcagaataaagctattgccactgagcttctgaaggcgatcttgggactcaaagcaaagtttaacgtgctgacccgcatagaagccgaggatgtaaaggcttggacattaactttcaatgccgaaaacttcgacgaggaaatggttaagctggagtcctcactcgatgacaatgcacatcaaattatcgagagccttcaggaactgtacagtggcattttgctagctggcatcgtgcctgagaaccagtctctgtcccaagccatgatcatgaaatatgatgaccaccagaagcacctcaagatgctgaaagcggtcagagaagcccttgcaccagaggataggcagcggctgaagcaggcttacgaccaatatgtggatgggcaggaaaataccaaagcctacagcaaggaggacttttacggagatattacaaaggctttgaagaacaaccccgaccatcctatagtgtcggagatcaagaaactcattgaactggaccagttcatgccaaagcagcgcaccaaagataatggtgccatcccgcaccaattacatcagcaggagctggacagaataattgaaaaccagcaacagtattacccctggctagcagagctcaatcctaactctaagaggcagacggtcgccaaatataagctggatgaacttgttgcttttcgtgtgccatactatgtaggccccttgatcactgcggagcagcaacggcagtcctcagacgcaaagttcgcctggctgatccgaaaagctgaggggagaattacaccttggaattttgatgacaaggtggataggcaggccagtgcaaacgaatttatcaaacgcatgaccactacagacacctacctcctggccgaggatgtccttccaaagcaaagcctgatttatcagcggtttgaagtgttgaatgagctcaacggactgaaaatagacgatcagcccatcacgaccgagttaaagcaggctattttcacagacctgtttatgcaaaagacttccgtttctgtgaaaaatatccaggattacctagtcagcgaaaagagatacgcctcaaggccggcaatcaccggcctcagtgacgagaacaaattcaattcccgcctgagcacatatcacgaccttaaggcgattgtgggtgatgctgtagaagacgttgataaacaggtggacttggagaagtgcgtcgaatggtctactatatttgaggatgggaaaatctactcagccaagctgaacgagattgactggctcaccgatcagcaacgagtgcagctggcagccaagcggtatcgtggatggggcagattaagtgctaaactgcttacacagatcgtcaatgccaacggccagaggattatggacttgctctgggataccactgacaatttcatgcgcatcgtgcacagcgaagattttgacaagctgataacggaggcaaaccaaatgatgctagctgaaaacgatgttcaggacgtgatcaatgacctgtacacatcccctcagaacaaaaaggccctccggcaaattctgcttgtagtcaatgatatccagaaagcgatgaaggggcaggcccccgagagaattttgatcgagttcgctagggaggacgaggtgaacccacgactgtctgttcagcgcaagcggcaagtggaacaggtctatcagaatatatcgaacgagttactcaataacaccgaaattagaaatgagctgaaagatcttagcaactccgcactgtcaaatactaggttgttcctctactttatgcagggaggtcgtgacatgtataccggcgatagtctgaacatcgaccgcctatctacatacgatattgaccatatcctgcctcaatccttcataaaggataatagcctcgacaaccgggtgctggtatcacagaaaatgaatagaagcaaggccgatcaggtgcccaccgactttacttctgttgaacttgggaaaaagatgcagttgcaatgggagcagatgctgagggctggattaatcacaaagaaaaagtacgacaacctcacgctgaacccagatcacatttccaaatatgccatgaagggcttcatcaatcgacagcttgtcgagacccgccaggtgattaaactggcaactaacctactcatggaacaatacggtgaggacaatatcgaactgataacagtgaagagtgggttgacccatcagatgcggacagagtttgatttccccaagaacagaaatctgaacaatcaccatcacgcgtttgacgcctatttaactgctttcgtcggcctctacctgcttaaaaggtatcctaagctgaaaccatactttgtttatggagagtaccagaaggccagccaacaggataaatggcggaacttcaatttcttgaacggcctcaagaaagacgaactggtggatgagaataccgaagcagtgatttgggacaaggagtctgggctagcttacctgaacaagatctatcagttcaaaaagatccttgtaacgcgagaagtccacgaaaattccggagccctctttaaccagaccctgtacgcagccaaagatgacaaggcttcaggtcaaggcgggaaacagttgattccggcgaagcaggatagacccacagccctgtatggaggctacagtggtaagactgtggcatatatgtgtatcgttcgcattaaaaataagaaaggggacttatacaaggtgtgcggcgtcgagaccagctggctcgctcagctgaaacaacttacagatgaagactcgcagaaggccttcctgaagcagaaaatatcccctcagttcactaaggtgaaaaagcaaaaaggaaccatcgttaaggtggtagaggactttaaggtcattgccccacatatcttgattaaccagaggttctttgataacggccaggaactcacgctggggtctgctacatataaacacaatgagcaagaactaatcctggacaagaccgcagtgaaacttctcaacggagccctgcccttgactcagagcgaggagttagcggaacaggtgtacgatgagatactggaccaggtcatgcattacttccctctctatgatacaaatcaatttcgtgctaagctgtcagccggtaaagcagccttcatgaaacttccatggaagagtatctgggacggcaacaaaatgacccagattgggcagcagatcattctggatcggatcttgataggactacacgctaatgcagccgtttccgacctgggcgtgctcaagatttctactcccctgggtaaaatgcaacagccgagcgggatctccctttcacctgatacccagatcatttaccagagcccaacaggcttatttgaaagaagggtagcgctgcgcgacctctga

SEQ ID NO: 3112 - RNA, 4107 nt, synthetic construct
  misc_feature 1..4107: note = Cas9 variant
  source 1..4107: mol_type = other RNA
atggtggagaagaaaagctactccatcggcctggacattgggaccaactctgtcggatgggccgttataacagatgactataaggtgcccgctaaaaagatgaaagtactcggtaatacttcaagacagagtatcaagaagaacatgattggcgcacttctgttcgatgaagggggacctgccgcgagcacgagggtgaaacggaccacacgccgacgttacactagaaggaagaatcggttgtgctatttacgcgacatctttgagtccgaaatgcacaccattgataaacatttctttctgagactagaggactctttcctccacaagtcggataaaaggtacgaagctcatccaatctttggcacactgcaagaggagaaggcctatcacgacaactacccgaccatatatcatcttcggaaggcactggccgataatactgaaaaagctgacttgcgcctcatctacctggcactggcccacattatcaagttccgaggtcactttctcattgagggggctttatcagccaacaatacagatgtccagcagctggtgcatgcgcttgttgacgcatacaacatcatgttcgaagaggatcagttggacatagaggccattgacgtgaaagctatcctgaccgaaaagattagcaaaacgagaaggctagagaatctcatcagtaacatccccggacaaaagaaaaatggcctgtttggcaaccttattgccctgtccttggggctcactcctaatttcaagtctcactttaacctgccagaagatgcaaagttacagctggctaaagacacctatgatgaggaactcaataaccttctgacacagataggagacgagtacgccgatttgttcctaagcgcgaagaacctgtccgacgccatcctcctgtcagatattcttactgtcaatggtgacggcacccaggcacccctgagtgctagcttgatcaaacggtatgaggaacatcgtcaagatctcgccctgttaaagcagatgtttaaagagcagctgcctgacctataccgcgatgtgttcacagacgaaaacaaggacgggtatgctggatacatatctggcaagacctcccaggaggccttctataaatacattaagccaatcctcgaaacgctggatggtgcagaggactttcttactaaaatcaatagagaggatttcttgaggaagcaacggacatttgacaacgggtcaattccccaccagatccacctgggagaactccaggccattctggagcgacaacaggcttactatcctttccttaaagataatcaggaaaagatagagaagatcctgacctttcgcattccatactatatcggcccgttggcgagaggcaacagcaggttcgcatggctcactcggacaagtgaccagaaaatcaccccctggaattttgatgaaatggtagaccaagaggcctctgctcaggccttcattgagcgcatgacgaactttgatgaatacctgcctcaggagaaggttttaccaaaacattccctgacctatgaatacttcacagtgtataatgagctaactaaggtcaaatacgtgaccgaggggatgacaaagcccgaatttctcagcgcaggacagaaggagcaaatagtggaactgcttttcaaaaagtacagaaaagtcactgttaagcagttgaaagaggactttttctcgaagatcgaatgtttcgataccgtggacatttctggtgtagaggataaatttaacgcctccctgggcacatatcacgacctcctgaagatcattaaggacaaggctttcttagataattcagagaacgaaaatatcatagaggacatcattctgacccttactttgtttgaagataaagagatgatcgccaacaggctcgcagtgtacgaagacctgttcgatcagaatgtcctaaaacagctgaagcgtcggcattatacggggtggggacgactcagtaaacaactgattaacggcatgagagacaagcacacaggtaagaccatccttgattttctaaaagcggacgggttcataaacaggaattttatgcagctgattaacgatgacaatctgagcttcaaggaggagatcaaaaaggctcaggaaggcggactcaaagattccattaacgaccagatccgcgatctggccggctctcctgcaataaagaaggggatccttcaaactattaatatcgtggacgagattgttaaaatcatgggaaaggccccacagcatatagtggtcgaaatggctcgggacgtgcagaaaaccgatattggtgtaaagcaaagcagagagaggatgaaacgcgttcaggaagtgctgaagaagttgggctcacagctcctgaaagagcaccccgtcgagaactttcagctacaaaatgaacgactgtacctctattacctgcagaacgggaaggacatgtatacaggagaggaacttagtatctccaatttgagccactacgatatcgaccatattatcccgcggtctttcattaaagatgactcaatagataacaaggtgctgacccgtagtgagcacaatagaggcaaaactgacaacgtccctagcatcgaggtggttaagaggatgaaaccctactggcagaagttactcgatacaaaggtgatttcccagcgcaaatttgacaatctgacgaaggccgaacggggtgggcttcaagagtctgataaagcaaacttcatccagagacagctggtagaaaccaggcagattactaagcatgtcgctcaaatcctagactcgcgatttaatacagagcgcgacgaaaaagatcggccaataagaagggtgaaggttatcaccctcaagagcaaattcgtgtccgacttccgtcaggattttggcttctataagctgcgcgagattaacgactaccaccacgcccatgatgcgtatttgaacgccgtcgtgggaacagctctgttaaaaatgtaccctaagctcgcatcagagtttgtatatggcgactaccagaaatatgatctgaagcggatggtggggaagagtggaaaagcctctggtcacgctactgccaagtacttcttttacagcaatcttatgaacttctttaaatccgaagttaagctggcaaatggcaacatcattaaaagatcacccatcgaggtcaatgaagagaccggggaaatagtgtgggacaagacgaaggatttcggaaccgtgaggaaagtcttgagcgcgccacaagttaacattgtgaagaaaacagagatccagactggcggtttttctaatgagaccatcctctccaaggggaaaagtagcaagctgattccccgaaagaacaaatggcgggacacaactaagtatggcggattcaatacccctacggtggcctactctgtattggtcgtggctaaagttgaaaagggcaaagccaagaaactgaagccagtgaaggagcttgtcgggataacaatcatggaacgcaccaaatttgaggcaaacccgattgctttcctcgaatccaagggatatcatgatatccaggagcacctgatgattactttgcccaaatactcactgttcgagttagaaaatggcagaaggcggctcctggccagtgcaacagagcttcagaagggtaacgaaatggtgctgcctcaacatttggttacctttctctatcgagtgagcaaaagagacaaggggactcagtcggagaatatggagtacatctccaaccacaaggaaaaattcatagagatctttcactatattatccgctacgccgaaaagaatgtaattaaaccaaaggtcatcgagaggctgaacgataccttcaaccagaaatttaatgactctgacctaacagaactgagcatatcattccttaacctctttaagttcacgagttttggagctcccgagaagttcacctttttaaattccgagattaaacaggatgacgtgcgttaccggtctactaaggaatgcttgaacagcacattaatccatcaatccgtgaccggcctgtatgagacaagaatcgatctctcacagttcggtggcgactga

SEQ ID NO: 3113 - RNA, 4107 nt, synthetic construct
  misc_feature 1..4107: note = Cas9 variant
  source 1..4107: mol_type = other RNA
atggacaagaaatacagcatcggcctggatattgggaccaactccgtgggatgggccgtcataacagacgattataaggttccctctaaaaagttcaaagtgctcggtaatactgacagacactcaatcaagaagaaccttattggcgctctgttgtttgatagtggggagacggcagaagccaccaggttaaaacggacagcgcgccgacgttacactagaaggaagaatcggatctgctatctgcaggagattttcagcaacgaaatcgctaaagtagacgattcctttttccatcgcctagaggaatcttttctcgtggaggaggacaagaaacacgaaagacatcctatattcggaaatatcgtcgatgaggtggcctaccacgaaaagtatccaaccatttaccatctgaggaagaaacttgcagactcgacagataaggccgacctgcggttgatctatctcgctctggcacacatgattaaatttcgcggccacttcctgatcgagggtgatctcaacccggacaattcagacgttgataagttatttatacaactggtgcagacctacaaccagcttttcgaggaaaatcccattaacgccagccgagtcgacgctaaagccatcttgagtgcgagactgtccaagtctaggcggctagagaatctcattgcacagctgcctggggaaaaacgtaacggactttttggcaatctgatcgccttgagcctcggcctgactccaaacttcaagtccaattttgatttagctgaggacgccaagctgcaactctcaaaagatacatacgacgatgaccttgataacctgttggcacagatcggggaccagtatgctgatctattcctggccgcgaagaacctcagtgacgccattctgcttagcgacatactgcgcgtgaataccgaaatcacgaaagcacccttgtctgcttccatgattaagagatacgatgagcatcaccaggacctcactctgttaaaagccctggtaaggcaacagctacctgagaagtataaggaaatcttctttgatcagtcaaagaacggatacgctggttatatagacggcggggccagccaggaggagttctacaagtttattaaaccaatcctcgagaagatggatggaaccgaagaactgcttgcaaaattgaatcgggaggacctgctccgaaagcaacgcacattcgataacggcagtatcccccatcagattcacctgggtgaacttcacgccatcctgagaaggcaggaggacttttatcctttcttgaaggataatcgggagaaaattgaaaagatactcacttttcgcatcccatactacgttgggccgctggctagaggaaactctaggttcgcgtggatgacccgtaaatccgaagagacaattaccccctggaattttgaggaagtggtcgacaagggcgcaagcgcccaatcgttcatcgagcggatgacgaactttgataaaaatttacctaacgaaaaggtgctgccaaagcattctctactctatgagtacttcactgtgtataatgagctgacaaaagtcaagtacgttaccgaaggcatgcgaaaacccgcttttctttccggggagcagaagaaagccatcgtggacttgctgttcaagactaacagaaaagtaacagtgaagcagctcaaggaagattatttcaaaaagattgagtgttttgactcagtcgaaataagtggagtggaggacaggttcaatgcaagcctgggtacctaccacgatttactgaaaatcattaaggacaaagattttcttgacaacgaggaaaatgaggatatcttggaagacattgttctcacgctgaccctattcgaggatcgcgaaatgatcgaggagcggctgaagacatatgcccatctctttgacgataaggtgatgaaacagctgaagagaaggcgctacactggctgggggcgactttcccggaaattgataaacggaatccgtgacaagcaatctggcaaaaccattctggatttcttaaagagcgacggttttgctaacagaaatttcatgcagctcatccacgatgactcactgacatttaaggaagaccttcagaaagcccaggtcagtgggcaaggcgattccctgcatgagcacattgcaaacttggcgggaagccctgctatcaagaaaggcatactccagactgtgaaggtagttgacgaactggtgaaagtcatggggaggcacaagccagagaatattgtgatcgaaatggcccgcgagaaccagaccacacagaagggacagaaaaattctcgggagagaatgaagaggattgaagagggtatcaaagaactaggctcagatatactgaaggagtaccccgtcgagaccactcaactccagaacgaaaaactgtatctttactatttgcagaatgggcgagacatgtacgtggatcaagagctggacatcaaccgcttaagtgattatgacgttgatcatattgtgccgcagagcttcctcaaggacgattccatcgacaataaagtactgacgcggtctgacaagaacagaggaaagtcggataatgtccctagcgaagaggtggttaaaaagatgaaaaactactggaagcagcttctgaatgcaaaactaattacacaaaggaagtttgacaacctcaccaaggccgaacgtggcggtctgtccgagttggataaagctgggttcatcaagcgccagctggtggagactcggcagataaccaaacacgtcgcccagattttagactcaagaatgaatacaaagtatgatgaaaacgacaaactcatcagggaggtgcgagtaatcaccctgaagagtaaacttgtgtctgattttcggaaagacttccaattctacaaggttcgcgaaattaacaattaccatcacgcacacgatgcttatctgaacgccgtcgtgggcactgcgttgatcaaaaagtaccccaaactcgagagcgaatttgtgtatggagactacaaggtctatgatattagaaagatgatagccaaatccgagcaggagatcggcaaggctacagcaaaatacttcttttattcaaatattatgaacttctttaagacggaaatcaccctggccaatggggagattaggaaacggccactaatcgaaactaacggagagacaggtgaaatagtttgggacaagggccgagatttcgctaccgtgagaaaggtgctgagcatgcctcaggtaaatatcgtcaaaaagacagaggtgcagactgggggattttctaaagagtccattcttcccaagcgcaacagtgacaaactcatcgccaggaagaaagactgggatccaaagaagtacggcggtttcgacagccccaccgttgcatactctgtgctggtcgtggcgaaagttgaaaaggggaaatccaagaaattgaagtcagtgaaggagctggtaggcattacgatcatggaacgtagtagctttgagaaagatcctgtcgacttcttagaggccaagggatataaagaagtgcggaaggatctcataattaaactgccaaagtactcgctttttgagctggaaaatggcagaaagaggatgttggcttccgccggggagctccaaaaaggaaacgaactggcactaccgtctaagtatgtgaatttcctgtaccttgctagccattatgagaaactcaagggctcacccgaggacaacgaacagaaacagctgttcgtcgagcagcacaagcattacttggatgaaatcatcgagcaaattagtgaattttccaagcgcgttatattagccgacgcaaatctggataaagtgctctctgcctataacaagcaccgagacaaacctatcagagagcaggctgagaatattatccatctgttcacccttacaaacctgggtgcgccagccgcatttaagtgcttcgatactaccattgggcggaacaggtacaaaagcatcaaggaagtattggacgctacactaatacaccagtccatcactggactgtacgagacccgcattgatctctcacaactgggcggtgactga

SEQ ID NO: 3114 - RNA, 4107 nt, synthetic construct
  misc_feature 1..4107: note = Cas9 variant
  source 1..4107: mol_type = other RNA
atggacaagaaatacagcatcggcctggatattgggacctcctctataggattcgtgggtgtcgacgagaacggctggcccctcaatatcaaggggaaaagagccattggagctcacctttttagggaaggcgaggcagccgcggaaacacggggtttccgcactacgcgacgtagatataacaggcggaagtggcgcctgagattgttaagggagatctttgatgaacctatttcacgggttgacccaaccttctttgctcgcatgaaagagagtagcgtgtccccgaaggatcccaattacgacgggctggccaaggagatcctaatacctcgagataaagacggaaagatcctctatccaacaatttaccatctgagacacgcacttatgtatgaagatcatcagttcgacatcagggagatttacctggccatccaccatatagtaaaatatcggggccactttttgctcgatggcgctgcaaagaacttcgaatcttcgaatctggacctgaaatcagatattcacgagatcaacgccattctcgtggggatctttggaaatgagcaagtccagttcaacgaccagtacgtggaaaagttaaaggaggttctgcttgacagcactcagagtcgttccgatcgccaaaaagctgccgcgaagttgctgctacccaccaatgacctcgataaagacacaaccaagatcctgaaaactgtgtctacagaaattaccaaggcaataacgggtcttaaagccaagtttttcgtcatcactggcaacgatattgctaaggaccagcagaaagattggacctttagcatcgacacactggatgagaagatgtccgtgatagaaccttcattcagtgagaaaaatttcagcttgattactatcctccagaagctgtactcttccgtaaccttagccgggatcgttccaaacggactgtcactcagcgaggcaatgattcaaaaatatgacagacatgctagtgatcttgtgctgttgaagaagtactgggacacaaaacccaaggtcctaaaacaccagctgcagaatacctatgccgaatacatcgagattcatcaggtggtggacgaattttattctgatctctccaagctgattaaaaacgacgatgacacgcttgcgcaagagatcaagagcaagattactatcggcaatttcctgcctaaacagaggacaaccgaaaacggtgtcatcccataccagttgcaacagcgggagctcgatactattataaagaaccagcaggagtattacccgtggctggccgaagagaatcccgttgcagaccaccaaatcgcttttccttacaaattagatgaactggtggggttccgaataccatattacgtaggacccatgatcgccaaggaggacacatcgaactctaaaaattccaagtttgcttggatgattcgcaagcagtcaggcgaagtgaccccttggaacttcgatgagaaaatcgacagaacggccagtgcaaccgcctttatagataggatgacaactaccgacacatatctaatcggcgaggatgtcctcccaaagcagagcctgatttaccagcggttcgaagtgcttaatgagttgaacaaaatctccattgacgggcaacccatcactcgcaagcagaaacagtctgtttatacccacgtgtttgaaaagaaaaagacagtccaggtgaaggacgtacaaaaattcctggttagctcaggagaggtgatgagtctcccgaagataggtggcctggctaatgagaaacagtttaactccagcctttctaccctgtacgattataataagattatccctgacgcgttggaagatagaaacaaagtcgacgatattgagaagatcatactctggtcaactatcttcgaagacaatagtatttttgtggagaagctggatagcatcgactggttaacgtcctctcagaggaaacgtctggcacagaagcggtaccgagggtggggaagactatcgctcaggctgcttacaaccttcaaaaacaaggatggctacagcattttggacgaactgtggaactccaatcataatttcatggagatccaagcccagtcagattttagtgagcagatagctactgccaacaacaataacctctctcaagtcctgcccgcaaaatgggaaccaggtcgcaagaatttagccagcctggacgagttcatttccaacctttatacctcacctcagaataagaaagctctccggaaggccatcagagtggttcaggatatgatgacagcagcggggcacatgcccgaaaagatctttattgaggtggctagggacaccagcaactctcatcagcaaactatcgcccgccagcgacagctccagcaactgtaccagtccgaagacaaggaggtaattgatagtagcgtccggtctgagctagacgatatactgaaaaatcgtgcaaacatcaaggaccagttgttcctgtattttcagcaaggcggaagagatctttacacaggcaaggccattaatatcgacaaattgtccctgtatcacattgatcatatcttaccacagtcactcgtgaaggacgatagtctggacaacagggttcttgtgagccagaaaacgaatgaagataagggggtcaccttcgtgtcggacaaatacatgaacaatatgctgcccacttggaagcgctggcacgagatgggattgatatccgctcggaaactcaagaacctgacaatgagacctgacgaaatcgataagtatgccccaggttttattcaaaggcagctagtagagacccgacaggtgacaaaactggttatcgaactcctggacgcacttttgggcaattctcagactgagattatcaccataaaggctagcctgtcacaccaattccgccagcagtttgatttagtcaaaattcgggaggtgaacgacaaccatcacgccttcgatgcgtttctcgccgctagaatcgggacgtacctgtacaagaggtatccgaaacttcgtccctacttcgtgtatggacagtacatgcaaaatcataagaacctgaagagtatcaatctaattaaaaccctcgactccgataaggcaatagtcgacgaaggcacaggtgagatcctgtgggataaaaagtctgacttggccaaaatgattaagatctataactaccagcgcctgttaattactcacgaaagccggacctcctttggggctatgtataagcagaaaatcctcaaggccacagatgcaaaacagaatggcggaggcttcaagctggttcctactaaaagaaacaggccagtggacatatacgggggatacaccggtcaaacggcggcctatcttacaatcgtgcgagtatactcaaagaagaccagcgagctgcgggtcttgcccatttatactaataaagtgcagcagatcgagaaggctatgacacagggcgataaagccaccatgctcgcattcaagaaagttattgctcctcaactggggaaggaaaacaagaaaactcacgagatcaagataccagaatttgacgtggtcattcccaaagtgctactggaccagcttgttatcgatgacatcgccggaagtccgcatcgcttcagactcggcaccgatacatactatcacaattctcagcaactgtttttgcctctgtccatgcagaggcagttaatggaccgggagagcgatgacaaggtgtacctcgatattttcaacgacgtactgaaacaggtcgattcgtattttaatctttacgacgtgaacggtttccgagcagccctgcaaaagtctaaaaaggcttttgaacagttgccaatcaatgatttccccaaggacgtgcctgataacaaaaagaaaaaggggaaaagatcaatactcaaggagatttttatcggcctgcatgcgaatgccacgctaggaaacctgaagcagatgggcattaaaaccgacttcgggaaacttcagaaaagtaacggactccgcatcactgagaattgcaagataattcaccaatcccccacaggcctgtttgaaaggatcgtcccaatcaaatga

SEQ ID NO: 3115 - RNA, 4107 nt, synthetic construct
  misc_feature 1..4107: note = Cas9 variant
  source 1..4107: mol_type = other RNA
atggacaagaaatacagcatcggcctggatattgggaccaactccgtgggatgggccgtcataacagacgattataaggttccctctaaaaagttcaaagtgctcggtaatactgacagacactcaatcaagaagaaccttattggcgctctgttgtttgatagtggggagatcgcagaagccacgaggttaaaacggaccgcgcgccgacgttacacaagaaggaagaatcggatttgctatctgcaggagatcttcagcaacgaaatggctaaagtagacgattcctttttccatcgcctagaggaatcttttctcgtggaggaggacaagaaacacgaaagacatcctatattcggaaatatcgtcgatgaggtggcctaccacgaaaagtatccaactatttaccatctgaggaagaaacttgttgactcgaccgataaggcagacctgcggttgatctatctcgccctggctcacatgattaaatttcgcggccacttcctgatcgagggtgatctcaacccggacaattcagacgtggataagttatttatacaactggtccagacatacaaccagcttttcgaggaaaatcccattaacgcaagcggggtggacgccaaagctatcttgagtgcccgactgtccaagtctagaaggctagagaatctcattgcgcagctgcctggagaaaagaagaacggcctttttggcaatctgatcgcattgagcctcgggctgaccccaaacttcaagtccaattttgatttagccgaggacgctaaactgcaactctcaaaggatacttacgacgatgaccttgataacctgttggcccagatcggagaccagtatgcagatctattcctggctgccaaaaacctcagtgacgcgattctgcttagcgacatactgcggctcaattctgaaatcacaaaggcccccttgtccgcatcaatgattaaacgttacgatgagcatcaccaggacctgaccttactgaaggctctagtacgccaacagctccctgagaagtataaagaaatcttctttgatcagagcaagaacggttacgccggctatatagacgggggagctagtcaggaggaattttacaaatttattaagccaatcctggagaaaatggatggcacggaggaacttttggccaagctgaatagagaggacctcctgaggaagcaacggactttcgataacggttctatcccccatcagattcaccttggggaactgcacgcaatcttgcgacgccaggaggacttttatcctttcctcaaagataatagagaaaagattgagaaaatactgacctttaggatcccatactacgttggaccgttagcccggggcaactcccgcttcgcttggatgacaagaaagagcgaagagactattaccccctggaattttgaggaagtggtcgacaaaggcgcgtcggcacaatctttcatcgagaggatgacaaactttgataagaatctgcctaacgaaaaggtgctaccaaaacattccctcctgtatgagtacttcaccgtgtataatgagcttacgaaggtcaaatacgttactgaagggatgcgtaagcccgcctttttgtcaggagagcagaaaaaggctatcgtggacctcctgttcaaaacaaaccggaaggtaaccgtgaagcagctgaaagaagattatttcaagaaaattgagtgttttgacagtgtcgaaataagcggtgtggaggaccgattcaatgcctccttaggcacttaccacgatctgcttaagatcattaaagacaaggatttcttggacaacgaggaaaatgaggatatcctcgaagacattgttctgacactaaccctgttcgaggatagagaaatgatcgaggagaggctcaagacgtatgcacatctgtttgacgataaagtgatgaagcagcttaaacgccggagatacaccgtctgggggaggttgtctcgcaagctgataaacggaatccgagacaaacaaagcggcaagacaattttagatttcctcaagtcagacggttttgccaaccggaatttcatgcagctgatccacgatgacagtcttacttttaaagaagacattcagaaggctcaggtgtccgggcaaggcgatagcctgcatgagcacatcgccaacttggcaggatctcctgcgattaaaaagggcatactccagaccgtaaaagttgtggacgaactggtcaaggtgatggggcgtcacaagccagagaatatcgtcattgaaatggctagagagaaccagacaactcagaaaggacaaaagaactcaagggagcgcatgaaacggatcgaagagggtataaaggaactaggcagtcagatcctgaaagagcatcccgtggagaatacccagctccagaatgaaaagctgtacctttattacttgcaaaacgggagagatatgtatgttgaccaggagctggatattaataggttaagcgactacgatgtggaccacatcgtaccgcagtccttcattaaagatgactctatcgataacaaggtcctcacacgatcggacaagaatcgcggaaaaagcgacaacgtgccttccgaagaggttgtgaagaaaatgaagaattattggcggcaactgcttaacgccaaactgataacccagagaaagtttgataatctaactaaggcagaaaggggcggtctctcagagctggacaaagccgggttcattaagcgtcagttggtcgagacgcgccagatcacaaaacatgtggctcaaatcctggatagtcggatgaacaccaagtacgacgaaaacgataaattaattagagaggtaaaggtgatcactctcaagtctaaactggttagcgactttaggaaggatttccagttctataaagtccgagaaattaataactaccaccacgcccatgacgcataccttaatgctgtggtgggcaccgccctgataaagaaatatcccaagttggagtccgaatttgtctacggagattataaggtttacgacgtgcggaaaatgctcgcgaagtcagagcaggagatcggcaaagccacagctaagtatttcttttacagcaacattatgaatttctttaaaaccgaaatcactctggcaaacggggagattcgcaagagaccactaatcgaaacaaatggagagacgggtgaaatagtgtgggataagggcagggacttcgccaccgtacggaaagtcctgtctatgcctcaggtgaacatcgttaagaaaactgaggtgcaaacagggggattttccaaggagagtattcttcccaaacgaaatagcgataagctcatcgctcgcaaaaaggactgggacccaaagaaatatggcggtttcgattctcccaccgtcgcctactccgtgctggttgtggcaaaggtagaaaaagggaagagtaaaaagttgaagtcagtcaaagagctgttaggcattacaatcatggaaagaagctcgtttgagaagaaccctatagacttcctcgaggcgaaaggatacaaggaagtgaggaaagatctgattatcaaacttccaaagtattccctgtttgagttggaaaatggccgtaaacggatgctcgcctctgctggggagctgcagaagggaaacgaactagccctgccgagcaaatacgtgaatttcctttatctcgcatcacactacgagaagctgaaaggcagtcccgaggacaacgaacagaagcagttgttcgtcgagcaacataagcactatttagatgaaatcattgagcagatatccgaattttctaaaagagttatcctggctgacgccaatctcgataaggtgctgagcgcatacaacaaacatagggacaagcctattcgcgagcaggccgagaacatcattcaccttttcactctgaccaatttgggtgctccaacggcgtttaaatatttcgataccacaatcgaccgaaagagatacacttccaccaaagaagtactagatgccacatttatacaccaatcaatcactgggctgtacgagacccggattgacctcagccagctgggaggcgattga

SEQ ID NO: 3116 - RNA, 4107 nt, synthetic construct
  misc_feature 1..4107: note = Cas9 variant
  source 1..4107: mol_type = other RNA
atggacaagaaatacagcatcggcctggatattgggaccaactccgtgggatgggccgtcataacagacgattataaggttccctctaaaaagttcaaagtgctcggtaatactgacagacactcaatcaagaagaaccttattggcgctctgttgtttgatagtggggagacggcagaagccaccaggttaaaacggacagcgcgccgacgttacactagaaggaagaatcggatctgctatctgcaggagattttcagcaacgaaatggctaaagtagacgattcctttttccatcgcctagaggaatcttttctcgtggaggaggacaagaaacacgaaagacatcctatcttcggaaatatagtcgatgaggtggcctaccacgaaaagtatccaaccatctaccatctgaggaagaaacttgttgactcgacagataaggcagacctgcggttgatttatctcgccctggctcacatgatcaaatttcgcggccacttcctgattgagggtgatctcaacccggacaattcagacgtggataagttatttatccaactggtccagacctacaaccagcttttcgaggaaaatcccataaacgcaagcggggtggacgccaaagctattttgagtgcccgactgtccaagtctagaaggctagagaatctcatcgcgcagctgcctggagaaaagaagaacggcctttttggcaatctgattgcattgagcctcgggctgactccaaacttcaagtccaattttgatttagccgaggacgctaaactgcaactctcaaaggatacatacgacgatgaccttgataacctgttggcccagatcggagaccagtatgcagatctattcctggctgccaaaaacctcagtgacgcgatcctgcttagcgacattctgcggctcaattctgaaataaccaaggcccccttgtccgcatcaatgatcaaacgttacgatgagcatcaccaggacctgacgttactgaaggctctagtacgccaacagctccctgagaagtataaagaaattttctttgatcagagcaagaacggttacgccggctatatcgacgggggagctagtcaggaggaattttacaaatttataaagccaattctggagaaaatggatggcactgaggaacttttggccaagctgaatagagaggacctcctgaggaagcaacggaccttcgataacggttctatcccccatcagatccaccttggggaactgcacgcaattttgcgacgccaggaggacttttatcctttcctcaaagataatagagaaaagatcgagaaaattctgacatttaggataccatactacgttggaccgttagcccggggcaactcccgcttcgcttggatgactagaaagagcgaagagaccatcacaccctggaattttgaggaagtggtcgacaaaggcgcgtcggcacaatctttcattgagaggatgaccaactttgataagaatctgcctaacgaaaaggtgctaccaaaacattccctcctgtatgagtacttcacggtgtataatgagcttactaaggtcaaatacgttacagaagggatgcgtaagcccgcctttttgtcaggagagcagaaaaaggctatcgtggacctcctgttcaaaaccaaccggaaggtaactgtgaagcagctgaaagaagattatttcaagaaaatcgagtgttttgacagtgtcgaaattagcggtgtggaggaccgattcaatgcctccttaggcacataccacgatctgcttaagataatcaaagacaaggatttcttggacaacgaggaaaatgaggatattctcgaagacatcgttctgaccctaacgctgttcgaggatagagaaatgattgaggagaggctcaagacctatgcacatctgtttgacgataaagtgatgaagcagcttaaacgccggagatacacagggtggggaaggttgtctcgcaagctgatcaacggcatacgagacaaacaaagcggtaagactatcttagatttcctcaagtcagacgggtttgccaaccggaatttcatgcagctgattcacgatgacagtcttacctttaaagaagacatccagaaggctcaggtctccggccaaggagatagcctgcatgagcacattgccaacttggcaggctctcctgcgatcaaaaaggggatactccagacagtgaaagtagttgacgaactggtgaaggtcatgggacgtcacaagccagagaatattgtgatcgaaatggctagagagaaccagactacccagaaaggtcaaaagaactcaagggagcgcatgaaacggattgaagagggcatcaaggaactagggagtcagatactgaaagagcatcccgtcgagaatacacagctccagaatgaaaagctgtacctttattacttgcaaaacggaagagatatgtatgtggaccaggagctggatatcaataggttaagcgactacgatgttgaccacattgtgccgcagtccttcatcaaagatgactctattgataacaaggtactcacccgatcggacaagaatcgcggcaaaagcaacaatgtcccttccgaagaggtggttaagaaaatgaagaactattggcggcaactgcttaatgccaaactgatcactcagagaaagtttgacaacctaacgaaggcagaaaggggtgggctctcagagctggataaagccggcttcataaagcgtcagttggtggagacacgccagattaccaaacatgtcgctcaaatcctggacagtcggatgaacactaagtacgatgaaaatgacaaattaatcagagaggtgaaggtaattaccctcaagtctaaactggtgagcgattttaggaaggacttccagttctataaagttcgagaaatcaacaattaccaccacgcccatgatgcataccttaacgctgtcgtgggaacagccctgattaagaaatatcccaagttggagtccgaatttgtgtacggcgactataaggtctacgatgttcggaaaatgatagcgaagtcagagcaggagatcgggaaagccaccgctaagtatttcttttacagcaatattatgaacttctttaaaactgaaatcacactcgcaaatggagagattcgcaagagaccactgatcgaaacgaacggtgagaccggcgaaatagtgtgggacaaggggagggatttcgccactgtgcggaaagtactatctatgcctcaggtcaatatcgtgaagaaaacagaggttcaaaccggaggcttttccaaggagagtattctgcccaaacgaaacagcgacaaacttatcgctcgcaaaaaggattgggacccaaagaaatatggtgggttcgactctcccacagtggcctactccgtcctcgtggttgcaaaggtggaaaaaggcaagagtaaaaagctgaagtcagtaaaagagttgctgggaattactatcatggaaagaagctcgtttgagaagaatcctatagatttcttagaggcgaaaggctacaaggaagtcaggaaagacctcattgtgaagctgccaaagtattccctttttgagctggaaaacgggcgtaaacggatgttggcctctgctggagagctccagaagggcaatgaactggccctaccgagcaaatacgtgaacttcctgtatcttgcatcacactacgagaagctcaaaggtagtcccgaggataatgaacagaagcagctgttcgtcgagcaacataagcactatttggacgaaatcatcgagcagatttccgaattttctaaaagagttatattagctgatgccaacctggacaaggtgctcagcgcatacaacaaacatagggataagcctatccgcgagcaggccgagaatattatccacctgttcacccttacgaacctgggggctccagcggcctttaaatatttcgacaccacaattgatcgaaagagatacacttccaccaaagaagtattggacgcaacatttatccaccaatcaataactggactatacgagacccggatcgatctgagccagctcggcggtgactga

SEQ ID NO: 3117 - RNA, 4107 nt, synthetic construct
  misc_feature 1..4107: note = Cas9 variant
  source 1..4107: mol_type = other RNA
atgagcagaccctacaacatcggcctggacattgggacctcctctataggatggtcagtggtcgatgaccagagtaagctcgttagcgtgaggggtaaatatggctacggggtacggctttatgatgagggacaaacagctgctgaacgccgatccttccgtactacgagaaggcggctgaagcgcagaaaatggaggttgggcttactgcgggagatctttgaaccttacattaccccaatcgacgatacattctttctacgccagaagcagtctaatctctcgccgaaagaccagcgaaagctgtatactcaaacctcacttttcaacgatagaacagacagggcattttacgatgactatcccaccatttaccaccttcggtaccgtttgatgactgagaagcgccagttcgatatcagagaaatatatctcgccatgcatcacatcgtgaaatacaggggtcattttctgaatgaggcgcctgtcagcagtttcaagtcctctgagattaacctggtggctcactttgaccggctcaatacaatcttcgccgatttatttagcgaatccgggttccagctggagaccgacaaacttgcagaagttaaggccttgctgctagacaaccagcaatcagctagtaatcgacagcgccaggcactcagcctgatttatacgccatctactaacaaagccgtggagaagcagaataaggctatcgccaccgagcttctgaaagcgatattgggactcaaggcaaaatttaacgtcctgacaggcattgaagccgaggatgtgaaggcttggactttaaccttcaatgccgaaaacttcgacgaggaaatggtaaaactggagtcctcactcgatgacaatgcacatcaaatcattgagagccttcaggaactgtacagtggcgttttgctagctgggatcgtgcccgagaaccagtctctgtcccaagccatgatcacaaagtatgatgaccaccagaaacacctcaagatgctgaaggcggtcagagaagcccttgcacctggagataggcagcggctgaaacaggcttacgaccaatatgtggatggtcaggagaataccaaggcctacagcaaagaagacttttacggcgatattacgaaggctttgaaaaacaacccagaccatcccatagtgtcggagatcaagaagctcattgagctggaccagttcatgcctaaacagcgcactaaggataatggggccatcccacaccaattacatcagcaggaactggacagaataattgagaaccagcaacagtattacccgtggctagcagaactcaatcccaactctaaaaggcagacagtcgccaagtataaactggatgagcttgttgcttttcgtgtgccttactatgtaggaccattgatcaccgcggaacagcaacggcagtcctcagacgcaaagttcgcctggctgatccgaaaggctgagggcagaattactccctggaattttgatgacaaagtggataggcaggccagtgcaaacgagttcatcaagcgcatgacaaccacggacacctacctcctggccgaagatgtccttcctaaacaaagcctgatttatcagcggtttgaggtgttgaatgaactcaacggtctgaagatagacgatcagccaatcacaactgagttaaaacaggctattttcaccgacctgtttatgcaaaagatctccgttacagtgaagaatatccaggattacctagtctctgagaaaagatacgccagcaggcccgcaattactgggctctcagacgaaaacaagttcaatagtcgcctgtccacctatcacgaccttaaaatgatagtgggagatgcggtagacgatgttgacaagcaggctgatttggagaaatgcatcgaatggagcacaatttttgaggacggcaagatctactctgccaaactgaacgaaattgattggctcaccgaccagcaacgagtgcagctggcagccaagcggtatcgtggctgggggagattatcagctaagctgcttactcagatcgtcaatgccaacggacagaggataatggatttgctctgggacacgacagataatttcatgcgcatcgtgcacagtgaggactttgataaactgattaccgaggcaaaccaaatgatgctagctgaaaacgacgtccaggacgtgatcaatgatctgtacactagcccgcagaacaagaaagccctccggcaaattctgcttgttgtgaatgacatccagaaggcgatgaaaggtcaggcccctgagagaatattgattgagttcgctagggaggatgaagtaaactcccgactgtctgtccagcgcaagcggcaagtggagcaggtttatcagaatatctcgaacgagttactcaataacaccgaaattagaaatgagctgaaggaccttagcaactccgcactgtcaaatacaaggttgttcctctactttatgcagggcgggcgtgatatgtataccggagacagtctgaacatcgatcgcctatctacttacgacatagatcatatcctgccccagagcttcattaaagacaattccctcgataaccgggtgctggtctcacaaaagatgaatagaagcaaagccgaccaggtgccaacagactttacgtctgtagaacttggccagaagatgcaaatccagtgggagcagatgttgagggctggtctgattaccaaaaagaagtacgataacttaactctcaaccctgaccacatctccaaatatgccatgaaggggttcataaatcgacagctggtggaaacacggcaagttattaaacttgcaaccaacctgctaatggagcagtacggcgaggataatatcgaactcatcacagtcaagagtggactgactcatcagatgcgcaccgagtttgacttccccaaaaacagaaatttgaacaatcaccatcacgcgtttgatgcctatctgacggctttcgtgggcttatacctcctgaagaggtatccaaagctgaaaccctactttgtgtatggggaataccaaaaggccagccagcaggacaaatggcggaacttcaattttctgaacggattgaagaaagatgagctcgtcgacgagaataccgaagcagttatttgggataaggagtctggtctggcttacctaaacaaaatctatcagttcaagaagattctggtgacacgaggcgtgcacgaaaattccggggccctttttaaccaaactctctacgcagccaaagacgataaggcttcaggacagggcggtaaacagctgatacctgcgaagcaggacagaagtaccgccttgtatgggggctacagcggaaaaacagtagcatatatgtgtatcgtccgcattaagaataagaaaggcgatctgtacaaggtgtgcggggttgagacttcgtggttagctcaactcaaacagctgaccgacgaagactcccagaaggccttccttgagcagaaaatctctccacaattcacgaaggtgaagaaacagaagggaaacattatcgaggccgtcgaagagtttgaagtgatagctccgcatatcctgattaaccagaggttctttgataatggtcaagagttgacactcggcagcgcaacctataaacacaacgaacaggagctgatcctagacaagactgccgttaaactgcttaatggggcgctccccctgacacagtcagaggaattggctgaacaggtgtacgatgaaattttagaccaagtaatgcattacttccctctgtatgataccaaccagtttcgtgccaagctcagtactggaaaggcagccttcatgaaactgccatggaagtcccagtgggacggcaataaaatggtccaggtgggtcaacaggtgatccttgatcggatactgattgggttgcacgctaacgcagccatgtctgacctaaaggtcctgaaaatgaccacaccctttggcatgatccagcagagcacgggaatcaccctctccgcggatactcaaattatataccagtcacctacaggcctgttcgagagaagggttgcccttcgcgacttatga

SEQ ID NO: 3118 - RNA, 4107 nt, synthetic construct
  misc_feature 1..4107: note = Cas9 variant
  source 1..4107: mol_type = other RNA
atggacaagaaatacagcatcggcctggatattgggaccaactccgtgggatgggccgtcataacagacgattataaggttccctctaaaaagttcaaagtgctcggtaatactgacagacactcaatcaagaagaaccttattggcgctctgttgtttgatagtggggagacggcagaagccaccaggttaaaacggacagcgcgccgacgttacactagaaggaagaatcggatctgctatctgcaggagattttcagcaacgaaatggctaaagtagacgattcctttttccatcgcctagaggaatcttttctcgtggaggaggacaagaaacacgaaagacatcctatcttcggaaatatagtcgatgaggtggcctaccacgaaaagtatccaaccatctaccatctgaggaagaaacttgttgactcgacagataaggcagacctgcggttgatttatctcgccctggctcacatgatcaaatttcgcggccacttcctgattgagggtgatctcaacccggacaattcagacgtggataagttatttatccaactggtccagacctacaaccagcttttcgaggaaaatcccataaacgcaagcggggtggacgccaaagctattttgagtgcccgactgtccaagtctagaaggctagagaatctcatcgcgcagctgcctggagaaaagaagaacggcctttttggcaatctgattgcattgagcctcgggctgactccaaacttcaagtccaattttgatttagccgaggacgctaaactgcaactctcaaaggatacatacgacgatgaccttgataacctgttggcccagatcggagaccagtatgcagatctattcctggctgccaaaaacctcagtgacgcgatcctgcttagcgacattctgcggctcaattctgaaataaccaaggcccccttgtccgcatcaatgatcaaacgttacgatgagcatcaccaggacctgacgttactgaaggctctagtacgccaacagctccctgagaagtataaagaaattttctttgatcagagcaagaacggttacgccggctatatcgacgggggagctagtcaggaggaattttacaaatttataaagccaattctggagaaaatggatggcactgaggaacttttggccaagctgaatagagaggacctcctgaggaagcaacggaccttcgataacggttctatcccccatcagatccaccttggggaactgcacgcaattttgcgacgccaggaggacttttatcctttcctcaaagataatagagaaaagatcgagaaaattctgacatttaggataccatactacgttggaccgttagcccggggcaactcccgcttcgcttggatgactagaaagagcgaagagaccatcacaccctggaattttgaggaagtggtcgacaaaggcgcgtcggcacaatctttcattgagaggatgaccaactttgataagaatctgcctaacgaaaaggtgctaccaaaacattccctcctgtatgagtacttcacggtgtataatgagcttactaaggtcaaatacgttacagaagggatgcgtaagcccgcctttttgtcaggagagcagaaaaaggctatcgtggacctcctgttcaaaaccaaccggaaggtaactgtgaagcagctgaaagaagattatttcaagaaaatcgagtgttttgacagtgtcgaaattagcggtgtggaggaccgattcaatgcctccttaggcacataccacgatctgcttaagataatcaaagacaaggatttcttggacaacgaggaaaatgaggatattctcgaagacatcgttctgaccctaacgctgttcgaggatagagaaatgattgaggagaggctcaagacctatgcacatctgtttgacgataaagtgatgaagcagcttaaacgccggagatacacagggtggggaaggttgtctcgcaagctgatcaacggcatacgagacaaacaaagcggtaagactatcttagatttcctcaagtcagacgggtttgccaaccggaatttcatgcagctgattcacgatgacagtcttacctttaaagaagacatccagaaggctcaggtctccggccaaggagatagcctgcatgagcacattgccaacttggcaggctctcctgcgatcaaaaaggggatactccagacagtgaaagtagttgacgaactggtgaaggtcatgggacgtcacaagccagagaatattgtgatcgaaatggctagagagaaccagactacccagaaaggtcaaaagaactcaagggagcgcatgaaacggattgaagagggcatcaaggaactagggagtcagatactgaaagagcatcccgtcgagaatacacagctccagaatgaaaagctgtacctttattacttgcaaaacggaagagatatgtatgtggaccaggagctggatatcaataggttaagcgactacgatgttgaccacattgtgccgcagtccttcatcaaagatgactctattgataacaaggtactcacccgatcggacaagaatcgcggcaaaagcgacaacgtcccttccgaagaggtggttaagaaaatgaagaattattggcggcaactgcttaacgccaaactgatcactcagagaaagtttgataatctaacgaaggcagaaaggggtgggctctcagagctggacaaagccggcttcataaagcgtcagttggtggagacacgccagattaccaaacatgtcgctcaaatcctggatagtcggatgaacactaagtacgacgaaaacgataaattaatcagagaggtgaaggtaattaccctcaagtctaaactggtgagcgactttaggaaggatttccagttctataaagttcgagaaatcaataactaccaccacgcccatgacgcataccttaatgctgtcgtgggaacagccctgattaagaaatatcccaagttggagtccgaatttgtgtacggcgattataaggtctacgacgttcggaaaatgatagcgaagtcagagcaggagatcgggaaagccaccgctaagtatttcttttacagcaacattatgaatttctttaaaactgaaatcacactcgcaaacggagagattcgcaagagaccactgatcgaaacgaatggtgagaccggcgaaatagtgtgggataaggggagggacttcgccactgtgcggaaagtactatctatgcctcaggtcaacatcgtgaagaaaacagaggttcaaaccggaggcttttccaaggagagtattctgcccaaacgaaatagcgataaacttatcgctagaaagaaggactgggacccaaagaaatatggtgggttcgattctcccacagtggcctactccgtcctcgtggttgcaaaggtggaaaaaggcaagagtaaaaagctgaagtcagtaaaagagttgctgggattaactattatggaacgcagctcgtttgagaagaaccctatcgacttcctcgaggcgaaaggctacaaggaagtcaaaaaggatctgataattaaacttccaaaatattccctgtttgagttggaaaatgggaggaagcgtatgctcgcctctgctggagagctgcagaaaggcaacgaactagccctgccgagcaagtacgtgaatttcctttatctcgcatcacactacgagaaactgaagggtagtcccgaggacaacgaacagaagcagttgttcgtggagcaacataaacactatttagatgaaatcatcgagcagatttccgaattttctaagcgggtcatactggctgacgccaatctcgataaagttctgagcgcatacaacaagcatagagacaaacctatcagggagcaggccgagaacattatccaccttttcaccctgacgaatttgggggctccagcggcctttaagtatttcgataccacaattgaccgcaaacgatacacttccaccaaggaagtgctagatgcaacactgatccaccaatcaataactggactctacgagaccagaatcgacctgagccagcttggcggtgattga

SEQ ID NO: 3119 - RNA, 4110 nt, synthetic construct
  misc_feature 1..4110: note = Cas9 variant
  source 1..4110: mol_type = other RNA
atgaagagaatcctgggcctcgaccttgggaccaacagcattggatgggccctggtgaatgaggctgaaacagtcaacgagaaatcctctatagttaagttgggtgtgagggtaaatcccttaactgtggatgaacagaaaaacttcgaggcaggcaagtcaatccctacgaatgccgggcggaccctgaaacgcggaatgcgacgtaacctacaaagatacaagctcaggcgggactatctgattcagtgccttaaggaatacggctggatcacaagtgatactctgttgtatgagtgtggtaatcgcaccacatttgagacctacagactcagggcgaaagctgtcgacgaagagattgccctggaggaactggggcgggtgctcttaatgatcaacaagaaacgcggatataagagcaatcgaaaagcaaagtcctctgatgagggccagctgatagacggcatggccatcgctatggatatgtaccacaacgggactacaccaggagaatatgtttactcgcttttgtcaaagggtaaaaagtacattccggtgttctatagaagcgacctgctagatgagtttgacaggatctgggattaccagtgcgcatattaccccgacattctcaccagtcaattcaaagaactgatccggggcaagtcctctcaggtcacgagcaaactttttaagcagcagtataatctgttcactgccgataacaaagagaaggacaagcgtttgcaggcttactgtcgcagagccgacgcgctcaaaaagaggctgcctgtggaagaggtagcagccgctttatgcgatgttaatcgggacgtgaacgcctcctcagggtatctgggaaccataagtgatcgaagcaaaaagctctttttcaataaacaaacagtcggccagtaccttatgctggagttggacaaggattctcatttttccgtgaagaacgaagtgttctaccgccaggactatctaaacgagtttgaagcaatttgggagaaacaagctgaataccacccagagctgactcccgatagaaagaaaatcctcagggacgtcgttattttctatcagcggcctctgaagtcacagaaagatcttgtggcctgttgcgagctggaacgcagaaggatcgaggtaatgaaggacggtaaggtgcgtagcgtcgaaatcgggccaaaagtgtgtcccaagagttctcctttgtttcaagatttcaaaatttggcatgttctcaataacctgaaggtgcgggacaaagcgaccggagacgagcgattcttagaactggatgagaaggagatactattttccgaactcgccatcaagagcaaactgtcgaagacagaggcacttaaattgctgtaccagaagccaaaaggcctcgacctgaattatgattctgtcgaaggcaacaccacgcaggctgcccttttcgaggcttaccagactgtgattgccatgacagggcacggagagtatgtattttccaagatgtcagcaagtgaagttatgagcgtggtcgagggtgtgttcggcgggctgggatttaatacctccgtcttgagattcgactctctcctgcaaggcaaagaattagagaagcaggatagctacaggctgtggcatctactctactcatatgaaggtgacaacagtgtgactgggacagatggcctggttgccaaggtggcttcccttttgcgctgcgacgaggagtacgcgaaagtagtcgcaggagtgacctttcagccggattatggcagcctgtctgccaaggctatccggagaatactcccccacatgagggccgggaatgaatactcactggcatgtgagtatgccggatacaaacacagtcgcaggagcttaacgaaggaggaactggaacagaaagactataaggatcatcttgagttgctccctcggaactccctgcgtaatccagttgtggagaagattctaaaccaaatggtcaatgtggtaaacgctgtggttgacgcctacggtaaacccgatgaaatcagaatcgagatggcaagggaactgaagaaatctgcgaaggagcgcgaagagatgaccgctgccattaataaagcaacatcggagcacgaacggatcaaggagattctcaacaaggaatttggcatacagcatgtcagccacaatgacatcgtgagatacaaactgtattgcgagcttaagaacaacgggtacaaaactttgtattccgacacctacattcctcaggagaagctgttttcaaaagaagtggatatcgagcacatcttaccacaggcccgactcttcgacgatagtttttctaataagacactggaatatcgaagcgtcaacattgagaagtccaatcaaactgcttgggactacgttgccgcaaaatggggagaagagggctcacttcgctataagaaacgggtggatgacctgttggctgccggtgtgataggcaagagcaaacatgataagctcctgatgaaacaggaggacatccccaccgatttcattaacagagacctaagggatacacagtacatcgcgcgtaaggcccgcgaaattctggaggacctcgtaccgatggtcgtgtctaccactggggctgttacggatcggctgagagaagactggcagcttgtggacgtcatgcaagagttgaattgggataagtacgcaatgaaaggactgacagaagagtggaccgacaaggatggcaggcgaatctcccggataaaagagtggactaagcgcaacgaccacagacatcacgccatggatgctttaaccatcgcctttacaaaacatagtttcattcagtatctcaataacctgaatgcaaggagcgacaagtctgggtccatctacgcgattgaacagaaggagctttatcgggataaccacggaaaactgcgattcatcatgccttttgaaggtttcagatcagaggccaagcgccaactagaaaatatactcgtgagtattaaagctaagaacaaagttgtgaccaggaatgtaaacaatgcccgtcggggcagcgggagacaggcaaaggtccagctgactcccaggggacagttgcacaacgagacaatctacggctcgattcatcgctatgtgacgaagctggagaaagtgggtgggaactttgacggcgaacaaatcgctaaggtcgccaatttacgatacagagaggcactccaggcccggcacgaggctttcggaggcgatgcgaaaaaggcctttaccgggaaaaacgcactggacaagaatccactttatctgaaggatactaggacagaagttcctttgaaagtgaagaccgtatccacagagactctctacaccatacgcaaagctgtggcccccgacctgaacgtcgacaaggtgatcgatgccaaagttcgtaaggtgctagaagagagactgcaggaatacggaggcgacccaaagaaggctttcgtcaatcttgatgagaaccccatttatctcaataaagcaaaaggtatcacgattaagcgggtggccatcaccggggttaacaatgcgatagctctgcatgacaaaaaggatgtgggaggccacgtcatgttggacgcctctggtaggaaacagcctgtagattttgtgaacacaggcaataaccaccatgttgcaatttaccgcgacgccgaagggagcctgcaagaggtggtcgtgtcattctatgaggctgtagcacgagtgagtttaggactcccagtcatcgatagagaataccggaaggaggacggctggcagtttctgttcactatgaagcagaatgaatattttgttttcccgaaccccgagaccgggtttaatcctcaggaagtggatcttacagacgagactaactacgccctgatctccccaaacttgttcagggtgcaaaaattcaccattaaggattatttcttccgccaccatctcgagacgacagtcgaagacagaaaagagctgaaggacatgacctggaaaaggtgtggactaggcggtatcattgggatagtgaaggttcgggtaaatcacatcggacgtattgtgtctgtcggcgaatactga

SEQ ID NO: 3120 - RNA, 4110 nt, synthetic construct
  misc_feature 1..4110: note = Cas9 variant
  source 1..4110: mol_type = other RNA
atggccaagacctacaacatcggcctggacattgggacaaatagcataggatgggctgtggtcgatgaccagaaccacctcatgtccatcaaaggtaagtatggctacggggttagactttatgatgagggaaaaactgcagaagagaggcggtctttccgcacgacccgacgtagactgaagaggcggaaatggcgcttgtcattactgagagaaatttttgagccccaaatcacacctctagacaatactttctttctcaggcagaagcagagtagcctgtcctctaaggataaccggaaactttacccagaaatgtcgctgttcaatgaccgcaccgatacagacttttatacccagtacccgactatttatcatttgtcacgagatctcatgacaaagaacaaacaattcgacatcagagagatatacctggccatgtaccacatcgtgaagtataggggccattttctgaatgagagccccgtaagttccttcaaatctagcgaaattaagctcgcggagaactttgaaaccttaaatcagatcttcaacgagcggtttaatgagtccatgttccagctggctgtgaacgattttgacgatcttaaggccttgctgctaaatgaccagcaatcagcaagtaaccgtcagaaaaaggccctcggtatgatttacgtccctaatgaaaacaaaagcctggagaagcagaacaaagctatcgcaacggaacttctgaaggccatattggggctcaaagctaagttcaatgtgctgactggaattgaggttgacgatgccaagccatggaccttatctttcaactccgaatcatttgacgaggatatcgacaaagcggcaacaaatattgatgacgatagccgcgagatcatcgccattctgcagggcctctatagtggcatacttctggctgggatcattcccgaaaaccaatctttgtccgaggccatggtggaaaagtacgaccagcacgcagctcatctaaaacagcttaagagcatctatcctctcctgtcgatatctgataaaaaggccattcaacaggcgtacaattattacatcgacggacaggataacgccaaggcatactccagagaggacttctatgctgccactaccaaagctcttaagtcataccaggacaatgaaacaatcgccgagattctgaaattgatcgagctcgaacaatttatgccaaagcagaggaccaaagataacggtgcaattccccaccagctgcaccagcaagagttagaacggataatcgagaatcagcagaagtattacccttggctggccgaactaaacccaaatgagagtcgacgcaagattgctaaatataagctcgacgagctggtcgcgttcagagtgccgtactatgtaggcccccttatcacgagcgaacagcaacagcagtcctctaacaaaaagtttgcatggatgatcaggaaagccgaggggaagattactccttggaatttcgatgaaaaggttgaccggcaggctagcgccaacgagtttataaaacgcatgacaaccactgatacatacttgctggcagaggacgtgctcccaaagcaatcactggtctaccagagattcgaagtgcttaatgagctgaacggaatcaaaattgatgacgtgcccatcaccgtcgaacagaagcaaaggatttttaacgatttgttcatgatgcaggccagtgtttccgtgaaaaatatccaggactatctcgtaagcaagggctactttgcttctcgtcctgagataacgggtctgtcagatgaaaacaaagtgatcagtcggttaagcacctatcatgacctgaaggccattctagggggaatcgtcgatgaggcaaataagcaggcggacctcgagaaatgcgtggaatggtccacaattttcgaggacggcaagatctttgttgaaaaactgaacgagatagaatggcttactgatgagcaacgaaagagattgtcttcgaaaaggtaccgcggctgggggcggctgagcaataagctcctgaaccagattgtgaatgagaacggacagagaatcatggacttactgtgggataccacagacaatttcatgaggattgtccactccgaagagttcgataaacttatctcagctgccaaccagactttgctcagtaagaatgacgtgcaagatgtaataaacgacctgtatacctctccacagaataagaaagcactacgccagatcctgctcgttgtgagcgatattcagaaggccatgaaaaaccaagctccctccaagatcctgattgaatttgcccgagaggacgaagcaaatccgcggctttcagtccagcgtaagagacaggtggagcaagtctaccagaacatcagcaaagatatattgtctgactccgatgtgaaggctgagctgaaagacttaacaaacaccgccctcgcgaatactaggctgttcctttattttatgcagggtggccatgacatgtacacgggggaaacactgaacattgatcgcttgagtgagtacgacatcgatcacatcctccctcaggccttcattaaggacaatagcctggataaccgggttctagtgtctgctaaaatgaatagatccaagtcagaccaagtacccctgaacgattataccgaagagaggtttggaagtaagatgcgagtccagtgggagcagatgctccgcgcaggcctgatcactaaacggaagtacgacaatcttaccttgaacccagatagaattagcaaatatgccatgaagggtttcataaataggcagctggtggaaacacgtcaagttatcaaattagtgaccaacctcctgatggaccactacgaggatgacgaagtccagcttattactgtgaagtcggggctgatccatcagatgcgcgagatgtttgacttccctaaaaatcggaacctaaataaccaccatcacgcttttgatgcctatctcacagcattcgtaggcatttacctgttgaagagatatcccaagctgacgccatttttcgtgtacggatcctaccagaaaaataacaccaacgacaagtggaggaattttaacttcttaaatgatctcaaaaaggaagaggttatcgactctgatagccatgaggtcatatggaacaaagcgcaaggcctggtggaacttgacaagatctatcagttcaagaaaattctggtgactcgagaggtccacgaaaatacaggggccttgtacaaccagaccctctattcagctaaggatgacaaagccagtggacagggtggcaagcaactgatccccgcaaaacaggatcggcctacagctctatacgggggatattccggcaagactgttgcctacatgtgtattgtgcgcatcaagtctaaaaaggaggacacctataaagtgtgcggtgtaaagacgagctgggtcgcagaactggagagactttccgattcaaatgagcagctcgccagcctgaaagctaagttgatgccaaagtttaccaaaaacaagaaacaaaaggggaaaacaatacaggtgactgaagacttcgagattatcgttccgagggtgctgatcaatcagcggttttacgataacggccaggaaattaccttaggaagtgcgacatacaagcacaatgagcaagaactcatgctgaacaagaaagccgtcaagctgctgaatggccagttgtctctcgtggaggcagagactctggctccccaggtttatgacgaaatactaaaacaggtgatgaagtacttccctctgtatgacaccaaccaatttcgaacgaaacttaagatggggaaagagcagttcatcaagctcccatggaagaataaatgggatggaaacaagctgattcatgtaggtcagcagacagtcttggacagaatcttaattggcctgcacgccaatgccgctgtgtccgatctcagcaccctgaaagtgactacaccctttgggaaacttcaacagccttcgggaatcgcactgtcattgaacaccaagataatctaccagtctccaactggcctattcgaacgcagggtcgccctgcgtggtctctga

SEQ ID NO: 3121 - RNA, 4110 nt, synthetic construct
  misc_feature 1..4110: note = Cas9 variant
  source 1..4110: mol_type = other RNA
atggacaagccctacaacatcggcctggatattgggagccactccataggatggaccgtggtcgacgataattctaaactcgttagaatcaagggtaaacttggctatggggtgaggctgttcgacgagggaaagacagccgaagaacggcgccagtttcgaactacgcgtagaaggttgaaacggcgcaagtggagattaaggctgctacgggaaattttcgagcctcatatcgctccactcgatgaaacctttttcctgcgccaaaagcagtcaaaccttgtaccgacacagaaaaagctgccccagttgagtctctttaatgaccgaagcgatgcagagttctaccacaaatatcctactatttaccatctgagaaacgccctgatgaccgagaagaggcaatttgacctccgggaaatctatttagcgatacaccatatcgtgaaataccgtggccacttcctgaatgctgccccagcagcctcctttaagtctggtaagttcgatcttgagaacaaatttgaccagttgaatctgctattcgcttcggcatattcagatctcgactttacactgcgcaccgataacgtcgaccaggtgaaggccattcttctgaatgaagacttgagcgctagtactagacagaggcaagccctccccctgatctaccagacatccgcggatcagaaagcagccaagaaattaaccaagtctctggctacggagctccttaaagccattctggggttgaaggcaaagttcgacgttctaactggaatcgagaccgatgacacaaaggcttggcggctgactttcaacgccgaagattttgacgataagctcaatgagctgaacgtgaccgacaatgaagcggccacacagataattgagatccttcgagaactgtacagctccattttgctcgcagctatcgtccctgagaactataccctgtcacaagccatgatggctaaatacaatgcccacaagcagcatttaagtctgctacgccaggtgaaaacgactctcccagcaaagaagcaaaaagagctgcaggccgcttatgatgactacatcgatcagcaccttcccttggacaagttctatgcgaaactgacaaaggtactccctaaagaaaaggacaccgataacccacagattatacaaatcctgaaccttattgacctggatcagtttttgccgaagcagagaactaaagacaatggcgcaatcccccatcagctccaccaacaggagctggatcagataattgacaaccagaaggcctactatccttggttagctcaactgaatccaaacgaaaagaggcagaagatcgccaaatacaagctagatgagctcgttgcattccgggtgccctactatgtcggccctctgatcgaagccaagacacagcagaaaaccagcggggctaattttgcctggatgattcgcaaggagccaggaacgaccacacccatcactccgtggaacttcgacgagaaagtgaatagacaagcatctgcgaacgaatttattaagaggatgaccacaactgatacctaccttttgggtgaggacgtgctgcctaaacactccctcctgtatcagcgtttcgaagtcttaaatgagctgaacggcataaagatcgatcagaaacgggttacagtgcgacaaaagcaggctatttttaatgaccttttcttgaagcagcccaacgtaaccgtgaaaaagctccagcaatacctgcaggccaaaggggaatatgcatcagccccaatcatcactggactaagcgatcctaagaaatttaatagtcagctgtctacgtaccatgagtataagaagattttcggcggtctcatagacgaccccgataaacaggctgactttgagaagtgcatcgaatggtccacaattttcgaggatagccaaatcctgaaagacaaacttaaagaaattaactggttgaccccagagcagagacacaaggtcgccaataagaggtaccaggggtggggacgcctgtcgaaaaagttactcactcagctggtggattacaacggccaacggatcatagacatcctttggaacaccacagataatttcatgcagattgttcattctgaggcatttgacaaagctatcattaaggaaaaccaggccctgttgacccaatataatccccaggcggtgatcgatgacctctacacttcccctcagaacaaaaaggccctgagacagatactactggtcgtgaatgatattcaaaaggctctcaaaggccaggcaccatcaaggatcctgattgagttcgcccgcgaagggcaggagaacccgcgacttagtacacagcggaagcaacaggtagaaaatgcttataaagaggccagcgacgcattgctgtcctctgcggaggttcgtcaggaattaaagggactcgataacaaagccctggctaatacgagactttttctgtacttcatgcagggtggcagggacatctataccgggaaaagcctaaacatagacgatctctcaaaatacgacatcgatcacattctgccccaagcctttatcaaggacaatagtttggataaccgcgtgctggtctccgcaaagatgaatcggagcaaatctgaccaggtgcctttaaacgatttcgctgagattagatatggaaagcagatgaggcagcaatgggagaaaatgctccgagccggcctgatcactcgcaagaaataccataatcttacactgaacccagagtcaataaacaagtacaccgcaaagggttttattaatcggcagttggtcgaaacaagacaggtgactaaactcgccaccaacctgctagttgaccaatatgctgaggatgacgtgcagctgatcacggtaaagagtaatcttacccaccagatgagggaggagttcgattttcccaaaaaccgtaatgtcaacaatcaccatcacgcgttcgacgcctacctcacagcatttgtggggctgtatttgctgaagcgctaccctaaattagctccatatttcgtttacggcgactatcagaagggagccagccaaaactccaagtggcggaattttaacttcctcggcaatctgcatagagaaaaagtggtcgataagaacactggggaaatcatttggcagagggacgccggacttggtgagctgaatcgaatctacaacttcaaaaagattttggtgacccgggctctccgcgtaaatagaggccccatgtttaaacagacaatatacaaggcagaagaggataagtcttcggggaggggaagcaaacagctgatcccgactaagaaaaaccggcctaccgagctatatggcggttacacgaacaaggaaacagcctatctgtgtcttgtgaaagagccacacaagaagggggacatttaccgaatctgctccgttctcaatatgtggctgaccgaattggatagaattgcggaccccatcgctaaagcccaaaagttaactgagctgctcacacctcagttcaccactaccaaaaagaaacagggccagaagatacccgtcgtgaaaccatttaaggtggtcatccctaagattctgatcaaccaacgcttcttttcaaggggacaggagcttacagttgcaagtcccatgtatatgcacaatgaacaggagctgttcttgaacaaaaagacgattaaactactgaatggccaactcgccaagaacgaagctcatgagctggcaccaaaaatctaccagcagatacttgatcaggtgaatgactattttccgttatacgatatgtacaagttccgtgacaccctgaacgcctctaaggaaatttttgtgaatctcccttggcaagatcagcggcaggacaaaaagatcagccagtccgggcaaaaatcaatcttgaacaagattctgataggactccacgcgaatgctgccagaatcaaactgactgagcttaacttcaagagcgattttggtctgttgtctcagaggtccggcattgcattcagtcccgacgaccagatcatttatcagagcccaacagggctattcgagcgccgagtaaccctgaaggatctctga

SEQ ID NO: 3122 - RNA, 4110 nt, synthetic construct
  misc_feature 1..4110: note = Cas9 variant
  source 1..4110: mol_type = other RNA
atgaaggtgaacaattaccacatcggcctggacattgggaccagctccataggatgggtcgccatgggtgaggatggcaaacccctcagagttaaggggaaaacagctatcggagcaaggcttttccgggaaggcaaccctgccgcggaccgccgaatgtttcgtactacgagaaggcggctgaatcgcagaaagtggaggttgaaattactggatgagattttcgacccatatatcaccccggtggattctacatttttcgctcggctaaagcagtcaaactggagtcccaaggacagccgcaaagcctttaaggattccactctcttccctgacctgaccgataaacaataccatcttgactatccaacaatttaccacttacgacatgcattgatgacccaggataagcagtttgacatcagaatggtatatctcgccctgcaccatatagtgaaatacaggggtaatttcctgaactctactcccgtcgattcgtttaaggcttcaaaggtgaatttcgacgaccagtttaaaaagctcaacgaattatatacagcaatcaatcctgaggaatcattccaaattaactttgccaatagtgagaaaatcgggcagcagttcctggatccatccattcggaagttcgacaaaaagaaacagatctctaagatagttcccgtgaccatggatgacaaggctgtcgataaacttaacggaaagattgccagcgagatcgtgaatgcgattttgggctacaaatccaagctggacgtagcagttcaatgcgatcctgaagactcaaaaccatgggccgtgaagtttgatgacgaggatatcgacgctaagctacagaaaatcctcccggaaatggacgagaaccagcagagtattataggcatcattcaagatctgtacagccaggtcacgcttaatcagatcgtgcccaacgggatgtctctgtccgagtcaatgataaagaaatataacgaccaccacgatcatttgaagctctacaaaaagctgattggacaaatcagcgacagtaagaaaaagactgccctgaaaaaggcatatgatcagtacgtgggtaatgacggcaaagtcatcgaacaggatgacttctattcttccgttaagaagaacctggatgacagcgagctctcgaaacagattatggatcttatcgacgctgataagtttatgcctaaacaacgtacctctcagaatggggtgattccacaccagctgcatcagcgcgaattggacgagataatcgaacaccaatccaagtactatccctggctagccgagtcaaaccctaataaacacgacctgcatctcgcgaagtacaaaattgaggaactggtagccttcagaatcccatactatgtgggacccatgatcacaccggaggatcagaagaagagtggcgcagctgtctttagctggatgaaaaggaaggaacctggtcagattactccctggaacttcgaccagaaagtggatcggatggagtccgccaataagtttataaaacgaatgaccacaaaggacacctaccttatcggggaagatgttctgccagacgagtctttgctctatgagaagttcaaagtgctgaacgaattaaatatggtccgcgtgaacggagatagcctgaaggtagctgacaaacaagccatttaccaggatctatttgagaattataagcacatctcagttaaaaagatgcagaactacattaaggacaaaacgggcctccctaataaccccgatatcagtggcctgtccgacccagatcatttcaataacagccttgggacttataacgactttaagaaattgttcggagacaaggtggatgaccccgatctgcaggacgattttgaaaagatagtcgagtggtctacagtgttcgaagacaagaagatcctcagagcaaaactgaatgagatttcatggcttagtgataagcaaaaagacgatctggagagctccaggtaccagcggtggggtcgcttgtctaagaaactcctgaccggcatcgtcaacgaccagggggaaagaattatcgatgagttatggaatactaacaagaatttcatgcaaatacagtcggacgacgattttgccaaaaggattcacgaagctaacgcggaccagatgaaggcaacagatgtggaggacgttctggccgatgcttacaccagccctcagaataagaaagccatccgtcaagtggtaaaggtcgtggacgatattcagcgggcaatgggaggcgttgccccaaaattcatctccatagagtttacgcgatcagaagacagaaacccgaggcgcaccatcagtcgggagagacagctagaagatacactcaaggacactgctaaaaccctggtgaagtctatgaatcccgatattcttagcgagttggacaacgcctccaagagcaaaaagggtctgacagataggctctatctgtacttcactcagttagggcgcgacatgtataccggcaaacctatcaatattgacgaaatcagcaactacgatatagaccatattctgccacaagcatttatcaaggatgactctctttccaatcgagtcttggtgagtaaagcggtaaacaatggaaagagcgctaacgtgcccctcaagctgttcggcgttaaaatggcccacttttggaagcagctagcagaggccgggctgatcaacaaacggaagctcaaaaatctgcagacaaaccctgataccatttctaagttcgctatgcacggatttatccgtagacagcttgtcgagacttcccaagtgattaagttggtggccaatatactgggtgacaaatataggaacgatgacacgaagatcattgaaatcacagcacgcatgaatcatcagatgcgggatgagttcgcttttattaaaaacagagaaatcaatgactaccaccatgccttcgatgcgtatttaaccgcctttctcggcaggtacctgtaccaccgatatataaaacttcgcccatacttcgtctatggggacttcaaaaagtttcgggaggataaggttactatgagaaacttcaattttctgcacgacttgaccgacgatacacaggctaggatcgcagacaccgaaactggagaggtgatttgggatcgtgagacatcaatcaaacaactccgcgacgtgtaccattataagttcatgctgattagtcaggaagtatacacgctacggggcgccatgtttaaccagaccatctatcccgctgatgaggccggtagaaagaagctgataccgactaaagcagacaaggcggtcgatgtgtacgggggctacagcggatcgaatgacgcctatatggctattgttaggatccacgataaaaagggcgacaagtacaaagtggtcggggtgcctatgcgagccctcgatcggctgaacgcagctaagaatgtttccgacgccaaatatgaccaggtgcttaaggatgtattgacaccacaattcaccaaatctaaaaagagccgcaaaacaggagaaatctcacagactgtcgaggactttgaagtggtgctgggtaaggtcatgtacagacagttagttattgatggcgacaaaaagttcatgctcgggagttccacctatcagtacaacgcaaaacaactggtgctttctgatgagagcgtaaagacgctggcctccaagggaaaactagacgaggctcaggaatcagcggcctatgataatgtgtacgacgagatactcgataaggtcgacaggtactttgcactgtatgatcagcggaactaccgaaccaacttgcatgaaggcgagcagaaattcatcggtctgcccttacacgacacatttgatgggagcaagaaagtggctaatggcaagagagagactattagtgacatcctcaacggactgcatgccaatgccaccatgacaaaccttaaggttctgggcatttcttcccctttcgggatgttccaaagccacggacccatcaatttgaacccagaaactataatcctctgtcagtcgcctaccggcctgtttgagcgcaggattatcctacgtgacctgtga

SEQ ID NO: 3123 - RNA, 4113 nt, synthetic construct
  misc_feature 1..4113: note = Cas9 variant
  source 1..4113: mol_type = other RNA
atgaagaaaagaaactacaatatcggcctggacattgggaccagctccataggatggacaatcgtggatgacaacgcccagattatgagggctaagggtaaaaatggctatggggtccggatcttcgcagagggaaagactgccgcggatcgccgaggctttcgtacgaccagaaggcggctcaaacgcagaaagtggaggcttcggctgttgcaagagttctttgaaccctacattttacctatcgacgaaaacttctttatgcgccagaaggagtctaatctggttccacaggatccgaacaaacacttcaagggttcaatactatttaatgaccgaacagatcaggagttccatgaacaatatcccactatctaccacctcagatatgctctgatgaccgagcataggcagtttgacgtgcgggaaatttactgggccatccaccatattgtaaaatatcgtgggcacttccttaacagtacactggcaagcaagtttaaaggaggcgagttgcgcctcgccgataagttcgaatccctgaataagctgtttctcagagtgcaggctgagaccggcttcgagttatctgaagacaacgtcgataaaatcaagactgtgctgcttgacaatgggaaatcgaggttggatcggcagcgagaggttctgaagatagtgtacctaacatcagaagacaaagacaccgagaagaaacgcaaggcagtcgccacggagttcattaaggctgtgctcggactgaaaactaaactttttatcgtactggccaaaaaccctaccgcggaaacagattggaagttcagctttgacgcagaggatattgacgataaattggacagtatctccgaacaactcactgatgacgatcacgagatcgttgaactgatttctgagatacatagcatcattaccttaacaggtgtggtcccagaaggcatggggctgtccgagtcaatgatcgccaagtacgaccagcaccagctcgatcttaagaaactgaagagtttgatgagagacctagacgtgaaacaggctaggaagctgcaagatgcctatgacgagtacatagatggactcaaacccagcgaagaggcattctattctgctgtgtcctcagtcattcagaagatggacgatcctcgggccaagaaaatcaccgcggaaatcgagctggaagagtttatgccaaagcagcgcacgaaagccaatggccaaattccccatcagcttcaccagcaggagctggaccaaatcattgaaaaccagaaggagtactatccttggttggcagaagagaatccaaacaaaagagagcacaacgctgccccgcataagctcgatggtctggttactttcagggtgccctactatgtagggcctttaatagaagctagcgtgcagcagaagacaagtaattctaactttgcctggatggagcgtaaagtcaagaatgacacctcccggatcactccatggaacttcgaagagaaagtggatcgaaatgcaagcgccgaaaactttattaagagaatgacaaccaaagacacgtacctgctaaatgaggatgttctcccccaacagtcgctgctttaccagaggtatgaggtgttgaacgaactgaataacgtccgcgtgaatgacaagaaactcgagaacaattgcaagcaggatgtatacaaggacctgttcaaaaacaataccacagtttctatcaagaaatttaaggactatcttgtggctaactgtgaatacgcggataaccctaaaatcgagggactggcagacgaatccattttcttgtcaagtctcagcactgagaataagtttaaggatatattcggcgcccaaatcgacgatccaaactatttcgaggactttgaacacattatcgagtgggctaccattttcgaagataataaaatcctgcgggccaagttagacgagatatcctggctgaacgaatctcagaaaaaggagctagcaaaactcagaatgaggggctgggggcgcctgagccgaaaacttatcgccgagattacagatgaaaatggatcacggatcattgacttgctgtgggagcatatggataactttatggtcgtggtcaatcaggacgtgttcaaggaaaagatcgttgctgagaacaaacaggtgtttaaggagctcaatcccctggatataattaacgaacaattcaccagtccgcagaataagaaagccttacgtcagatcctgcttgtagtcgcagacattcaaaaggcgatgaacggtgtgactccttccaatatctttatagagttcgctagagaagacgagaggaacccccgccggagcatccagagattgaggcaggttgaaaatatgtaccgagatatttctgacacagtgctcgccgatccagaggtccgcaacgagctgtcaaacatcaagaataccgaactagcacgggacagagtgtttctgtatttcctccagggcgggagggatgtatacactggagagcctctgaacattgacaaacttagtgaatacgatatcgaccacatattgccccaagcctttattaaggataatagcctggacaaccgtgtgttagtttccgcttctctcaatcgctcgaaaagcgattccgtcccactggacgacttcacgtcagagatgtttggccggaagatggaacccctttgggagcagatgcagagagccggtctgatcagtaaaaagaaattggcaaacctcaagttcaatcctgagaacatcaataagtatacaaggaacgggttcattaatcgacagctggtggaaacccggcaagtgatcaaactagctgccaacattctgaaggatcattacggcgaggaaactgagatagtcaatgttaaagcgggactcacccaccagtttcgcaaggacttcgattttccaaagaacagaaatgtgaacaactatcaccatgccttcgacgcttacctgacagcacttgtgggcacctatttgctgaagaagtacccgaaattagaatcttattttgtatacgggaagttcaaaaagggagatggtatcactaatctcaaaaactttaatttcctgcacggctttaacaagcccgggaagattatcaataaagagacaggagagattcttttcgacagggataagcagctgggctacatgaacagcatctatgacctacggaaagtcatagtgacgcatgaactctccacccgacacggtgccatgtacgatcagactctgtataaggcttcagacgataaagacagcgggagaggcggaaagcaattgatccgcaagaaagataatctgcctacagagatttacggcgggtataccggatctacagacgcctttatgtccatcattaggatgaagaaaaaggacaaattatactataaggttatcggtgtgccaactcgtgtcgcacacgaagtgctccagagtgatggcaagataaacattttcaccctgaataaattcatcgagcagaaacttacgaaggagaaggttaacaaaaagaccggggcgatcacacggattactgactggtttgaactggtgatagccaaagtaatgtacggacaagtcatcgatgacggcggtcagcccttcatgttggggagctctaccctcccttacaatgtgagagagctgtatctagctaaggatctggtgaaggtcattaacaaaggctccacatcaaagagtagctaccttgacgtttatgatgaactcgtgaaatcgctgaataagtactttccaatgtatgacaggaacatgttccgccagaaaatcactgatgcccgagacaagtttgagaagttgcccaaaagagataaggtatccaatggaaaactgcagcaaattggccaggtgaccatcatagaccggatcttaattgggctccatacgaacgcaggagtctctaatctgaaggatcttggcatcgctacaccgttcggttttatgcagcaggggaacggaattagcctgacctcaactgccaaaatcatataccaaagttccacaggcttgttcgaaaagtctaaggcactcgacgacctgaaccctctagcctga

SEQ ID NO: 3124 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctataatcacagatgactataaagtccctgccaagaaaatgagagttctcggtaacactgataaggagtacattaaaaagaatcttatcggcgctctgttgttcgacgggggaaacacggcagccgataggcggttaaagcgcaccgcgcgacgtagatatacaaggcggcgcaataggattctgtacctacaggaaatctttgctgaggaaatgtcaaaagtggacgatagtttctttcacagactcgaggacagcttcctggtagaagaggataagcggggctccaaatatccaatatttgccactatgcaagaggaaaagtactatcatgagaaattcccgaccatctaccaccttcgcaaggaactggcagacaagaaagagaaggccgatttgcgactcatttacctggctctggcacatatcattaaatttagaggtcacttcctcatcgaggacgataggtttgacgtgcggaacacagacatacagaagcagtatcaggccttcttagaaatttttgataccactttcgagaataacgacctgctttctcaaaatgtcgatgtggaagctatcttgacagacaaaatttcgaagtcagccaaaaaggatcgtatcctggcgcgctaccccaaccaaaagagcaccgggatctttgcagagttcctaaaactcattgttggaaatcaggccgacttcaagaaacattttaacctggaagataagacgcctcttcagttcgctaaagacagttatgatgaggacctggagaatttgctcggccagataggcgatgaatttgccgacctgttctccgcagctaagaagttatacgactctgtgctgctcagcgggatccttactgtcaccgatctgtccacaaaagccccattgtcagcgagtatgattcagagatatgacgagcacagggaagatctaaagcagctgaaacagtttgtgaaggccagcctccccgagaaataccaagaaatcttcgcagactcttccaaggatggatatgctggttacatagagggcaagactaaccaggaggccttttacaaatatctgtcaaagctgctgaccaaacaggaagggagcgagtacttgctcgaaaagattaaaaatgaggacttcctgcggaagcaacgaacatttgataacggaagtatccctcaccaggtacatttaaccgaactgcgcgctatcattagaaggcagtctgagtattacccattcctaaaggagaacctcgaccggatcgaaaagattctgacgtttcgcataccctattacgttggccctcttgccagagagaagtccgatttcgcatggatgactaggaaaacagacgatagcatccgtccatggaattttgaagacttggtggataaggagaaatcggccgaggctttcattcaccggatgaccaacaatgacctgtatctcccggaagagaaggtcctgcccaaacattctcttatctacgaaaagttcactgtgtacaacgagctgacaaaggtgcgatttttggcggaaggtttcaaagactttcagttcctcaatagaaagcaaaaagagaccatctttaactccctgttcaaggagaaaaggaaggtcacggaaaaggatattatatcatttttaaataaagttgacgggtatgagggaatcgcaattaagggcatcgaaaaacagttcaacgccagtctgagcacctaccacgatctaaagaaaattctcggcaaggactttctggataatacagacaacgagcttatcttggaagatatagtgcagactctgaccctcttcgaggaccgcgagatgatccggaagagactggatatttataaagactttttcacagaatcccagttaaagaaactgtacaggcgccactatactgggtggggacgactttctgctaagttgatcaatggtattcggaacaaagagaatcaaaagaccatcctcgattacctgatagacgatggcagcgccaaccgtaattttatgcagctaattaaggacgcagggctgtcattcaaacctatcattgacaaggccagaacaggaagtcattccgataacctcaaagaagtagtgggcgagctggctggtagcccagccatcaagaaagggatacttcagtctttgaagatcgtcgacgaactggtgaaagttatgggctatgagcccgagcagattgtggtcgaaatggcaagggagaaccaaaccactgcgaagggattatcacgcctccggcagagactgacgacacttagggaaagtctggctaatcttaagagcaacatcctcgaggagaaaaagcctaaatacgtgaaggatcaggtagaaaatcaccatctgtccgacgatcgactattcctgtactatctccagaacggcaaagacatgtacaccgatgacgagctggatattgacaatctttctcaatatgatatcgacttgataattccacaggcctttatcaaggacgattcgatcgacaaccgcgttctggtgagctccgcaaagaatcgggggaaatcagatgacgtccccagtgtggaaattgtcaaggattgcaaagtgttctggaagaaattactcgacgccaagctgatgtctcagagaaagtacgataaccttactaaagctgagaggggaggtctgaccagcgacgataaggcccgttttatccaacgccagctagttgaaacacggcagattaccaaacacgtggcaagaatactcgacgagaggttcaataacgagctggattccaagggccgacggatccgcaaagtaaagattgtcactttgaagtcaaatctggtgagcaactttagaaaagagttcgggttttataagatcagggaagttaataactaccatcacgctcacgacgcctatttaaatgcggtggtcgccaaagctattctcacaaagtacccgcagctggaacctgagttcgtgtacggagattatcccaaatacaactcttataagacgcggaagtccgcaaccgaaaaattgtttttctacagtaacatcatgaatttcttcaagactaaagtaacactggccgacggcaccgtggttgtcaaggacgatatagaggtgaacaatgacacaggtgagatcgtgtgggataaaaagaaacatttcgctactgtccgaaaggttttgagctatccacaagtgaacattgtgaagaaaaccgaaatccagaccgggggcttttctaaggagtccattctcgcccacggaaattcagacaaactgatccctagaaagacgaaagatatatacctagaccccaagaagtatggcgggttcgatagtccaattgtagcatacagcgtcctggtggttgcggacatcaaaaagggaaaagcccagaaacttaaaacagtgactgaactcctgggtatcaccattatggagcgctcgaggtttgaaaagaacccctccgctttcttggagtctaagggctacctgaatatacgtgatgacaaattaatgatcctccctaagtatagcctgtttgagcttgaaaacgggcggagaaggctgttggcctcagcagatgagctccagaaaggaaatgaactggctctaccaacacaattcatgaagtttctgtaccttgccagtcgctataacgagctcaaaggcaagccggaggaaattgagcagaagcaggaatttgtcgtgcagcatgtttcctactttgacgatatcctgcaaattatcaatgacttctctaaccgagtgatattggcagacgccaatttagagaaaatcaacaagctgtatcaggataataaagaaaacattcccgtagacgagctcgctaacaatatcattaacctgtttactttcaccagccttggtgcgcctgccgcatttaagttcttcgataaaatcgtcgacagaaagcggtacacgtccacaaaagaggtgcttaattcaaccttgatacaccagagcattactgggctatatgaaacaaggatcgatctgggcaagctcggagaggactga

SEQ ID NO: 3125 - RNA, 4113 nt, synthetic construct
  misc_feature 1..4113: note = Cas9 variant
  source 1..4113: mol_type = other RNA
atgaccaagaaaaactacagcatcggcctggacattgggacaaattccgtgggatgggccgtcataactgatgactataaggttcccgctaaaaagatgaaagtgctcggtaacacggataagaagtacatcaaaaagaatcttctgggcgcattgttattcgactctggggagaccgccgaagcgacaagactgaaaaggactgctcggcgccgatatacccgtagaaagaacaggctacggtacctccaggagatttttgccgaagagatgacaaaagtagatgaatcattcttttatcgcctggacgagagtttccttaccactgatgagaaggactttgaaagacaccctatcttcggaaataaggcagaggaagatgcctaccatcaaaaatttccaacaatttatcacctgaggaactacttggctgacagctccgagaaggcagatctccggctggtgtacctggccctcgctcatatgatcaaatatcgcggccacttcttaatagagggtaagctgaatgccgaaaacaccgacgtccagaaactttttacggatttcgtgggggtttacgaccgaacttttgacgattctcatttgtcggagatcaccgtggacgtcgcgtcaacactgactgaaaagattagcaaaagtagaaggctagagaatctcatcaagtattacccgaccgaaaagaaaaacacactgttcggaaatcttattgcactggccttgggcctccagcccaactttaagatgaatttcaaactgtccgaggatgctaagttacagttctctaaagacacctatgaggaagatctggaggaactccttggcaagatcggggacgattacgccgacctgtttacgagcgcaaagaacttgtatgatgctatactactgtccggtattctcactgtggacgataattcaacaaaagcccctctgagtgcgagcatgatcaagcggtacgtagagcaccacgaagaccttgagaaactgaaggagttcattaaagccaacaagtctgaattgtaccatgacatctttaaggataaaaacaagaatggatatgcaggctacatcgagaacggggttaaacaagacgagttctataagtacctcaaaaataccctgtccaagattgatggatcagactattttcttgataagatagaacgtgaagacttcctgcgcaaacagagaacttttgataacggcagcatcccacaccagattcatctacaggagatgcacgctatcctcaggcggcaaggtgactactatcccttcctgaaggagaaacaggatcgaatagaaaagattcttacatttcgcatcccttactacgtggggccattggtcagaaaagacagtaggttcgcctgggctgagtatcggtctgatgaaaagatcaccccctggaattttgacaaagtgattgataaggagaagtccgccgagaaattcatcacgcgcatgaccctgaacgacctctacctgcctgaagagaaggtgcttccaaaacacagccatgtctatgaaacatacgcagtttataatgagctgactaagattaaatacgtgaacgaacagggaaaggagtcgtttttcgactctaatatgaagcaggagatattcgatcacgtatttaaagaaaacagaaaggtgaccaaagagaagttgctcaattatctgaacaaagagttcccggaatacaggatcaaggacttaattggcctggataaggaaaataaatcctttaacgcctcactaggcacataccatgacctcaagaaaatcctggataaggctttccttgacgataaagtcaatgaggaggtgatcgaagacattataaagactttgaccctgtttgaggataaggacatgatccacgaacgtctccaaaaatatagtgatattttcacagcgaaccagctgaagaaattagagcggcgacattacaccgggtggggaagactgagctataagttaatcaacggtattaggaataaagaaaacaataagactatcttggactacctcatagatgacggctccgcaaaccgcaattttatgcagctgatcaacgacgatacgctacccttcaaacaaattatccagaagtctcaggttgtgggggacgtcgatgacattgaggccgtggtacacgatctgcctggaagcccagctatcaagaaaggcatactccagtcagttaagattgtggacgagctggtcaaagtgatgggtgataatcccgacaacatcgtcattgaaatggcccgggagaatcaaacaaccaacagagggaggagtcagtcccagcagcgccttaagaaattgcaaagctctctgaaggaattaggctcaaatatcctcaacgaggagaagcctagttatatagaagataaagtggagaatagccatctgcagaacgaccagctttttctgtactatatccagaatggaaaggatatgtacactggcgacgaattggacattgatcacctctccgactacgatatcgaccacattatcccacaagcattcataaaagatgactctattgataaccgagttctgacctcgagcgccaagaaccgggggaaatccgacgatgtgccctcactagacatcgtacgtgctagaaaggccgagtgggtcaggctgtataagagtggactcatctctaaacgcaagtttgataatctgacaaaagcagaacggggtggccttaccgaggcggacaaggctgggttcattaaaagacagttggtggagactaggcagatcacaaagcatgttgcccagattctggatgcacgatttaacacggaacacgacgagaatgacaaggtgatacgcgatgtcaaagtgatcaccttaaagagcaacctcgtatcccaattccggaaagacttcgaattttacaaggtgagagagattaatgattatcaccatgcccacgacgcttacctgaacgccgttgtcggaactgcacttctgaaaaagtatccgaagctagcttcagagttcgtgtacggcgaatataaaaagtacgatatcaggaaatttattacaaatagctctgacaaggccaccgcgaaatacttcttttattccaacctcatgaatttctttaagacaaaagtgaagtacgccgatggtactgtcttcgagcgtcctatcatagaaaccaacgctgacggggagatcgcatggaataagcagattgattttgaaaaagttcgcaaggtgctgagttatccccaggtgaacatcgtaaagaaggtcgagacgcaaaccggcggattcagcaaagaatctattttgccaaagggcgactccgataagctgatccctcggaaaacaaagaaagtgtactgggacactaagaaatatgggggatttgattcacccaccgttgcctacagtgtgttcgtcgtggctgacgttgagaagggtaaggccaaaaagttaaaaacagtgaaggagctcgtaggcataagcattatggaaagatcgttctttgaggaaaatccagtcgagttcctggagaacaaagggtatcataatatcagggaagacaaacttatcaagctgcccaaatactccttgtttgagttcgaaggaggccgacggcgcctcctggcatctgcgagcgagctacagaagggtaacgaaatggtgctgcctgggtaccttgtggagctcctgtatcacgcccatagagctgataactttaattcaactgagtacttgaactatgtcagtgaacacaaaaaggagttcgaaaaagttctgtcctgcgtggaggactttgccaatttatacgtagatgtggaaaagaacctctctaaaattagggcagtcgctgacagcatggataatttctccatagaggagatctcaaacagctttattaatctgcttaccctgacggccttgggcgcaccagccgacttcaactttctcggagaaaagatcccgcggaagcgatatacaagtaccaaagagtgtctgactgctacactaattcaccagtctatcaccggcctgtacgaaactagaatagatctttccaagctcggggaggaatga

SEQ ID NO: 3126 - RNA, 4113 nt, synthetic construct
  misc_feature 1..4113: note = Cas9 variant
  source 1..4113: mol_type = other RNA
atgaagaacgccaataaagtgaccggcaagtactatctggggttcgacatcggaacaaacagcgtcggttgggctgttactgatgagaattacaacctctgcaaatttaagaaaaagtccatgtggggcattagacttttcgaagacgcaaagacggccgaggaaaggcgggggcagcgcgcgtctcgacgtagactgcaaaggcggaaacagcgcatagatttgttacaggagatctttgctgaagagattaataaggtggacgagaccttctttatcagactgaacgaatcaaggctacacctcgatgacaaaacagtaagtgagaagcatcccctgttcattggaagcgaatattccgagaaagagtactatcgggaataccctactatctttcaccttcgcaaggagctgatggaatcttcggagccacatgatatacgattggtgtatctcgccatccaccatattctgaagaatagaggccacttcctgatcgacggtgaactctcaaaagcaaacagctttgatgccgctttctaccagatgaaggaggtcttatgtaatgagctggaccttgaaattgatggggagaacaccacagaagtggagaggaccttgcgggaccgtaatatcagtaaatccgataaggttaaactgctagcagccctcctggctatgaaccaaaatgaaactgagtctaaggagacaaagaagaagatagaaaacatttgcaaacttctggccggaaataagggcgacatcagcaaaatttttggccagaccccggagggggtggaaaagacgtccttctcatttggagaggcggactacgatgaaagtatccgccccaacttggaggagagcatccctgaccagtgtttcgtcattgattctataaaagcactctatgactggaacgtgctggccgatatcttaaatggtcagacttacctgtcctgcgctaaggtaaaccaatatgaaacccacaagaataacctcaaagagcttaagctgttggttaatagatactgttcaagggaagagtataaacggttctttaagagcgccgtggagaaagcaaactacagtaattatattggctctgctaagcaggggaacaagatcatagacgtcaaacgatgcgccgaagaggatttctacaaggaactaaaaattctgctctccaagatcgagccagaagaggcggaccgcgagctgtacgaaagaatcaaaagggaggccgaagagggaagccttctgcccttgcagcggaataaggataactcggtggtgcctaatcagatgcataaggcagaactcgctctgattttagagaacgccggctcttatctgggttttctaaatgagaaagacgaagatgggctctccccagctgagaagatcattgaactgttctcatttcgcataccctactatgtcggacctcttagtgacagacacaaagacaggggcagcaacgcctggatcgttcgtaaggcagagggccggattttgccatggaatttcgatgaaaaagtggaccgagagaagtccaacgaggcctttatcgaaagaatgacaaacaaatgtacttacctgctcgggaaggatgtagtggctaaaaattctctgatctatagccatttcatggtccttaacgagctgaataacttgtcagtgtgcggaaataaaattagtgttcaagtgaagcaggacatatacagggaactctttcagcgccacaccaaagtctccaagaaaatgctgttacaatattgtcgggagaagatgatgaacaaggatctggaggaagaggacctaagcggtttcgatggcgactttaaagcgaagctctcttcatacctggatttcgagaaaaaggtgtttggggcaaaaatggaagaagacagaatcaggaagattacagaggatatcattcgctggaagaccatctacggagacgatggcaaaatgcttcaggccgtagttgagaaggaatatccgggtgagttggacagtgaccagctgaaagctgtgaagcagttccgatacagcgggtggggcaatttctccgaagagtttctcaacggaatagtcggcacggaaaaacccactgggcaaatgttcacaatcattgaggccctgtggcagaccaattgcaacttaatgcagctgctttctaagaattttactttcatggaggaaatcgagaagcacaaccgggaattggcaggacagattacagatatctcgtatgacaaactcgtgaaggatctgtacataagccctgccaataaacgtgctgtctggcaaaccgtgagaattgccgaggaagttaagaaaatcatgggttgtgagccagcaaagatttttgtggagatggcgaggggcggggaaaaagagaagaagcgcacgatctcccggaaaaagaaactactggaactctatgctgcctgcaagaaagacgcaagagattggaacagggagatagaggaccgagatgaacgcgagttcaattcagacaagctgtacctttattacacccagatgggacggtgcatgtacagtggcgaaagaatcgatttgcatgagctgatgtctgccaacagcaagtgggacattgatcacatctatccccagtccaaagtaaaggacgattcattagacaacagggtcctcagcctgaaaaagattaataacgaaaaaggtaataagcctctttctcgtgacatccagcaatcccagcagaagtggtggacagagctgttgcagctcgagtttataactaaaaagaaatacgatcgcctgatgcatagaggggaactaagtgaggaggaactgagcggcttcattaaccggcaactcgtggaaaccaggcagtctacaaaggctgccgcagagctgcttggacgaatgtataataactccaaagttgtgtacgtcaaggctccattggtgtcacagtttcggaaggacgatctgaatatcttaaaaagtcgcctcgccaacgactatcaccatgcgaaggatgcctacctgaatatcgctgtaggcaacgtgtataatgagaaattcactgacaacccccttagatggattgaaaagcacgcaggggagaattacagcatcaacagggtttttgattacgacattgtcgccggagatggtgctccggtgtgggccgcacctctgcgggacgagaaaaataagctacgaaagaacgaagtgggcgaaaaatatgggggaaccatagatgtcatcagaaagacagttaaacgcaacgacgtgctctacaccgagcacacttattgtggcaagggtgagctgttcaatgcgacgattgccaaaaaggacgggggcgctgaaatccccttgaaagccggactgcaaacaggcaagtacgggggatataagtcgccaaacacctcctactttgcagctattgagttcgatggcaaaaagggtgaaagggtgaaaaatatcatggaggtacctgtctatatagccaacatcttactccatgacattgatgcatacatccgttactgcgagactgtgaaggggctgaaaaatgttaagattcttcggccctgtatcaagaaaaacgccctgatatctgtggacggatatccaatgagaattaggggcgctaatgaaaagaacatcttgctcaaaaataacctgcagcccatcttcggtcgccacgaggaaaccgtccgaagaattgagaagtacgtggagaaaaatcaggaatttgaggttgatgaaaagttcgacggcctaaacgaggcgaatctgacagatctttatgacgatataaccgaaaagctctgcgggccttacgtggagcggccaagcaaccagggagaatatctgatggagaatagggagaaatttttgaacatctcactgaaggaaaaagccaagttactcgcacaaatgattaaactggtacgctgtgacactgagacaaaggctgatcttcgtagtatcggcgcctccaagaatgccggggtcatttctgtgaacaaaaacacgctgggaggcaagagattgatcctcataaatcagagcgtgaccggtctgttcgaaaaccggatcgagctatga

SEQ ID NO: 3127 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctataatcacagatgactataaagtccctgccaagaaaatgagagttctcggtaacactgataaggagtacattaaaaagaatcttatcggcgctctgttgttcgacgggggaaacacggcagccgataggcggttaaagcgcaccgcgcgacgtagatatacaaggcggcgcaataggattctgtacctacaggaaatctttgctgaggaaatgtcaaaagtggacgatagtttctttcacagactcgaggacagcttcctggtagaagaggataagcggggctccaaatatccaatatttgccactatgcaagaggaaaagtactatcatgagaaattcccgaccatctaccaccttcgcaaggaactggcagacaagaaagagaaggccgatttgcgactcatttacctggctctggcacatatcattaaatttagaggtcacttcctcatcgaggacgataggtttgacgtgcggaacacagacatacagaagcagtatcaggccttcttagaaatttttgataccactttcgagaataacgacctgctttctcaaaatgtcgatgtggaagctatcttgacagacaaaatttcgaagtcagccaaaaaggatcgtatcctggcgcgctaccccaaccaaaagagcaccgggatctttgcagagttcctaaaactcattgttggaaatcaggccgacttcaagaaacattttaacctggaagataagacgcctcttcagttcgctaaagacagttatgatgaggacctggagaatttgctcggccagataggcgatgaatttgccgacctgttctccgcagctaagaagttatacgactctgtgctgctcagcgggatccttactgtcaccgatctgtccacaaaagccccattgtcagcgagtatgattcagagatatgacgagcacagggaagatctaaagcagctgaaacagtttgtgaaggccagcctccccgagaaataccaagaaatcttcgcagactcttccaaggatggatatgctggttacatagagggcaagactaaccaggaggccttttacaaatatctgtcaaaacttctgaccaaacaggaagggagcgagtacttgctcgaaaagattaaaaatgaggacttcctgcggaagcaacgaacatttgataacggaagtatccctcaccaggtacatttaaccgaactgcgcgctatcattagaaggcagtctgagtattacccattcctaaaggagaacctcgaccggatcgaaaagattctgacgtttcgcataccctattacgttggccctcttgccagagagaagtccgatttcgcatggatgactaggaaaacagacgatagcatccgtccatggaattttgaagacttggtggataaggagaaatcggccgaggctttcattcaccggatgaccaacaatgacctgtatctcccggaagagaaggtcctgcccaaacattctcttatctacgaaaagttcactgtgtacaacgagctgacaaaggtgcgatttttggcggaaggtttcaaagactttcagttcctcaatagaaagcaaaaagagaccatctttaactccctgttcaaggagaaaaggaaggtcacggaaaaggatattatatcatttttaaataaagttgacgggtatgagggaatcgcaattaagggcatcgaaaaacagttcaacgccagtctgagcacctaccacgatctaaagaaaattctcggcaaggactttctggataatacagacaacgagcttatcttggaagatatagtgcagactctgaccctcttcgaggaccgcgagatgatccggaagagactggatatttataaagactttttcacagaatcccagttaaagaaactgtacaggcgccactatactgggtggggacgactttctgctaagttgatcaatggtattcggaacaaagagaatcaaaagaccatcctcgattacctgatagacgatggcagcgccaaccgtaattttatgcagctaattaaggacgcagggctgtcattcaaacctatcattgacaaggccagaacaggaagtcattccgataacctcaaagaagtagtgggcgagctggctggtagcccagccatcaagaaagggatacttcagtctttgaagatcgtcgacgaactggtgaaagttatgggctatgagcccgagcagattgtggtcgaaatggcaagggagaaccaaaccactgcgaagggattatcacgcagtcggcagagactcacgacactgagggaaagccttgctaatctgaagtccaacatcttggaggagaaaaagcctaaatacgtgaaggatcaggtagaaaatcaccatctctctgacgatcgactgttcctatactatctgcagaacggcaaagacatgtacaccgatgacgagctcgatattgacaatctgtcgcaatatgatatcgaccacataattccacaggcctttatcaaggacgatagcatcgacaaccgcgttcttgtgtcctcagcaaagaatcgggggaaaagtgatgacgtcccctctgtggaaattgtcaaggattgcaaagtgttctggaagaaattgctggacgccaagttaatgagccagagaaagtacgataacctcactaaagctgagaggggaggtctgacctccgacgataaggcccgttttatccaacgccagcttgttgaaacacggcagattaccaaacatgtggcaagaatactggacgagaggttcaataacgagctagattcaaagggccgacggatccgcaaagtaaagattgtcactctcaagagcaatctggtgtctaactttagaaaagagttcgggttttataagatcagggaagttaataactaccaccacgctcatgacgcctatttgaatgcggtggtcgccaaagctattctgacaaagtacccgcagttagaacctgagttcgtgtacggagattatcccaaatacaactcctataagacgcggaagagtgcaaccgaaaaactctttttctacagcaacatcatgaatttcttcaagactaaagtaacactggccgacggcaccgtggttgtcaaggacgatatagaggtgaacaatgacacaggtgagatcgtgtgggataaaaagaaacacttcgctactgtccgaaaggttctttcttatccacaagtgaacattgtgaagaaaaccgaaatccagaccgggggcttttccaaggagtcaattctggcccatggaaatagtgacaaattgatccctagaaagacgaaagatatatacctcgaccccaagaagtatggcgggttcgatagcccaattgtagcatactcggtcctggtggttgcggacatcaaaaagggaaaagcccagaagctaaaaacagtgactgaactgcttggtatcaccattatggagcgctccaggtttgaaaagaacccctctgctttcctcgagagcaagggctacctgaatatacgtgatgacaaattgatgatcctgcctaagtattcattatttgagctcgaaaacgggcggagaaggctgcttgccagtgcaggagagctgcagaaaggcaatgaattggctctcccaacacaattcatgaagtttctgtacctagcctcccgctataacgagctgaaaggtaagccggaggaaattgagcagaagcaggaatttgtcgtgcagcacgtttcttactttgatgacatccttcaaattatcaatgatttcagcaaccgagtgatactcgcagacgccaatctggagaaaatcaacaagttgtatcaggacaataaagaaaacattcccgtagatgagttagctaacaatatcattaacctgtttactttcacctccctcggggcgcctgccgcatttaagttcttcgacaaaatcgtcgatagaaagcggtacacgtcaacaaaagaggtgctgaatagcacccttatacaccagagtattactggcctgtatgaaacaaggatcgacttgggaaagctaggcgaggattga

SEQ ID NO: 3128 - RNA, 4113 nt, synthetic construct
  misc_feature 1..4113: note = Cas9 variant
  source 1..4113: mol_type = other RNA
atgaccaagatcaaagacgattacattgtgggcctggacatagggacagatagctgcggatgggtcgccatgaactccaataacgacatcctcaaacttcagggtaaaactgctattggctctagactgttcgaagggggaaagtcagcagccgaaaggcggttgtttcgcacgacccaccgacgtatcaaaagaaggcggtggcgcttaaagctgctagaggagttctttgatccctatatggcggaggttgacccttacttctttgctagactcaaggaaagtggcctgagcccacttgataaaaggaagacagtgtcctctattgtattcccgacttcggccgaggacaaaaagttttatgatgactaccccaccatctatcatctgcggtacaaattgatgacagaggatgaaaagttcgacctccgcgaggtgtatctggcaatacaccatatcattaagtaccgaggtaattttctgtacaacacctcagtcaaagatttcaaggccagcaaaatcgacgtgaagagttccattgaaaaactcaatgagttatatgagaacctggggcttgacttgaatgttgaatttaacatctctaatactgctgagatagaaaaggtgctgaaagataagcaaattttcaagagagacaaagtcaagaaaatcgcagagctatttgccattaagacagataacaaagaacagagcaagaggatcaaggacatctccaaacaggtggctaatgccgtactcggatacaagacccggttcgatacgattgcgctgaaagagatatcaaaggacgagcttagtgattggaacttcaaactgagcgacatcgatgcagactctaagtttgaagccttgatgggcaatctcgatgagaacgaacaggctattctgttaactatcaaggagctgttcaatgaagttaccctcaacggcatagtggaggacgggaacacactttccgagtcaatgattaataaatataacgaccaccgtgatgacctgaagttgctaaaagaagtcatcgagaatcatatcgatcgcaagaaagccaaggaactggcactcgcttacgacctgtatgtgaacaatagacacggaaggcttctgcaagccaagaaaaagttgggtaaaattaagcctcggagcaaagaggatttttacaaggtggtcaacaaaaatctcgacgatagtcgagcgtctaaggaaatcaagaaaaagattgagctggactccttcatgccaaaacagcgcactaacgccaatggcgttataccctatcagttacagcaactggagctagataagatcattgaaaaccagagcaaatactacccttttctcaaggagatcaatccagtgtcgtctcacctgaaggaagcaccctataaacttgacgagttgatcagattcagggtaccttactatgtggggccactgatttccccgaacgagtcaaccaaggatatacagactaaaaagaatcagaactttgcttggatgatccggaaagaagagggacgcattaccccctggaatttcgaccaaaaggtcgatagaatcgaaagtgccaacaagtttattaaaaggatgacgactaaggacacatacctcttcggcgaggacgtgctgcctgctaacagccttctgtatcagaaatttaccgttttgaatgaactcaacaatatccgtataaacggtaagcggatctccgtggatctgaaacaggagatttacgagaatttattcaagaagcatactacagtcaccgtgaaaaagctggaaaactatctaaaagagaatcacaacctcgtaaaggttgaaatcaaagggctggccgacgagaagaaatttaattctggacttacgacctacaaccgattcaagaatttgaacattttcgataatcaaatcgacgatctgaagtacagaaacgactttgaaaagataattgagtggagcacaatcttcgaggataagtcaatttataaagaaaagctcaggagtatcgactggctgaatgagaaacagataaacgcattatccaacatccgcctgcagggctggggccggcttagcaagaagttgctcgcccagctgcatgatcacaatgggcaaactattatcgaacagctatgggactctcagaacaattttatgcagattgtgacccaagctgatttcaaagacgcgatcgcaaaggccaaccagaatctgctcgtcgctacatcagtggaggatatactgaacaatgcctacacaagtccagcaaacaaaaaggccattagacaggtcatcaaagtggttgacgacatcgtgaaggctgccagcggaaaggtacccaaacagattgcaatcgaatttaccagggatgcggacgagaatcctaagcgctcccaaacacgaggttctaaacttcagaaggtctataaagatttgtcgaccgagctggctagcaagactattgccgaagagttaaacgaagcaataaaggacaaaaagctcgtgcaggataaatactatctgtacttcatgcagcttggccgggacgcctatacgggggagccaatcaatattgatgagatccaaaagtacgacattgatcacatcctgccccagtcctttataaaagacgatgctttggacaaccgtgttctcgtgtcaagagccgtcaataacggaaagagtgacaatgtgccggtaaagctgttcggcaacgaaatggcagctaacctaggtatgacaatcaggaaaatgtgggaggaatggaagaatattgggctgatctctaaaaccaagtacaacaatctcctgactgatcctgaccatattaacaaatataagagcgccggctttatccgccggcagcttgtggagacctcccaaataattaaattggtttcaacaatcctgcagagcagataccccaataccgaaatcattactgtcaaggcgaagtataaccactacttaagggagaaattcgatctctataagtctcgagaggtgaatgactaccatcacgccatagatgcttatctgtccgcaatctgtggaaaccttctgtaccagaattacccaaacctacgcccctttttcgtgtatggccagtacaaaaagtttagtagcgaccctgataaagaaaaggagattttcaataagacacggaaattctcttttatctcccaaattctcaagaacaaatcagaaaatagtaaggagatcgccgaaaaactgaagagagcttatcagttcaagtacatgttggtcagcagggagacggagaccaaagaccaggaaatgtttaagatgactgttttcccacgtgagacacccgggaacctgatacctaaaaagaaaggaatggccccagaaatctatggtggctacaccaaaaattcggatgcatatatggtgattgtgaagatcgacaagaagaaagagacagaataccgcattttagggatcccgactcgggagctcgtaaacctgaagaaagcggagaaggaagatcattacgagtcctatcttaaagaaatactggcccccagaattttgtacaataagaacggaaagagggacaaaaagatcacctcttttgagatcgtcaaaagcaagattccttataaacaggtgatccaagatggcgacaagaagttcatgctcggttcaagtacgtacgtttataacgctaaacagctgaccctatccacagagtctatgaaggccataactaataactttgacaaagatagcgacgaaaatgatgcactgattaaggcttacgacgagatccttgataaagtggacaagtatctcccactgttcgatattaacgcctttcgaaagaaattgcactccgggcgggaaaagttcgtcgagctgtcattagaagacaaaaaggatatcatactcaaagtgctgattggccttcacgacaatcccgcaaccagcgatctgaagacattgggatttagttctactgagctcggcaagatgcagaaaaactccgggatcgttctgagcggaaatgccaagctaatctaccagtcgcctaccggtctgttcaaaaagtcagtgaaaatttctgacctttga

SEQ ID NO: 3129 - RNA, 4113 nt, synthetic construct
  misc_feature 1..4113: note = Cas9 variant
  source 1..4113: mol_type = other RNA
atgaccaagatcaaagacgattacattgtgggcctggacatagggacagatagctgcggatgggtcgccatgaactccgacaatgatatcctcaaacttcagggtaaaactgctattggctctcacctgttcgaggcagggaagtcagccgcggacagaaggttgtttcggacgacccatcgccgaatcaaacgtagaaggtggcggttaaagctgctagaagagttctttgatccctatatggctaaggttgacccttacttctttgcccgcctcaaagaaagtggactgagcccacttgataagagaaagaacgtgttctccattgtatttccgacagcagccgaggacaagaaattctatgatgactaccccactatctatcacctgaggtacaagttgatgaccgaagatgagaagtttgacctccgggaggtgtatctggctatacatcacatcattaaataccgcggcaatttcctgtacaacacatctgtcaaggactttaaagcatcgaagatcgatgtgaaatcaagcattgaaaagctcaatgagttatatgaaaacctgggtcttgacttgaatgttgagttcaacatcagtaataccgccgagatagaaaaagtgctgaaggataagcaaatttttaaacgagacaaggtcaaaaagatcgctgagctattcgccattaaaactgataacaaggaacagtccaagagaatcaaagacatctctaaacaggtggcgaatgcagtactcgggtacaaaacaaggttcgataccattgccctgaaggaggttagcaaagacgaactttccgattggaactttaagctgtcagacatagatgctgacagtaagttcgaggccttgatgggaaatctcgacgagaacgaacaggcaatcctgttaacgattaaagagctgtttaatgctgtgactctcaacggcatcgtcgaagatggcaacacccttagcgagtctatgataaataagtataacgaccatcgggatgacctgaaattgctaaaggaagtgattgagaatcacatcgatcgtaaaaaggccgtgaagctggcgctcgcctacgacctgtatgtcaacaatcgccacgggcaacttatccaggcaaagaagaaactgggaaagattaaacctggttccaaggaggatttctacaaagttgtgaacaagaatttggacgattcacaggctagcaaggaaatcaaaaagaaaattgagctcgacagttttatgccaaagcagagaacaaacgccaatggcgtaataccctatcaactgcatcagttagaactggataaaatcattgagaaccagtctaagtactaccctttcctaaaggaaatcaatccagtgtccagccacctcaaagaggctccctataagctggacgagcttatcaggtttcgggtcccttactatgtggggccattgatttcgccgaacgaatctactaaagatatacagaccaagaaaaatcaaaacttcgcctggatgatccgaaaggaggaaggacgcattacaccctggaattttgaccagaaggttgacagaatcgagtccgcaaacaaattcattaagaggatgaccacgaaagatacttacctgtttggcgagaacgtgctccctgccaattcactgctttatcagaagttcacagtcctgaacgaattgaataacatccggataaatggtaaacgcatcagtgtggacctcaagcaagagatttacgaaaacctgtttaagaaacataccactgtaacagttaagaaattagagaattatctgaagcagaaccacaatctagtgaaagtcgaaatcaaggggctcgctgatgagaaaaagttcaacagcggactgaccacgtacaatagattcaagaaccttaatatttttgacaaccagatcgatgacttgaaatacaggaaggatttcgagaaaataattgaatggtccaccatctttgaggacaagtctatttataaagaaaagctgcgtagcatcgattggctcaatgagaagcagataaacgcgctgtcaaacatccggttacaaggctggggccgactgagtaaaaagttgcttgcacagctccacgaccataatgggcagacaattatcgaacagctgtgggattcccaaaacaatttcatgcagattgtgactcaggccgactttaaagatgctatcgccaaggcaaaccagaatctactggtcgccaccagcgtggaggacatactcaacgacgcttacacatctccagccaataaaaaggcaattagacaagttatcaaggtggtagatgacatcgtcaaagcggcttcaggaaaggtgcccaaacagattgccatcgagttcactagggatgcagacgataaccctaagcgcagtcagacccggggtagcaaactgcagaaggtttataaggacctttccacagaattggcctctaaagctattgccgaggaactgaatgaggcaataaaggataaaaagttagtgcaagacaaatactatctctactttatgcagctgggcagagatgcttataccggggaaccaatcaacattgacgagatccagaagtacgatattgaccacatccttccccaatcgttcataaaggacgatgccctggacaatagggtcttggtgagcaaagcggtaaacaatgataagtccgacaacgtgccggttaaactctttggaaatgagatggccggcaacctgggtatcactattcgcaagatgtgggaagagtggaaaaacatcgggctaatttcaaagacgaaatacaataacctgctcacagatcctgaccatatcaataagtatgaaagtgctggcttcatacgacggcagctggtcgagacctctcagattatcaaacttgtgagcactatcttgcagtcccgttaccccaacaccgagattataacagtgaaagcaaagtataatcactacctgagagaaaaatttgatttatataagtcaagggaggtcaacgactaccatcacgccatcgatgcttatctcagcgccatttgtggaaatctgctttaccaaaactacccaaatctgcgccctttctttgtttatggccagtacaaaaagttctcttccgaccccgataaggaaaaagagatcttcaacaagacccggaaatttagtttcattagccagatcctaaagaataaatctgaaaactccaaggagatagcagagaagctcaaaagagcgtatcagtttaagtacatgctggtgtcaagggaaactgagacaaaagaccaagaaatgttcaagatgacggtgtttccacgagagacccccgggaatttgatccctaaaaagaagggaatggccactgaaatttatggtggctacacaaagaacagtgatgcttatatggtaatcgtcaagattgacaaaaagaaagagaccgagtaccgcatcctggggataccaacacgggaattagtgaatctcaagaaagccgagaaggaagaccactacgagagctatctgaaggaaattcttgcaccgagaatcctgtacaacaaaaatggaaagagggataaaaagatcacttcgttcgagattgttaaatccaagatcccctataaacaggtgatacaggacggcgataaaaagtttatgttgggttctagcacctacgtctataacgctaaacagctcacgctgtcaaccgagagtatgaaggccattacaaacaatttcgacaaagattccgacgaaaacgatgcactaatcaaggcctacgacgagattctggataaggtggacaaatatcttcctctctttgatatcaatgctttccgtaagaaactgcattctgggcgcgaaaagtttgttgagttgagcctggaggacaaaaaggatataattttaaaggtgctcatcggcctgcacgacaacccagcgacttccgaccttaaaaccctgggattctcaagcacagaattgggcaagatgcaaaagaatagtgggatcgtactctctggaaacgccaagctgatttaccagtcccccactggtctattcaaaaagagcgtcaaaatctcggatctgtga

SEQ ID NO: 3130 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctataatcacagatgactataaagtccctgccaagaaaatgagagttctcggtaacactgataaggagtacattaaaaagaatcttatcggcgctctgttgttcgacgggggaaacacggcagccgataggcggttaaagcgcaccgcgcgacgtagatatacaaggcggcgcaataggattctgtacctacaggaaatctttgctgaggaaatgtcaaaagtggacgatagtttctttcacagactcgaggacagcttcctggtagaagaggataagcggggctccaaatatccaatatttgccactatgcaagaggaaaagtactatcatgagaaattcccgaccatctaccaccttcgcaaggaactggcagacaagaaagagaaggccgatttgcgactcatttacctggctctggcacatatcattaaatttagaggtcacttcctcatcgaggacgataggtttgacgtgcggaacacagacatacagaagcagtatcaggccttcttagaaatttttgataccactttcgagaataacgacctgctttctcaaaatgtcgatgtggaagctatcttgacagacaaaatttcgaagtcagccaaaaaggatcgtatcctggcgcgctaccccaaccaaaagagcaccgggatctttgcagagttcctaaaactcattgttggaaatcaggccgacttcaagaaacattttaacctggaagataagacgcctcttcagttcgctaaagacagttatgatgaggacctggagaatttgctcggccagataggcgatgaatttgccgacctgttctccgcagctaagaagttatacgactctgtgctgctcagcgggatccttactgtcaccgatctgtccacaaaagccccattgtcagcgagtatgattcagagatatgacgagcacagggaagatctaaagcagctgaaacagtttgtgaaggccagcctccccgagaaataccaagaaatcttcgcagactcttccaaggatggatatgctggttacatagagggcaagactaaccaggaggccttttacaaatatctgtcaaaacttctgaccaaacaggaagggagcgagtacttgctcgaaaagattaaaaatgaggacttcctgcggaagcaacgaacatttgataacggaagtatccctcaccaggtacatttaaccgaactgcgcgctatcattagaaggcagtctgagtattacccattcctaaaggagaacctcgaccggatcgaaaagattctgacgtttcgcataccctattacgttggccctcttgccagagagaagtccgatttcgcatggatgactaggaaaacagacgatagcatccgtccatggaattttgaagacttggtggataaggagaaatcggccgaggctttcattcaccggatgaccaacaatgacctgtatctcccggaagagaaggtcctgcccaaacattctcttatctacgaaaagttcactgtgtacaacgagctgacaaaggtgcgatttttggcggaaggtttcaaagactttcagttcctcaatagaaagcaaaaagagaccatctttaactccctgttcaaggagaaaaggaaggtcacggaaaaggatattatatcatttttaaataaagttgacgggtatgagggaatcgcaattaagggcatcgaaaaacagttcaacgccagtctgagcacctaccacgatctaaagaaaattctcggcaaggactttctggataatacagacaacgagcttatcttggaagatatagtgcagactctgaccctcttcgaggaccgcgagatgatccggaagagactggatatttataaagactttttcacagaatcccagttaaagaaactgtacaggcgccactatactgggtggggacgactttctgctaagttgatcaatggtattcggaacaaagagaatcaaaagaccatcctcgattacctgatagacgatggcagcgccaaccgtaattttatgcagctaattaaggacgcagggctgtcattcaaacctatcattgacaaggccagaacaggaagtcattccgataacctcaaagaagtagtgggcgagctggctggtagcccagccatcaagaaagggatacttcagtctttgaagatcgtcgacgaactggtgaaagttatgggctatgagcccgagcagattgtggtcgaaatggcaagggagaaccaaaccactgcgaagggattatcacgcagtcggcagagactcacgacactgagggaaagccttgctaatctgaagtccaacatcttggaggagaaaaagcctaaatacgtgaaggatcaggtagaaaatcaccatctctctgacgatcgactgttcctatactatctgcagaacggcaaagacatgtacaccgatgacgagctcgatattgacaatctgtcgcaatatgatatcgaccacataattccacaggcctttatcaaggacgatagcatcgacaaccgcgttcttgtgtcctcagcaaagaatcgggggaaaagtgatgacgtcccctctgtggaaattgtcaaggattgcaaagtgttctggaagaaattgctggacgccaagttaatgagccagagaaagtacgataacctcactaaagctgagaggggaggtctgacctccgacgataaggcccgttttatccaacgccagcttgttgaaacacggcagattaccaaacatgtggcaagaatactggacgagaggttcaataacgagctagattcaaagggccgacggatccgcaaagtaaagattgtcactctcaagagcaatctggtgtctaactttagaaaagaatttgggttttataagatcagggaggttaataactaccaccacgctcatgacgcctatttgaatgcggtggtcgccaaagctattctgacaaagtacccgcagttagaacctgagttcgtgtacggagattatcccaaatacaactcctataagacgcggaagagtgcaaccgaaaaactctttttctacagcaacatcatgaatttcttcaagactaaagtaacactggccgacggcaccgtggttgtcaaggacgatatagaggtgaacaatgacacaggtgagatcgtgtgggataaaaagaaacacttcgctactgtccgaaaggttctttcttatccacaagtgaacattgtgaagaaaaccgaaatccagaccgggggcttttccaaggagtcaattctggcccatggaaatagtgacaaattgatccctagaaagacgaaagatatatacctcgaccccaagaagtatggcgggttcgatagcccaaaagtagcatactcggtcctggtggttgcggacattaagaaaggaaaggcccagaaactaaagacagtgactgaactgcttggtatcaccatcatggagcgctccaggtttgaaaagaacccctctgctttcctcgagagcaaaggctacctgaatattcgtgatgacaagttgatgatactgcctaaatattcattatttgagctcgaaaacgggcggagaaggctgcttgccagtgcaggagagctgcagaagggcaatgaattggctctcccaacacaattcatgaaatttctgtacctagcctcccgctataacgagctgaagggtaagccggaggaaatcgagcagaaacaggagttcgtcgtgcagcacgtttcttactttgatgacattcttcaaatcattaatgatttcagcaaccgagtgatcctcgcagacgccaatctggaaaagataaacaaattgtatcaggacaataaggaaaacatccccgtagatgagttagctaacaatattatcaacctgtttactttcacctccctcggggcgcctgccgcatttaaattcttcgacaagattgtcgatagaaaacggtacacgtcaacaaaggaggtgctgaatagcacccttatccacaagagtataactggcctgtatgaaacaaggattgacttgggaaaactaggcgaggattga

SEQ ID NO: 3131 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctataatcacagatgactataaggtccctgccaagaaaatgagagttctcggtaacactgataaggagtacattaaaaagaatcttatcggcgctctgttgttcgacgggggaaacacggcagccgataggcggttaaagcgcaccgcgcgacgtagatatacaaggcggcgcaataggattctgtacctacaggaaatctttgctgaggaaatgtcaaaagtggacgatagtttctttcacagactcgaggacagcttcctggtagaagaggataagcggggctccaaatatccaatatttgccactcttcaagaggaaaaggactaccatgagaaattctctaccatctatcatctgcgcaaggaattggcagataagaaagagaaggccgacctccgactgatttacatcgctctggcacacattatcaaatttagaggtcacttcctcatagaggatgactcgtttgacgtgaggaacacagatatttcaaagcagtaccaggacttcttagaaatctttaataccactttcgagaacaatgatctgcttagccagaacgtcgacgtggaagccattttgacagataaaatcagtaagtccgctaaaaaggaccggatcctggcccaatatccgaatcagaagtctaccgggatttttgcggagttcctaaaactcatagttggaaaccaggcagatttcaagaaatactttaatctggaagacaagacgccccttcagttcgccaaagatagctatgacgaggatctggagaacttgctcggccaaatcggcgacgaatttgctgacctgttctccgccgcaaagaagttatacgattcagtgctgctcagtgggattcttactgtcatcgacctgagcaccaaagctcctttgtctgcctccatgatacagcgttatgatgagcatcgcgaagacctaaagcagctgaaacagtttgtgaaggcgtcactcccagagaaataccaagaaattttcgccgatagcagtaaggacggatatgcaggttacatcgagggcaagacaaatcaggaggctttttacaaatatctgtctaaacttctgactaagcaggaagattccgagaacttcttggaaaagatcaaaaacgaggactttctcagaaagcaaaggaccttcgataatgggagcattccccaccaggtacacctgacagaattaaaggccatcattcggcgacagtcggagtactatccttttctgaaagagaaccaggaccgcatagaaaagatcctaaccttcaggattccatactatatcggacccctcgctagagagaaatctgattttgcctggatgacgcggaagactgacgattccatccgcccttggaatttcgaagacctggttgacaaagagaagtcagcagaggccttcattcatagaatgacaaacaatgatttttaccttccagaagagaaagtgttgccgaagcacagtctgatatatgaaaagttcaccgtctacaacgagctcactaaagtgaggtacaagaatgaacaaggcgagacatactttttcgacagcaacatcaaacaggagatttttgatggtgtgttcaaggaacatcgtaaagtctccaagaagaaactgcttgactttctggctaaggagtatgaagagttccggatcgttgatgtgattgggttggacaaagaaaataaggcgtttaacgcatctctcggaacctatcacgatctggagaaaatcttagacaaggatttcctggacaatcccgataacgagagcatactagaagacatcgtacagacgctcaccctgtttgaggatcgagaaatgattaagaaaagacttgagaattacaaggacttgttcacagaatcacagctgaaaaagctctataggcgccactacactggctggggccggctgagtgccaaattaatcaacgggattagagacaaggagtcccaaaagaccatcctggattatcttatagacgatggaaggagcaatcgcaactttatgcagttgattaacgacgatggtctctctttcaaatcaatcattagtaaggctcaggccggcagccattccgacaatctgaaagaggtggtcggggaactagcaggatctcctgccatcaagaaaggcatactgcagtcgctcaagatcgtggatgagctggttaaagtgatgggttacgaaccagagcaaattgtcgtggagatggctcgagaaaaccagacaactaatcaggggcggcgtaacagcagacagaggtacaaacttttggacgatggcgtaaagaatctggcctccgacttaaacggaaatatcctcaaggagtatcccaccgataaccaagcactgcagaatgaacgccttttcctgtactatttgcagaacggccgggacatgtacacaggggaggcgctcgacattgataatctgtcacaatatgacatcgatcacataattcctcaggcttttatcaaggacgatagtatcgacaacagagttctagtgtctagcgccaaaaataggggaaagtccgatgacgtcccatcactggaaattgtgaaagattgcaaggtcttctggaagaaactcctggacgcaaaacttatgagccagcgaaagtacgataacttgaccaaggccgagcgcggtggcctgacttctgacgataaagctcggtttatccagagacaattagtggagacgaggcagattacaaagcatgttgcccgtatactcgacgaacgcttcaataacgagctggactccaaggggcggagaatcaggaaagtgaagattgtaacccttaaaagtaacctggtcagcaattttcgaaaggagttcggattttataaaatccgggaagtgaacaattaccaccatgcacacgatgcttacctaaacgccgttgtggcgaaggccattctcactaagtatccccagctggaaccggagttcgtctacggcgactatcctaaatacaattcttataagacccgcaaatccgctacagagaagttgtttttctactcaaacatcatgaactttttcaaaaccaaggtgactctggcagatggtacagtagtggttaaggacgatatagaagtcaataatgacacgggggagatcgtgtgggataaaaagaaacacttcgccaccgtgagaaaggtcttaagttatccccagaacaatattgttaaaaagactgaaatccaaacaggcggatttagcaaagagtcgattctcgctcatggcaactccgacaagctgatcccaaggaagaccaaagatatataccttgaccctaagaaatacgggggattcgattctcccattgtggcctatagcgtgctggtagtcgcagacatcaagaaaggtaaggcgcagaagttgaaaacagtgactgaactcctgggcatcaccattatggagcggtcacgatttgagaagaatccaagtgccttcctagaatccaaagggtacctgaacataagagctgataaacttatcattctccccaagtattctctgtttgagttggaaaatggacgcaggcgtctgttagccagcgcaggcgagctccagaagggtaacgagctggcccttcctacgcagttcatgaagtttctgtacttggcttcccggtataacgaatcaaaagggaagccagaggaaatcgagaaaaagcaagagttcgttaatcagcacgtgagctactttgacgacattctccagctgatcaacgatttcagtaaaagagtcatactagcagacgccaatctggaaaagatcaacaaactttatcaagataataaggagaacatttctgtggacgaactcgctaataacatcattaatctgtttaccttcacatccttgggcgcgccggccgcatttaagttcttcgataaaatcgttgacaggaagcgctacactagcaccaaagaggtgttaaactcgacactgatacatcagtcaattactggactctacgaaacccgaatcgatctgggcaaacttggggaggactga

SEQ ID NO: 3132 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctataatcacagatgactataaggtccctgccaagaaaatgagagttctcggtaacactgataaggagtacattaaaaagaatcttatcggcgctctgttgttcgacgggggaaacacggcagccgataggcggttaaagcgcaccgcgcgacgtagatatacaaggcggcgcaataggattctgtacctacaggaaatctttgctgaggaaatgtcaaaagtggacgatagtttctttcacagactcgaggacagcttcctggtagaagaggataagcggggctccaaatatccaatatttgccactcttcaagaggaaaaggactaccatgagaaattctctaccatctatcatctgcgcaaggaattggcagataagaaagagaaggccgacctccgactgatttacatcgctctggcacacattatcaaatttagaggtcacttcctcatagaggatgactcgtttgacgtgaggaacacagatatttcaaagcagtaccaggacttcttagaaatctttaataccactttcgagaacaatgatctgcttagccagaacgtcgacgtggaagccattttgacagataaaatcagtaagtccgctaaaaaggaccggatcctggcccaatatccgaatcagaagtctaccgggatttttgcggagttcctaaaactcatagttggaaaccaggcagatttcaagaaatactttaatctggaagacaagacgccccttcagttcgccaaagatagctatgacgaggatctggagaacttgctcggccaaatcggcgacgaatttgctgacctgttctccgccgcaaagaagttatacgattcagtgctgctcagtgggattcttactgtcatcgacctgagcaccaaagctcctttgtctgcctccatgatacagcgttatgatgagcatcgcgaagacctaaagcagctgaaacagtttgtgaaggcgtcactcccagagaaataccaagaaattttcgccgatagcagtaaggacggatatgcaggttacatcgagggcaagacaaatcaggaggctttttacaaatatctgtctaaacttctgactaagcaggaagattccgagaacttcttggaaaagatcaaaaacgaggactttctcagaaagcaaaggaccttcgataatgggagcattccccaccaggtacacctgacagaattaaaggccatcattcggcgacagtcggagtactatccttttctgaaagagaaccaggaccgcatagaaaagatcctaaccttcaggattccatactatatcggacccctcgctagagagaaatctgattttgcctggatgacgcggaagactgacgattccatccgcccttggaatttcgaagacctggttgacaaagagaagtcagcagaggccttcattcatagaatgacaaacaatgatttttaccttccagaagagaaagtgttgccgaagcacagtctgatatatgaaaagttcaccgtctacaacgagctcactaaagtgaggtacaagaatgaacaaggcgagacatactttttcgacagcaacatcaaacaggagatttttgatggtgtgttcaaggaacatcgtaaagtctccaagaagaaactgcttgactttctggctaaggagtatgaagagttccggatcgttgatgtgattgggttggacaaagaaaataaggcgtttaacgcatctctcggaacctatcacgatctggagaaaatcttagacaaggatttcctggacaatcccgataacgagagcatactagaagacatcgtacagacgctcaccctgtttgaggatcgagaaatgattaagaaaagacttgagaattacaaggacttgttcacagaatcacagctgaaaaagctctataggcgccactacactggctggggccggctgagtgccaaattaatcaacgggattagagacaaggagtcccaaaagaccatcctggattatcttatagacgatggaaggagcaatcgcaactttatgcagttgattaacgacgatggtctctctttcaaatcaatcattagtaaggctcaggccggcagccattccgacaatctgaaagaggtggtcggggaactagcaggatctcctgccatcaagaaaggcatactgcagtcgctcaagatcgtggatgagctggttaaagtgatgggttacgaaccagagcaaattgtcgtggagatggctcgagaaaaccagacaactaatcaggggcggcgtaacagcagacagaggtacaaacttttggacgatggcgtaaagaatctggcctccgacttaaacggaaatatcctcaaggagtatcccaccgataaccaagcactgcagaatgaacgccttttcctgtactatttgcagaacggccgggacatgtacacaggggaggcgctcgacattgataatctgtcacaatatgacatcgatcacataattcctcaggcttttatcaaggacgatagtatcgacaacagagttctagtgtctagcgccaaaaataggggaaagtccgatgacgtcccatcactggaaattgtgaaagattgcaaggtcttctggaagaaactcctggacgcaaaacttatgagccagcgaaagtacgataacttgaccaaggccgagcgcggtggcctgacttctgacgataaagctcggtttatccagagacaattagtggagacgaggcagattacaaagcatgttgcccgtatactcgacgaacgcttcaataacgagctggactccaaggggcggagaatcaggaaagtgaagattgtaacccttaaaagtaacctggtcagcaattttcgaaaggagttcggattttataaaatccgggaagtgaacaattaccaccatgcacacgatgcttacctaaacgccgttgtggcgaaggccattctcactaagtatccccagctggaaccggagttcgtctacggcgactatcctaaatacaattcttataagacccgcaaatccgctacagagaagttgtttttctactcaaacatcatgaactttttcaaaaccaaggtgactctggcagatggtacagtagtggttaaggacgatatagaagtcaataatgacacgggggagatcgtgtgggataaaaagaaacacttcgccaccgtgagaaaggtcttaagttatccccagaacaatattgttaaaaagactgaaatccaaacaggcggatttagcaaagagtcgattctcgctcatggcaactccgacaagctgatcccaaggaagaccaaagatatataccttgaccctaagaaatacgggggattcgattctcccattgtggcctatagcgtgctggtagtcgcagacatcaagaaaggtaaggcgcagaagttgaaaacagtgactgaactcctgggcatcaccattatggagcggtcacgatttgagaagaatccaagtgccttcctagaatccaaagggtacctgaacataagagatgacaaacttatgatcctccccaagtattctctgtttgagttggaaaatggacgcaggcgtctgttagctagcgccggcgagctccagaagggtaacgagctggcacttcctacgcagttcatgaagtttctgtacttggcttcccggtataacgaatcaaaagggaagccagaggaaattgagaaaaagcaagagttcgttaatcagcacgtgagctactttgacgatatcctccagctgattaacgacttcagtaaaagagtcatcctagccgatgcaaatctggaaaagataaacaaactttatcaagacaataaggagaacatctctgtggatgaactcgccaataacattatcaatctgtttaccttcacatccttgggcgctccggcggcctttaagttcttcgacaaaattgttgataggaagcgctacactagcaccaaagaggtgttaaactcgacactgatccatcagtcaataactggactctacgaaacccgaattgacctgggcaaacttggggaggattga

SEQ ID NO: 3133 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctataatcacagatgactataaagtccctgccaagaaaatgagagttctcggtaacactgataaggagtacattaaaaagaatcttatcggcgctctgttgttcgacgggggaaacacggcagccgataggcggttaaagcgcaccgcgcgacgtagatatacaaggcggcgcaataggattctgtacctacaggaaatctttgctgaggaaatgtcaaaagtggacgatagtttctttcacagactcgaggacagcttcctggtagaagaggataagcggggctccaaatatccaatatttgccactatgcaagaggaaaagtactatcatgagaaattcccgaccatctaccaccttcgcaaggaactggcagacaagaaagagaaggccgatttgcgactcatttacctggctctggcacatatcattaaatttagaggtcacttcctcatcgaggacgataggtttgacgtgcggaacacagacatacagaagcagtatcaggccttcttagaaatttttgataccactttcgagaataacgacctgctttctcaaaatgtcgatgtggaagctatcttgacagacaaaatttcgaagtcagccaaaaaggatcgtatcctggcgcgctaccccaaccagaaaagcaccgggatctttgcagagttcctaaaactcattgttggaaatcaggccgacttcaagaaacattttaacctggaagataagacgcctcttcagttcgctaaagacagttatgatgaggacctggagaatttgctcggccaaataggcgatgaatttgccgacctgttctccgcagctaagaagttatacgactctgtgctgctcagcgggatccttactgtcaccgatctgtccacaaaagccccattgtcagcgagtatgattcagagatatgacgagcacagggaagatctaaagcagctgaaacagtttgtgaaggccagcctccccgagaaataccaagaaatcttcgcagactcttccaaggatggatatgctggttacatagagggcaagactaaccaggaggccttttacaaatatctgtcaaagctgctgaccaaacaggaagggagcgagtacttgctcgaaaagattaaaaatgaggacttcctgcggaagcaacgaacatttgataacggaagtatccctcaccaggtacatttaaccgaactgcgcgctatcattagaaggcagtctgagtattacccactactcaaggagaacctggaccggatcgaaaagattcttacgttccgcataccctattacgttggccctttggccagagagaagtccgattttgcatggatgactaggaaaacagacgatagcatccgtccatggaatttcgaagacctggtggataaggagaaatcggccgaggcttttattcaccggatgaccaacaatgacctctatctgccggaagagaaggtccttcccaaacattctctgatctacgaaaagttcactgtgtacaacgagttgacaaaggtgcgattcctcgcggaaggttttaaagacttccagtttctgaatagaaagcaaaaagagaccatcttcaactccttatttaaggagaaaaggaaggtcacggaaaaggatattatatcattcctgaataaagttgacgggtatgagggaatcgcaattaagggcatcgaaaaacagtttaacgccagtctaagcacctaccacgatctcaagaaaattctgggcaaggacttccttgataatacagacaacgagttgatcctggaagatatagtgcagactctcaccctgtttgaggaccgcgagatgatccggaagagattagatatttataaagacttctttacagaatcccagctgaagaaactttacaggcgccactatactgggtggggacgattgtctgctaagctcatcaatggtattcggaacaaagagaatcaaaagaccatcctggattacctaatagacgatggcagcgccaaccgtaatttcatgcagctgattaaggacgcagggctctcatttaaacctatcattgacaaggccagaacaggaagtcattccgataacctgaaagaagtagtgggcgagcttgctggtagcccagccatcaagaaagggatattgcagtctctgaagatcgtcgacgaattagtgaaagttatgggctatgagcccgagcagattgtggtcgaaatggcaagggagaaccaaaccactgcgaagggactctcacgcagtcggcagagactgacgacacttagggaaagcctggctaatttgaagtccaacatcctcgaggagaaaaagcctaaatacgtgaaggatcaggtagaaaatcaccatctgtctgacgatcgactattcctgtactatctccagaacggcaaagacatgtacaccgatgacgagctggatattgacaatctttcgcaatatgatatcgaccacataattccacaggccttcatcaaggacgatagcatcgacaaccgcgttttggtgtcctcagcaaagaatcgggggaaaagtgatgacgtcccctctgtggaaattgtcaaggattgcaaagtgttttggaagaaactgttagacgccaagctcatgagccagagaaagtacgataacctgactaaagctgagaggggaggtcttacctccgacgataaggcccgtttcatccaacgccagctggttgaaacacggcagattaccaaacatgtggcaagaatactagacgagaggtttaataacgagctcgattcaaagggccgacggatccgcaaagtaaagattgtcactcttaagagcaatttggtgtctaacttcagaaaagaatttgggttctataagatcagggaggttaataactaccaccacgctcatgacgcctatctgaatgcggtggtcgccaaagctattttaacaaagtacccgcagctcgaacctgagtttgtgtacggagattatcccaaatacaactcctataagacgcggaagagtgcaaccgaaaaactgttcttttacagcaacatcatgaatttctttaagactaaagtaacacttgccgacggcaccgtggttgtcaaggacgatatagaggtgaacaatgacacaggtgagatcgtgtgggataaaaagaaacacttcgctactgtccgaaaggttctgtcttatccacaagtgaacattgtgaagaaaaccgaaatccagaccgggggcttctccaaggagtcaattttggcccatggaaatagtgacaaactcatccctagaaagacgaaagatatatacctggaccccaagaagtatggcgggtttgatagcccaattgtagcatactcggtcctagtggttgcggacatcaaaaagggaaaagcccagaagctgaaaacagtgactgaacttctcggtatcaccattatggagcgctccaggttcgaaaagaacccctctgcttttctggagagcaagggctacttggatatacgtgacgataaactgatgatcttacctaagtattcactcttcgagctggaaaatgggcggagaaggcttctggccagtgcaggagagttgcagaaaggcaacgaactcgctctgccaacacaatttatgaagttcctatacctggcctcccgctataatgagcttaaaggtaagccggaggaaattgagcagaagcaggaatttgtcgtgcagcacgtttcttacttcgacgatatcctccaaattatcaacgactttagcaatcgagtgatactggcagacgccaacttggagaaaatcaataagttatatcaggataacaaagaaaatattcccgtagacgagctggctaacaacatcattaatctcttcacttttacctccctgggggcgcctgccgcattcaagtttttcgataaaatcgtcgacagaaagcggtacacgtcaacaaaagaggtgcttaacagcaccctgatacaccagagtattactggcttgtatgaaacaaggatcgatctaggaaagctgggcgaggactga

SEQ ID NO: 3134 - RNA, 4113 nt, synthetic construct
  misc_feature 1..4113: note = Cas9 variant
  source 1..4113: mol_type = other RNA
atgaagaaaccctacagcatcggcctggacattgggaccaactccgtgggatgggccgtcgttacagatgactataaggtgcctgctaaaaagatgagagtattcggtgatactgacaggtctcacataaagaagaatctccttggcacgctgttgtttgatgacgggaacaccgcagagtcacggcgcttaaagcgaacagcccgtagaaggtacactcggcgcagaaataggatcctgtatctacaggaaattttcaccgagagtatgaacgaaatcgatgagagctttttccatcggctcgacgattcctttctggtgccagaagacaaacgcggatctaagtacccgattttcgcgacacttcaagaggagaaagaatatcacaagcagtttcccaccatctaccatctgcgaaaacagttggctgattcgaaggagaagtcagacgtcagactcatatatctggccctggcacacatgatcaaatacaggggccatttcctctacgaagagacttttgatattaagaataacgacatccagaaaattttcaatgagtttatcaacatatatgacaatacattcgaaggtagcagtttatccgggcaaaacgcccaggtggaggctatttttaccgataagatctctaaaagcgcaaagcgggaacgtgttctgaaacttttccctgacgagaagtccacgggattgttctcagaatttctgaagctaattgtgggcaatcaggccgatttcaaaaagcactttgacctcgaggagaaagctccactgcagttcagtaaggatacttacgacgaagaacttgaaaacctgttgggccaaatcggggatgactttgccgatctcttcctgatcgcgaaaaagttatatgacgcaattctgctcagcggaatacttaccgtcacagatccctctactaaggcccctctgtccgcttcaatgatcgagcgctacgaaaatcaccagaaagacttggccgcactaaagcagtttattaaaaacaatctgccagagaagtatgtggaggtattcagcgaccagagtaaagatggttacgctggctatatcgacgggaagaccacacaagaagccttttacaagtacattaaaaacctcctgtctaagttcgagggagcggattattttcttgacaaaatagaaagagaggatttcctgaggaagcagcggacctttgacaacggctccatcccccatcagatccacttgcaagaaatgaatgccattctccgacgccagggtgagcattaccctttcctgaaagagaacagagaaaagatcgagaagattttaacgttcaggataccatattacgttgggccgctggcacgggataatcgcgactttagctggctaactagaaactcggatgaacccatcaggccttggaatttcgaggaggtggtcgacaaagctcgttctgccgaagattttattcaccggatgacaaactatgacctctacctgccagaggaaaaggtgcttcccaaacactccttgctgtatgagaccttcgctgtgtacaatgaactcactaaggtcaaatttatcgccgagggactgcgagattaccagttccttgactcaggccagaagaaacaaatcgttaaccagctgtttaaggagaagagaaaagtgacagaaaaggacattatacattatttgcacaatgtagatggctacgacgggatcgagctcaaaggaattgaaaagcagttcaacgcaaatctgagtacctatcatgatttactgaaaatcacgaaggacaaggagtttatggatgaccctaaaaacgaagagattctagagaatatcgtgcacaccctcacaatattcgaagatagggagatgatcaagcagcgcctggcccaatacgacactctttttgatgaaaaagtcattaaggctttgacccggagacattatacaggttggggcaaactgagcgcgaagctcatcaacgggattagggacaagcagtccggaaaaactatcctggattacttaatagacgatgacaagattaatcgcaacttcatgcagctgatcaacgacgatggcctttcttttaaagagattatccagaaggcacaagtggttggtaaaaccgacgatgtgaagcaggtcgtgcaggaattgccagggagccccgccataaagaaaggcatcctccagtcaattaagatcgtagacgagctggttaaagtgatgggatatgctctagagagtattgtcatcgaaatggcccgagagaatcaaacaaccgcacggggcaagaaaaactcccagcagcgttacaagagaatagaagatgccctgaaaaatctcgctccggggctggacagcaacattcttaaggagaatcctactgataacatccaattgaagaatgacaggctgttcttatactatctccagaacggaaaagatatgtacacgggtaagcccctggacatcaatcagctttcttcatatgatattgaccacatcattccacaggccttcataaaagacgatagtatcgacaaccgcgtgctgacaagctccaaggataatcggggcaaatctgacaacgtcccttcgttggaggtggttcaaaagagaaaggcattttggcagcagctcctggatagcaaactaatttccgaaaggaagttcaataacctgaccaaagcggagcgagggggactcgacgaacgcgataaggtgggctttatccggagacagctggtagagactcaacagattaccaaaaatgtcgctcagatccttgacgccaggttcaacacagaagtgaaggagaagaaccagaaaatacgtaccgttaagatcattactttgaaatcaaatctggtgagtaactttcgcaaggagttcggtttatacaaagtccgggaaatcaataactatcaccatgcacacgatgcctacctcaatgctgtggtagccaaggcaattctgaagaaatatcccaaacttgagccagaatttgtgtacggggactaccaaaaatatgatctgaagaaatacatctctagattcaagcccagcaaggagatagaaaaagctacagagaagtactttttctattccaacctactcaactttttcaaagaggaagttctgtatgccgacggcacgattaggaagcgagagaatatcgaatactcaaaagataccggagagatcgcgtgggacaaggaaaaagacttcgccactattaagaaggtcttgagctatcctcaggtgaatatagtgaaaaagcgggaggtccagacaggcgggttttctaaagagtccatcctgccaaagggaaacagtgataaattaattccgcgcaagaccaaggacatcctctgggatacaactaaatacggtggcttcgacagccccgttattgcttactctatcctgcttatagcagatatcgaaaaggggaaagccaagaaactgaagaccgtgaagacgttggtgggaattaccatcatggagaaagctgcctttgaagagaatcctattacattcctcgagaacaagggctatcataatgtaagaaaagaaaacatcctgtgcctaccaaagtactccctgtttgagcttgaaaatggtaggcggcgactcctggcatcagcgaaagagttgcaaaaggggaacgaaatagtcctgcccgtgtgtttaactaccctcctgtatcacagtaagaaccttcacaaactggacgagcctgagcatttggaatacattcagaagcacagaaatgagttcaaagatctcctgaacctagttagcgaattttcgcagaagtatatcctggccgaggctaatcttgagaaaatcaaggacctctacgccgataacgagcaggcagacattgagatcctggctaattccttcataaacttgttaacatttactgccctgggcgcaccagccgctttcaaatttttcggaaaggatgtggaccgcaagaggtataccacggtctctgaaattctcaatgcgacactgatccatcaaagcattaccggcctttacgagactcgtatcgatctgtcaaaattgggggaagagtga

SEQ ID NO: 3135 - RNA, 4113 nt, synthetic construct
  misc_feature 1..4113: note = Cas9 variant
  source 1..4113: mol_type = other RNA
atgaagaaaccctacagcatcggcctggacattgggaccaactccgtgggatgggccgtcataacagatgactataaggttcctgctaaaaagatgaaagtgctcggtaatactgataagaactacatcaagaaaaatcttctgggcgcattgttattcgactctgggaacacggccgaggatagaaggctgaagcggaccgcgcgccgacgttatacaagaaggcggaatcgcctactctacctgcaggacattttctcagatgaaatgaacaaagtagacgagagtttctttcacagacttgaagatagcttcctggtgtccgaggacaagaggggagatcatcacccaatctttggcaatgtcgtggacgaagttaaatatcatgagcaattcccgactatttaccacttgcggaagtatctcgctgatacccccgagaaggccgacctgcgcctggtgtacctcgcattagcccatatgatcaaatttcgaggtcacttcctgatagacgatcctaaacttgacgtcaaaaacacagattctcaggaattgttttcgcagttcctgaccgcttacgacgtgactcaggaggattcacacctagcagacgtaaagatcaatattagcgatatcattacagaaaagatgaacaagagtagaaaagttgaggccctcctgtttcatttcccatcccaaaagaagaatagctttttcgggaaccttgtgtctctggtcttcggattgctccccaattttaaaaccaacttcaatctggctgaggacgccaagttacagctgtccaaagattcatatgacgaagatctcgagaaccttctgggccagatcggcgacgaatacacggacgtgtttgtggcggcaaggaagttgtatgatagtatactactgagcgggattctcactgtcaacgacctgtctaccaaagccatcctttccgcttcaatggttcggcgttacgaggaacacaataaggatctggccaagttgaaagcattcgtgaaggctaactttacacatgacgtattcaaagaggtgtttagcgatgccagtaagaatggatatgcgggttacattgagggcaaaacttctcaggaagacttctataagtacgtcaagaacctcatcgggaaagtggatggatccgccgactttatcgagaagattgatcgcgaagacttcctgagaaaacaaaggacctttgataatggcagcatacctcaccaggttcacttagcagagatgaaggctatcctgcggcgacagggtgaatactatccattcctaaaagagcatgccgagaagattcagcaaatcctcacatttcgcataccctactatgtggggcctctggacagacacggacattcggatttcgcttgggcctctttcaactccgaagagaaggtcaccccatggaattttgaagagattatcgacaaaaacaagtcagcacaggccttcatcgaaaggatgacgaatcaggacctttacttgccgaacgagaaagtgctgcccaagcacagtcctctctatgagaaatacactgtatataatgaactgacaaagattaaatacgttaccgagactggcacagctaagtttttcgatgcgaaccttaagcaagaaatctttgacggcctgttcaaaaaggagcggaaagtgaccaagcgcaaattgctcacgtttctggagaagaatttcgatgaatttagaattgtcgacatacaggggttagataaggagaccgaaacattcaacgcaagctacggaatctatcaggacctgctaaaaattatcaaggataaagcctttatggacgattccgagaatgctgacatcctcgaagatattgtgctgactcttaccttgttcgaggacagggagatgataaagcagcgtctggccaaatacgcagatctctttgacaagaaggtcatcgacaacctggcccggcgaagatatacaggttggggcaggttatctgctaaactgcttaacgggattcgcgataagcggagcagaaaaactatcatggactacttggtggatgacggaaggtcaaatcgcaacctcatgcaactgattaccgatgacaatctaacattcaaggatgaaatcgccaaagcacagtatagtgacaactccgatgacctgcatcaggttgtgcaggatctcgcgggcagcccagctataaagaagggtatcctgcaatctgtaaaaattgtcgacgagcttgtgaaggttatggggtacgaacccgagcagatcgtggtcgaaatggcccgagagaatcagaccactgcaaaaggccggcgtaactcacagcaaagatataagaggttggaggaagccattaaaaatctggaccgcgatttaaactacaagatcctcaaagagcaccctacggacaatcaggctctgcagaacgatcggcttttcctgtactatttgcagaatggaagagacatgtacacaggcgaaagtctcgatataaacaggctgagcgactatgatattgaccacatcattccacaagcctttatcaaggataattccatagacaaccgagtgctagtatcttcggcaaagaatcgcgggaaaagcgatgacgtgccctccgaggatgttgtcaaccggatgagaccgttctggaacaagctgctcaattgcggactgatctcacagaggaaatacagtaaccttaccaagaaagaattgactcctaatgacaaggctggttttattaagcgtcagctggtggagacccgccaaatcacaaaacatgtggcccggattttagacgagcacttcaacaaggaatttgatgaggacaaaaagagaatcaggaaagtcaaggttgtgaccctcaagtctaatctggtgagcaacttccgaaaagaatttgagctttataaggtacgggagataaatgattaccatcacgcgcacgacgcctatctgaacgctgtcgtggcaaaagccctactcatgaagtaccccaaactggaaccagagttcgtttacggcgaatatcctaagtacaattcctatcgcgagagaaagactgctacacagaggatgtttttctactcaaacattatgaatatgtttaaaagcaaggtgaaattggccgatgaacggatcatcgagcgacccatgattgaggtcaacgacgaaacgggggagatcgcatgggataagaccaaacatattgcgactgtgaagaaggttctgtcttatccacagataaatatcgtgaaaaaggtagaggaacagacaggaggcttaaccaacgaaacaatttaccccagaggttccttcgacaaactcctgaatcgcaagaacactcttgaggccagtaaatatgggggcttcggaagccctaccgtcgcttactgtgtgctggtggtcgccgattctaagaacgagaatggcaaagttaagaagttgaaactcgggtccgaactgctaggaatcacgattctggagaagaacgactttgaaaataactcacttgatttcctcagtaggaaaggttaccaaggcgtgcaggagaagaaaatcataaagctgccaaagtatagcttgtttgaatttcaggacgggtcgcgtcggatgctgtcctctgtaatggcaaatgataacaaaagaggagacttacagaaggctaatgagatgatcctcccggcctacctggtgaaacttctgtatcacgcaaagcatattaacagcgtcggcgagcccgcccacaaaaattacatcaacgaacattgctcagagtttcaagacttgctcaattatattaggcagttcgctgataagtttgtggacgttgataagaacctgagtaaaatccgctccctatctaagagcatggcggaatactccgtgtcagagatatgtagcagtttcgtcaatctgcttaccctcacagccctgggtgctcctgcagactttaaattctttgggactaccattccacgaaagagatatggctctccccagtccatcttgagcgccacattaatccaccagtcgattactggactgtacgagacccggatagatctctcaaaactgggcgaagactga

SEQ ID NO: 3136 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctataatcacagatgactataaagtccctgccaagaaaatgagagttctcggtaacactgataaggagtacattaaaaagaatcttatcggcgctctgttgttcgacgggggaaacacggcagccgataggcggttaaagcgcaccgcgcgacgtagatatacaaggcggcgcaataggattctgtacctacaggaaatctttgctgaggaaatgtcaaaagtggacgatagtttctttcacagactcgaggacagcttcctggtagaagaggataagcggggctccaaatatccaatatttgccactatgcaagaggaaaagtactatcatgagaaattcccgaccatctaccaccttcgcaaggaactggcagacaagaaagagaaggccgatttgcgactcatttacctggctctggcacatatcattaaatttagaggtcacttcctcatcgaggacgataggtttgacgtgcggaacacagacatacagaagcagtatcaggccttcttagaaatttttgataccactttcgagaataacgacctgctttctcaaaatgtcgatgtggaagctatcttgacagacaaaatttcgaagtcagccaaaaaggatcgtatcctggcgcgctaccccaaccagaaaagcaccgggatctttgcagagttcctaaaactcattgttggaaatcaggccgacttcaagaaacattttaacctggaagataagacgcctcttcagttcgctaaagacagttatgatgaggacctggagaatttgctcggccaaataggcgatgaatttgccgacctgttctccgcagctaagaagttatacgactctgtgctgctcagcgggatccttactgtcaccgatctgtccacaaaagccccattgtcagcgagtatgattcagagatatgacgagcacagggaagatctaaagcagctgaaacagtttgtgaaggccagcctccccgagaaataccaagaaatcttcgcagactcttccaaggatggatatgctggttacatagagggcaagactaaccaggaggccttttacaaatatctgtcaaagttgctgaccaaacaggaagggagcgagtacttgctcgaaaagattaaaaatgaggacttcctgcggaagcaacgaacatttgataacggaagtatccctcaccaggtacatttaaccgaactgcgcgctatcattagaaggcagtctgagtattacccattcctaaaggagaacctcgaccggatcgaaaagattctgacgtttcgcataccctattacgttggccctcttgccagagagaagtccgatttcgcatggatgactaggaaaacagacgatagcatccgtccatggaattttgaagacttggtggataaggagaaatcggccgaggctttcattcaccggatgaccaacaatgacctgtatctcccggaagagaaggtcctgcccaaacattctcttatctacgaaaagttcactgtgtacaacgagctgacaaaggtgcgatttttggcggaaggtttcaaagactttcagttcctcaatagaaagcaaaaagagaccatctttaactccctgttcaaggagaaaaggaaggtcacggaaaaggatattatatcatttttaaataaagttgacgggtatgagggaatcgcaattaagggcatcgaaaaacagttcaacgccagtctgagcacctaccacgatctaaagaaaattctcggcaaggactttctggataatacagacaacgagcttatcttggaagatatagtgcagactctgaccctcttcgaggaccgcgagatgatccggaagagactggatatttataaagactttttcacagaatcccagttaaagaaactgtacaggcgccactatactgggtggggacgactttctgctaagttgatcaatggtattcggaacaaagagaatcaaaagaccatcctcgattacctgatagacgatggcagcgccaaccgtaattttatgcagctaattaaggacgcagggctgtcattcaaacctatcattgacaaggccagaacaggaagtcattccgataacctcaaagaagtagtgggcgagctggctggtagcccagccatcaagaaagggatacttcagtctttgaagatcgtcgacgaactggtgaaagttatgggctatgagcccgagcagattgtggtcgaaatggcaagggagaaccaaaccactgcgaagggattatcacgcctccggcagagactgacgacacttagggaaagtctggctaatcttaagagcaacatcctcgaggagaaaaagcctaaatacgtgaaggatcaggtagaaaatcaccatctgtccgacgatcgactattcctgtactatctccagaacggcaaagacatgtacaccgatgacgagctggatattgacaatctttctcaatatgatatcgaccacataattccacaggcctttatcaaggacgattcgatcgacaaccgcgttttggtgagctccgcaaagaatcgggggaaatcagatgacgtccccagtgtggaaattgtcaaggattgcaaagtgttctggaagaaactgttagacgccaagctcatgtctcagagaaagtacgataacctgactaaagctgagaggggaggtcttaccagcgacgataaggcccgttttatccaacgccagctggttgaaacacggcagattaccaaacatgtggcaagaatactagacgagaggttcaataacgagctcgattccaagggccgacggatccgcaaagtaaagattgtcactctgaagtcaaatttggtgagcaactttagaaaagagttcgggttttataagatcagggaagttaataactaccaccacgctcatgacgcctatctgaatgcggtggtcgccaaagctattttaacaaagtacccgcagctcgaacctgagttcgtgtacggagattatcccaaatacaactcttataagacgcggaagtccgcaaccgaaaaactgtttttctacagtaacatcatgaatttcttcaagactaaagtaacacttgccgacggcaccgtggttgtcaaggacgatatagaggtgaacaatgacacaggtgagatcgtgtgggataaaaagaaacacttcgctactgtccgaaaggttctgagctatccacaagtgaacattgtgaagaaaaccgaaatccagaccgggggcttttctaaggagtccattttggcccatggaaattcagacaaactcatccctagaaagacgaaagatatatacctggaccccaagaagtatggcgggttcgatagtccaattgtagcatacagcgtcctagtggttgcggacatcaaaaagggaaaagcccagaagctgaaaacagtgactgaacttctcggtatcaccattatggagcgctcgaggtttgaaaagaacccctccgctttcctggagtctaagggctacttgaatatacgtgatgacaaactgatgatcttacctaagtatagcctctttgagctggaaaacgggcggagaaggcttctggcctcagcagatgagttgcagaaaggaaatgaactcgctctgccaacacaattcatgaagtttctatacctggccagtcgctataacgagcttaaaggcaagccggaggaaattgagcagaagcaggaatttgtcgtgcagcacgtttcctactttgacgatatcctccaaattatcaatgacttctctaaccgagtgatactggcagacgccaatttggagaaaatcaacaagttatatcaggataataaagaaaacattcccgtagacgagctggctaacaatatcattaacctctttactttcaccagcctgggtgcgcctgccgcatttaagttcttcgataaaatcgtcgacagaaagcggtacacgtccacaaaagaggtgcttaattcaaccctgatacaccagagcattactgggttgtatgaaacaaggatcgatctaggcaagctgggagaggactga

SEQ ID NO: 3137 - RNA, 4113 nt, synthetic construct
  misc_feature 1..4113: note = Cas9 variant
  source 1..4113: mol_type = other RNA
atggagaagaacaaagaatacgtgatcggcctggacattgggaccggaagcgtcggttggtccgccatatctacagataattatcagctcatcagacaaaagggcaaaaaccttattggggttaggctgttcaattcagctgagactgcagaagaacggcgcggataccgaacgacccgtagaaggttgagtcggcgcagatggaggatgagcttactgaacgacatctttcggcccgaactaaatgagattgatgagaacttcctcgcccgcctgaagtattcctgggtgtctcctcttgaccagaaaaatccacagctgaacgaacagggcacaaatgcgtcgttgtacggtgatatcgaggctgaccaagcctttcaccgagcatatccgactatataccatctcagaaagaccctgatggaagataaccagaagcacgacctgagggaggtatatctcgccatccatcacattgtgaaataccgggggcatttcttaacacccgattttgacgctaattcacagaccatcgatattaagggactgttcaaacagcttggcgacgtcagcggcagtatcgagttgcaagcagatcagacttccacagtgatagccgcttttcagtctattctgctagacttcaccaagacgcctactgaaagcgggcgtctcgccggacagctgttttccgaccaaaacaaagataagcaggcgaagaaacaggttgaggaacttttcaagctgttgcgcggtggcaaagggtcactcgcagacatgtttctgttaaccgatctggacaaggtggtcaaaaatcaactcaagttcgcctttgatgacgctgtggatgagaaccttaatctgatcagtaacttgattaacgaggagcagtacgagctactgctcaatatccagaaactgagaggaacaatcattcttaagcagatactgggcgacgatgaaactgtaagcgacgccaaggttaggtcttatgaggaacacgcacaccaattgaaagagctcaaggctcaggtgctgaccaaagataacaaggaaaaattcgaggaggcctaccagttaatccagaagggtgacgcgtcccggattgacgggctgaagaaactaaagacaatcataaatcaagaacatgaggccctccgactggataaatatgaagcagacaaacttttgaaactgattgagctcgatcagctgcttccagtccagcgctcaaagagaaacggagaaatcccccaccagctgcatgagttcgagttgaagaaaatcattgaaaagcaaggcaggtactatccttttctccgggagaccttcgaacgcgacggccaggagtttaataaaatcgggcagctggtgaacttcagaataccatactatgtgggacccttagtcgatcctaggctggctggtatacagagcggcgaccaaacgaatcactggatgactcagaagaaagccgggaagatcacaccatggaactacaccgagctaattgatatcgacaagagtgctgccgaatttatcaaacgtatgactggaacagatacctacctcgttggcgagccgtctctgcacaaggcatcccttatttatcaggactacaatgtgttgcaagaactgaacaatctccggtatgatggtaaacccctgcctgtagacgccaagcaggagatatacagcaacttacaggtgtcgctgaaaaatgctacgaagaacaaaatcaattctttccttatttccgaagggtatttgcaggatggcgaggagctcaccggatttgcgggcaaggaactgaagaacaaactatcaagtttccattactttaagaacatcttcgggccagagcgaatgaatacactgggaactgacaacctcgaaaagattaccgagctgcaaacagtctttgaagacagacacatgcttaagaggcagttgcagaaactgggtttcttagatgacgatgagtgcgagaagctcgcaggcaagcattttactgggtggggaaatctgagcaaaaagctgcttaacacccccgccatcatagaccctgaaatcaatgagaacaaaatttccttgatcgatgctctctataagggccagcgcaatctgtctttctacgtgaacaatatggacgataaataccaattccgggactggattgaaagcgagaaccagtcacagcaggttgaaatcagtctagatgagaagataaagaatctggccggttccccagcaattaaaagagggatcacacaaagcatggccgtgattcaggacatcataagggctaacaatggcatctctcccaagcgcatttatctcgagtttgcccgagaatcacagaacagttaccaaccgaatagccggatcaaacagattgagaagatctatgatcagaacaaaaaggaactgatgaaggtctaccctgacgtgttcaaagatgtacagggagttcttaacaatgtggacgagaacaattccttgtctgagaaggcatttctgtatttcatgcaattaggcaaagacatgtacaccggggaagcgctcgattttgacaagctgtatacttacgatatagaccacattatcccccaggctatgacgaaagataactcgtgggacaataaggtccttgtgacagccatcaaaaaccgtgaaaagagcaatcaggtcctggataacgcaattcaggccaagatgcataatttctggctacaactcaaaaaggtgaacctgttgtcccagagaaaatacgacaccctgatgaagactaatttttcaaaaggagatgaaaagaagttcatcgctaggagtttagttgagacccgccagattattaaaaacgtggccgaactcatcaagtctgagtttgaccacgtagaggcaattccaatccggcaggaactgacaagcgatatgagacaacttatggactataaaaagaataggctggtcaacgactaccaccatgctcacgatgccttgctcattgcgaccgtgggtgagttcatgcagaaacgaggctttatgcaggggatgaatccttcccagaacgtttatcatggatacactcaatatgtgaagaagtggctgtcaatggccaaaaaggctcgcagcgcagaaaaacccgagcggatcttcccactacagtttgtcgtgggctctatgagaatggccgtaagggacggtcaggtggataaggttacacaccccgctacgggggaaatatgttggaccgccgacaacgaggcatacctgcgtaaagtccttggctataagaatatcctcgtgactcgcaaggtgaaaaacgcgggaaagctgtaccaacgggtcacagttaaacctaagggctccggggaggccccagtgaatcaccagaaaagtgatattaacatctacggaggcgtgaccagcgaacaggctgccgagttggtactgattagaatcaaggcaaagaataacgctaaaaatatggtcataaagattccgacagccatcgcaaaccaggtggccaataaaactaccacgtatgacgcttacgttaggtctttaaacatccccaattatgcgggtattatactcgatcaaatccctctggggcagcttgtgttcgacgaacgaacctccttctacctggcctcagcagagattaagcataacgctcggcagttgtgggtcaatcagcacatcaacaatgtgctcactaaaaagaacattaatgatgaggagcgcgacaacatcctgaacctactgacaaatgagaaaaaccttgaaagatttaagctcctggagccagatttgaagagggttaaagccgccaagcaacagtgggctagttgcgacgatcaggaacagatgcaaatattacggatcattatcaataaaatgcatgacgacgcaagcccccagattcctggaaagatcgatccattcaaaaactatctggacaagcagggcaagggttggcgagatctcagaaccaaaaagggcatgaaactgtcggacaatgccgagtttgtgtaccaatcccccacagggctttatcaccgcaagatatctattaacgagctgttgaaacagaagcagctagaatga

SEQ ID NO: 3138 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctataatcacagatgactataaagtccctgccaagaaaatgagagttctcggtaacactgataaggagtacattaaaaagaatcttatcggcgctctgttgttcgacgggggaaacacggcagccgataggcggttaaagcgcaccgcgcgacgtagatatacaaggcggcgcaataggattctgtacctacaggaaatctttgctgaggaaatgtcaaaagtggacgatagtttctttcacagactcgaggacagcttcctggtagaagaggataagcggggctccaaatatccaatatttgccactatgcaagaggaaaagtactatcatgagaaattcccgaccatctaccaccttcgcaaggaactggcagacaagaaagagaaggccgatttgcgactcatttacctggctctggcacatatcattaaatttagaggtcacttcctcatcgaggacgataggtttgacgtgcggaacacagacatacagaagcagtatcaggccttcttagaaatttttgataccactttcgagaataacgacctgctttctcaaaatgtcgatgtggaagctatcttgacagacaaaatttcgaagtcagccaaaaaggatcgtatcctggcgcgctaccccaaccaaaagagcaccgggatctttgcagagttcctaaaactcattgttggaaatcaggccgacttcaagaaacattttaacctggaagataagacgcctcttcagttcgctaaagacagttatgatgaggacctggagaatttgctcggccagataggcgatgaatttgccgacctgttctccgcagctaagaagttatacgactctgtgctgctcagcgggatccttactgtcaccgatctgtccacaaaagccccattgtcagcgagtatgattcagagatatgacgagcacagggaagatctaaagcagctgaaacagtttgtgaaggccagcctccccgagaaataccaagaaatcttcgcagactcttccaaggatggatatgctggttacatagagggcaagactaaccaggaggccttttacaaatatctgtcaaagctgctgaccaaacaggaagggagcgagtacttgctcgaaaagattaaaaatgaggacttcctgcggaagcaacgaacatttgataacggaagtatccctcaccaggtacatttaaccgaactgcgcgctatcattagaaggcagtctgagtattacccattcctaaaggagaacctcgaccggatcgaaaagattctgacgtttcgcataccctattacgttggccctcttgccagagagaagtccgatttcgcatggatgactaggaaaacagacgatagcatccgtccatggaattttgaagacttggtggataaggagaaatcggccgaggctttcattcaccggatgaccaacaatgacctgtatctcccggaagagaaggtcctgcccaaacattctcttatctacgaaaagttcactgtgtacaacgagctgacaaaggtgcgatttttggcggaaggtttcaaagactttcagttcctcaatagaaagcaaaaagagaccatctttaactccctgttcaaggagaaaaggaaggtcacggaaaaggatattatatcatttttaaataaagttgacgggtatgagggaatcgcaattaagggcatcgaaaaacagttcaacgccagtctgagcacctaccacgatctaaagaaaattctcggcaaggactttctggataatacagacaacgagcttatcttggaagatatagtgcagactctgaccctcttcgaggaccgcgagatgatccggaagagactggatatttataaagactttttcacagaatcccagttaaagaaactgtacaggcgccactatactgggtggggacgactttctgctaagttgatcaatggtattcggaacaaagagaatcaaaagaccatcctcgattacctgatagacgatggcagcgccaaccgtaattttatgcagctaattaaggacgcagggctgtcattcaaacctatcattgacaaggccagaacaggaagtcatctcgataacctgaaagaagtagtgggcgagcttgctggttccccagccatcaagaaagggatattgcagagcctgaagatcgtcgacgaattagtgaaagttatgggctatgagcccgagcagattgtggtcgaaatggcaagggagaaccaaaccactgcgaagggactctctcgctcacggcagagactgacgacacttagggaaagtctggctaatcttaagagcaacatcctcgaggagaaaaagcctaaatacgtgaaggatcaggtagaaaatcaccatctgtccgacgatcgactattcctgtactatctccagaacggcaaagacatgtacaccgatgacgagctggatattgacaatctttctcaatatgatatcgaccacataattccacaggcctttatcaaggacgattcgatcgacaaccgcgttttggtgagctccgcaaagaatcgggggaaatcagatgacgtccccagtctggaaattgtgaaggattgcaaagtcttctggaagaaattactcgacgccaagctgatgtctcagagaaagtacgataaccttactaaagctgagaggggaggtctgaccagcgacgataaggcccgttttatccaacgccagctagtggaaacacggcagattaccaaacatgttgcaagaatactcgacgagaggttcaataacgagctggattccaagggccgacggatccgcaaagtgaagattgtaactttgaagtcaaatctggtcagcaactttagaaaagaatttgggttttataagatcagggaggtgaataactaccaccacgctcatgacgcctatttaaatgcggttgtggccaaagctattctcacaaagtacccgcagctggaacctgagttcgtctacggagattatcccaaatacaactcttataagacgcggaagtccgcaaccgaaaaattgtttttctacagtaacatcatgaatttcttcaagactaaagtgacactggccgacggcaccgtagtggttaaggacgatatagaggtcaacaatgacacaggtgagatcgtgtgggataaaaagaaacacttcgctactgtgcgaaaggtcttgagctatccacaagttaacattgtgaagaaaaccgaagtgcagaccgggggcttttctaaggagtccatcctcgcccatggaaattcagacaaactgattcctagaaagacgaaagatatctacctagaccccaagaagtatggcgggttcgatagtccaatagtagcatacagcgtcctggtggttgcggacattaaaaagggaaaagcccagaaacttaaaacagtgactgaactcctgggtatcaccatcatggagcgctcgaggtttgaaaagaacccctccgctttcttggagtctaagggctacctgaatattcgtacagataaattaataatcctccctaagtatagcctgtttgagcttgaaaacgggcggagaaggctgttggcctcagcaggagagctccagaaaggcaatgaactggctctaccaactcaatacatgaagttcctgtatcttgccagtcgctacaacgagctcaaaggtaagccggaggaaattgagcagaagcaggaatttgtcgtgcagcacgtttcctatttcgacgatatcctgcaaattatcaatgacttttctaaccgagtgatattggcagatgccaatttagagaaaatcaacaagctgtaccaggacaataaagaaaacattcccgtagacgagctcgctaacaatatcattaacctgttcacctttacgagccttggggcgcctgccgcattcaagtttttcgataaaatcgtcgacagaaagcggtatacatccaccaaagaggtgcttaattcaactttgatacaccagagcattacaggcctatacgaaaccaggatcgatctgggaaagctcggcgaggggtga

SEQ ID NO: 3139 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctataatcacagatgactataaggtccctgccaagaaaatgagagttctcggtaacactgataaggagtacattaaaaagaatcttatcggcgctctgttgttcgacgggggaaacacggcagccgataggcggttaaagcgcaccgcgcgacgtagatatacaaggcggcgcaataggattctgtacctacaggaaatctttgctgaggaaatgtcaaaagtggacgatagtttctttcacagactcgaggacagcttcctggtagaagaggataagcggggctccaaatatccaatatttgccactcttcaagaggaaaaggactaccatgagaaattctctaccatctatcatctgcgcaaggaattggcagataagaaagagaaggccgacctccgactgatttacatcgctctggcacacattatcaaatttagaggtcacttcctcatagaggatgactcgtttgacgtgaggaacacagatatttcaaagcagtaccaggacttcttagaaatctttaataccactttcgagaacaatgatctgcttagccagaacgtcgacgtggaagccattttgacagataaaatcagtaagtccgctaaaaaggaccggatcctggcccaatatccgaatcagaagtctaccgggatttttgcggagttcctaaaactcatagttggaaaccaggcagatttcaagaaatactttaatctggaagacaagacgccccttcagttcgccaaagatagctatgacgaggatctggagaacttgctcggccaaatcggcgacgaatttgctgacctgttctccgccgcaaagaagttatacgattcagtgctgctcagtgggattcttactgtcatcgacctgagcaccaaagctcctttgtctgcctccatgatacagcgttatgatgagcatcgcgaagacctaaagcagctgaaacagtttgtgaaggcgtcactcccagagaaataccaagaaattttcgccgatagcagtaaggacggatatgcaggttacatcgagggcaagacaaatcaggaggctttttacaaatatctgtctaaacttctgactaagcaggaagattccgagaacttcttggaaaagatcaaaaacgaggactttctcagaaagcaaaggaccttcgataatgggagcattccccaccaggtacacctgacagaattaaaggccatcattcggcgacagtcggagtactatccttttctgaaagagaaccaggaccgcatagaaaagatcctaaccttcaggattccatactatatcggacccctcgctagagagaaatctgattttgcctggatgacgcggaagactgacgattccatccgcccttggaatttcgaagacctggttgacaaagagaagtcagcagaggccttcattcatagaatgacaaacaatgatttttaccttccagaagagaaagtgttgccgaagcacagtctgatatatgaaaagttcaccgtctacaacgagctcactaaagtgaggtacaagaatgaacaaggcgagacatactttttcgacagcaacatcaaacaggagatttttgatggtgtgttcaaggaacatcgtaaagtctccaagaagaaactgcttgactttctggctaaggagtatgaagagttccggatcgttgatgtgattgggttggacaaagaaaataaggcgtttaacgcatctctcggaacctatcacgatctggagaaaatcttagacaaggatttcctggacaatcccgataacgagagcatactagaagacatcgtacagacgctcaccctgtttgaggatcgagaaatgattaagaaaagacttgagaattacaaggacttgttcacagaatcacagctgaaaaagctctataggcgccactacactggctggggccggctgagtgccaaattaatcaacgggattagagacaaggagtcccaaaagaccatcctggattatcttatagacgatggaaggagcaatcgcaactttatgcagttgattaacgacgatggtctctctttcaaatcaatcattagtaaggctcaggccggcagccattccgacaatctgaaagaggtggtcggggaactagcaggatctcctgccatcaagaaaggcatactgcagtcgctcaagatcgtggatgagctggttaaagtgatgggttacgaaccagagcaaattgtcgtggagatggctcgagaaaaccagacaactaatcaggggcggcgtaacagcagacagaggtacaaacttttggacgatggcgtaaagaatctggcctccgacttaaacggaaatatcctcaaggagtatcccaccgataaccaagcactgcagaatgaacgccttttcctgtactatttgcagaacggccgggacatgtacacaggggaggcgctcgacattgatgacctgtcacaatatgatatcgaccacataattcctcaggcttttatcaaggatgacagtatcgataatagagttctagtgtctagcgccaaaaacaggggaaagtccgacgatgtcccatcactggaaattgtgaaagactgcaaggtcttctggaagaaactcctggatgcaaaacttatgagccagcgaaagtacgacaatttgaccaaggccgagcgcggtggcctgacttctgatgacaaagctcggtttatccagagacaattagtggagacgaggcagattacaaagcatgttgcccgtatactcgacgaacgcttcaacaatgagctggattccaaggggcggagaatcaggaaagtgaagattgtaacccttaaaagtaacctggtcagcaactttcgaaaggagttcggattttataaaatccgggaagtgaataactaccaccatgcacacgacgcttacctaaatgccgttgtggcgaaggccattctcactaagtatccccagctggaaccggagttcgtctacggcgattatcctaaatacaactcttataagacccgcaaatccgctacagagaagttgtttttctactcaaatatcatgaactttttcaaaaccaaggtgactctggcagacggtacagtagtggttaaggatgacatagaagtcaataacgatacgggggagatcgtgtgggacaaaaagaaacacttcgccaccgtgagaaaggtcttaagttatccccagaataacattgttaaaaagactgaaatccaaacaggcggatttagcaaagagtcgattctcgctcatggcaattccgataagctgatcccaaggaagaccaaagacatataccttgatcctaagaaatacgggggattcgactctcccattgtggcctatagcgtgctggtagtcgcagatatcaagaaaggtaaggcgcagaagttgaaaacagtgactgaactcctgggcatcaccattatggagcggtcacgatttgagaagaacccaagtgccttcctagaatccaaagggtacctgaatataagagctgacaaacttatcattctccccaagtattctctgtttgagttggaaaacggacgcaggcgtctgttagccagcgcaggcgagctccagaagggtaatgagctggcccttcctacgcagttcatgaagtttctgtacttggcttcccggtataacgaatcaaaagggaagccagaggaaatcgagaaaaagcaagagttcgttaaccagcacgtgagctactttgacgatattctccagctgatcaatgacttcagtaaaagagtcatactagcagatgccaacctggaaaagatcaataaactttatcaagacaacaaggagaatatttctgtggatgaactcgctaacaatatcattaacctgtttaccttcacatccttgggcgcgccggccgcatttaagttcttcgacaaaatcgttgataggaagcgctacactagcaccaaagaggtgttaaattcgacactgatacatcagtcaattactggactctacgaaacccgaatcgacctgggcaaacttggggaggattga

SEQ ID NO: 3140 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctataatcacagatgactataaagtccctgccaagaaaatgagagttctcggtaacactgataaggagtacattaaaaagaatcttatcggcgctctgttgttcgacgggggaaacacggcagccgataggcggttaaagcgcaccgcgcgacgtagatatacaaggcggcgcaataggattctgtacctacaggaaatctttgctgaggaaatgtcaaaagtggacgatagtttctttcacagactcgaggacagcttcctggtagaagaggataagcggggctccaaatatccaatatttgccactcttcaagaggaaaaggactaccatgagaaattctctaccatctatcatctgcgcaaggaattggcagataagaaagagcgagccgacctcagactgatttacatcgctctggcacacattatcaagtttaggggtcacttcctcatagaggatgactcgtttgacgtgcggaacacagatatttcaaaacagtaccaggacttcttagaaatctttaataccactttcgagaacaatgatctgcttagccagaacgtcgacgtggaagccattttgacagataagatcagtaaatccgctaagaaagaccgtatcctggcccaatatccgaatcagaagtctaccgggatttttgcggagttcctaaagctcatagttggaaaccaggcagatttcaaaaagtactttaatctggaagacaaaacgccccttcagttcgccaaggatagctatgacgaggatctggagaacttgctcggccaaatcggcgacgaatttgctgacctgttctccgccgctaaaaagttatacgattcagtgctgctcagtgggattcttactgtcatcgacctgagcaccaaggctcctttgtctgcctccatgatacagcgctatgatgagcatagagaagacctaaaacagctgaagcagtttgtgaaagcgtcactcccagagaagtaccaagaaattttcgccgatagcagtaaagacggatatgcaggttacatcgagggcaagacaaatcaggaggctttttacaagtatctgtctaaacttctgactaagcaggaagattccgagaacttcttggaaaagatcaagaacgaggactttctcaggaaacaacggaccttcgataatgggagcattccccaccaggtacacctgacagaattaaaggccatcattcgacgccagtcggagtactatccttttctgaaggagaaccaggacagaatagagaaaatcctaaccttcaggattccatactatatcggacccctcgctcgggaaaagtctgattttgcctggatgacgcgcaaaactgacgattccatcagaccttggaatttcgaagacctggttgacaaggagaaatcagcagaggccttcattcataggatgacaaacaatgatttttaccttccagaagagaaggtgttgccgaaacacagtctgatatatgaaaagttcaccgtctacaacgagctcactaaggtgcgttacaaaaatgaacaaggcgagacatatttcttcgacagcaacatcaagcaggagatttttgatggtgtgttcaaagaacatcggaaggtctccaaaaagaagctgcttgactttctggctaaagagtacgaagagttccgaatcgttgatgtgattgggttggacaaggaaaataaagcgtttaacgcatctctcggaacctatcacgatctggagaagatcttagacaaagatttcctggacaatcccgataacgagagcatactagaagacatcgtacagacgctcaccctgtttgaggatagagaaatgattaagaagaggcttgagaattacaaagacttgttcacagaatcacagctgaagaaactctatcgccggcactacactggctggggcagactgagtgccaagttaatcaacgggattagggacaaagagtcccaaaagaccatcctggattatcttatagacgatggacgcagcaatcgaaactttatgcagttgattaacgacgatggtctctctttcaagtcaatcattagtaaagctcaggccggcagccattccgacaatctgaaggaggtggtcggggaactagcaggatctcctgccatcaaaaagggcatactgcagtcgctcaaaatcgtggatgagctggttaaggtgatgggttacgaaccagagcaaattgtcgtggagatggctcgggaaaaccagacaactaatcaggggcgtagaaacagcaggcagcgctacaaacttttggacgatggcgtaaagaatctggcctccgacttaaacggaaatatcctcaaggagtatcccaccgataaccaagcactgcagaatgaacggcttttcctgtactatttgcagaacggcagagacatgtacacaggggaggcgctcgacattgatgacctgtcacaatatgatatcgaccacataattcctcaggcttttatcaaagatgacagtatcgataatagggttctagtgtctagcgccaagaaccgaggaaaatccgacgatgtcccatcactggaaattgtgaaggactgcaaagtcttctggaagaagctcctggatgcaaaacttatgagccagcgcaagtacgacaatttgaccaaagccgagcggggtggcctgacttctgatgacaaggctagatttatccagaggcaattagtggagacgcgtcagattacaaaacatgttgcccgcatactcgacgaacggttcaacaatgagctggattccaaggggagaaggatccgaaaggtgaaaattgtaacccttaagagtaacctggtcagcaactttcggaaagagttcggattttataagatccgcgaagtgaataactaccaccatgcacacgacgcttacctaaatgccgttgtggcgaaagccattctcactaagtatccccagctggaaccggagttcgtctacggcgattatcctaagtacaactcttataaaaccagaaagtccgctacagagaaattgtttttctactcaaatatcatgaactttttcaagaccaaagtgactctggcagacggtacagtagtggttaaggatgacatagaagtcaataacgatacgggggagatcgtgtgggacaagaaaaagcacttcgccaccgtgaggaaagtcttaagttatccccagaataacattgttaagaaaactgaaatccaaacaggcggatttagcaaggagtcgattctcgctcatggcaattccgataaactgatcccacggaagaccaaggacatataccttgatcctaaaaagtacgggggattcgactctcccattgtggcctatagcgtgctggtagtcgcagatatcaaaaagggtaaagcgcagaagttgaagacagtgactgaactcctgggcatcaccattatggagcgatcaagatttgagaaaaacccaagtgccttcctagaatccaaggggtacctgaatatacgcgctgacaaacttatcattctccccaagtattctctgtttgagttggaaaacggaaggcgtcggctgttagccagcgcaggcgagctccagaaaggtaatgagctggcacttcctacgcagttcatgaagtttctgtacttggcctccagatataacgaatcaaaggggaaaccagaggaaatcgagaagaaacaagaatttgttaaccagcacgtgagctactttgacgatattctccagctgatcaatgacttcagtaagagggtcatactagcagatgccaacctggagaaaatcaataaactttatcaagacaacaaggagaatatttctgtggatgaactcgctaacaatatcattaacctgtttaccttcacatccttgggcgcgccggccgcatttaaattcttcgacaagatcgttgatcgcaaacgatacactagcaccaaggaggtgttaaattcgacactgatacatcagtcaattactggactctacgaaaccagaatcgacctgggcaaacttggggaggattga

SEQ ID NO: 3141 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctataatcacagatgactataaagtccctgccaagaaaatgagagttctcggtaacactgataaggagtacattaaaaagaatcttatcggcgctctgttgttcgacgggggaaacacggcatcagataggcggttaaagcgcaccgcccgacgtagatatacaaggcggcgcaataggattctgtacctacaggaaatctttgcggaggaaatgagtaaagtggacgatagcttctttcacagactcgaggactccttcctggtagaagatgacaagcggggctctaaatatccaatatttgctactatgcaagaggagaaggattaccatgaaaaattcccgaccatctatcaccttcgcaaggagctggccgacaagaaagaaaaggcagatttgcgactcttttacctggccctggctcatattatcaaattcagaggtcactttctcattgaggacgactcgttcgatgtgaggaacacagacatccagcggcagtaccaggcatttttagagatattcgataccacttttgaaaataaccatctgctttcacaaaatattgacgtcgaggggatcttgacagataagattagcaaaagtgccaagaaagaccgtatcctggctcagtatcccaaccagaagtccaccggaatcttcgccgagttcctaaagctcattgtgggcaatcaggcggattttaaaaagcacttcaacctggaagacaaaacgcctcttcaatttgcaaaggattcttacgacgaagatctggagaatttgctcggccagataggggacgagttcgccgacctgtttagcgttgctaaaaagttatatgattccgtgctgctctcaggaatccttactgtcaccgacctgagtacaaaggccccattgagcgcatctatgattcagcgctacgatgaacacagagaggacctaaaacagctgaagcaattcgtgaaagctagcctccccgaaaagtatcaggagatctttactgattcaagcaaagacggttacgccggctatatagaagggaagaccaaccagggagcgttctacaagtacctgagtaaacttctgacaaagcaagagggctctgagtattttcttgaaaagattaagaatgaggatttcctcaggaaacagcggacctttgacaacggttccatccctcatcaggtacacctgacggaattaaaggccatcattcgacgccagagcgagtactatccattcctgaaggaaaacctagatagaatcgagaaaattctcacttttaggataccctactatgttgggcctctggcacgggagaagtcggacttcgcttggatgacacgcaaaaccgatgactctatcagaccatggaatttcgaggaacttgtggataaggaagcctccgctgaggcctttattcataggatgactaacaatgacttgtacctgccggaggaaaaagtcctccccaagcactcactgatctatgagaaattcacagtgtacaacgaacttaccaaggtgcgttacaagaatgagcaaggagaaacgtactttttcgacagtaacatcaaacaggagatttttgatggcgtcttcaaggagcaccggaaagttagcaagaaaaagctgttggactttctcgcaaaggaatatgaggagttccgaatagtggatgtaatcggcctggacaaagaaaataaggcctttaacgcttccttagggacctatcatgatctgaaaaagattctagacaaagatttcctcgacaatcctgataacgaatctatcctggaggacattgtgcagacacttactttgtttgaggatagagaaatgatcaagaagaggctggagaattacaaagacctcttcaccgaaagccagctgaagaaattatatcgccggcactacacaggatggggtagactgtcagcgaaacttataaacggcatcagggataaagagagtcaaaagactattttggactatctcatcgacgatgggaagtccaatcgcaactttatgcagctgattcatgacgatggactatccttcaaatctatcatatcaaaggcacaggccggcagtcacagcgacaatctgaaagaagtcgtgggtgagctcgctgggtccccagccattaagaaaggcatcctgcagtctcttaagattgttgatgagttggtgaaagtcatgggatacgaacccgagcaaatcgtggtagaaatggcacgagagaaccagaccacaaaccagggccggcgtaattcgagacagaggtacaagctgttagacgatggggttaagaacctcgccagcgacctgaatggaaacatacttaaagagtatcctaccgataatcaagctctgcagaacgaacgcttgttcctctactatctgcagaatggtcgggacatgtacactggcaaggccctagatatcgacaacctgtcccaatatgacattgatcatatcattccacaggcatttatcaaagacgattcaatagacaatagagtgctcgtcagttctgcgaagaacagggggaaaagcgatgacgtgccctccctggagattgtcaaggattgcaaggtgttctggaaaaagttgttggacgctaaactgatgtcacagcgaaagtacgataatttaacgaaagccgaacgcggaggcctcacaagcgacgataaggcacggtttatccagagacaactggttgagaccaggcagatcactaagcacgtggcccgtattcttgacgaacgcttcaacaatgagctggattctaaaggtcggagaatcaggaaggtaaaaattgtcaccctaaagtccaacctcgtgagtaattttcgaaaagagttcgggttttataagatacgggaagttaacaactaccaccatgctcacgacgcctacctgaatgcagtggtcgctaaggccatcttgacaaaatatccgcagctggagcctgagttcgtgtacggcgactatcccaagtacaacagctataaaacccgcaagtctgcgactgaaaaattatttttctactccaatattatgaactttttcaagacaaaggtaacgctcgccgatggaaccgtggttgtcaaagacgatatcgaagtgaataacgacactggcgagattgtgtgggataagaaaaagcatttcgctacagtcagaaaagttctgtcatatccacaggtgaatatcgtgaagaaaaccgagatacaaacagggggatttagtaaggaaagcatccttgcacacggtaactcggacaagctgattcctaggaaaactaaggatatctacttggaccccaaaaagtacggcgggttcgattccccaattgtagcctattctgtcctcgtggttgctgacatcaaaaagggaaaggcccagaaactgaagaccgtgacggagctactgggcataaccattatggaacggagccgatttgagaaaaatccctcagcattccttgaaagtaagggttacctcaacatcagagatgacaaactgatgatcttgcctaagtattccctgtttgagttagagaatgggcgcaggcgtctcctggcgtctgccggcgaacttcagaagggaaacgagctggctttgccaacacagttcatgaaatttctctacctggccagccggtataatgaactaaagggcaaaccggaggagattgaacaaaagcaggagttcgtcgtgcagcacgtttcctactttgatgacatactgcaaatcattaacgacttctcaaatagagtgatccttgcagatgctaacctcgagaaaattaacaagctgtatcaggacaataaggaaaacatcagcgtagatgaattggccaataacataatcaatttatttactttcaccagtctgggggcacccgccgcttttaaattcttcgacaagattgtcgataggaaacgctacacatctactaaggaggtgctcaactccaccctgatccatcagagcattacgggactttacgagacacgaatcgacctgggcaaattgggtgaagattga

SEQ ID NO: 3142 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctataatcacagatgactataaagtccctgccaagaaaatgagagttctcggtaacactgataaggagtacattaaaaagaatcttatcggcgctctgttgttcgacgggggaaacacggcagccgataggcggttaaagcgcaccgcgcgacgtagatatacaaggcggcgcaataggattctgtacctacaggaaatctttgctgaggaaatgtcaaaagtggacgatagtttctttcacagactcgaggacagcttcctggtagaagaggataagcggggctccaaatatccaatatttgccactatgcaagaggaaaagtactatcatgagaaattcccgaccatctaccaccttcgcaaggaactggcagacaagaaagagaaggccgatttgcgactcatttacctggctctggcacatatcattaaatttagaggtcacttcctcatcgaggacgataggtttgacgtgcggaacacagacatacagaagcagtatcaggccttcttagaaatttttgataccactttcgagaataacgacctgctttctcaaaatgtcgatgtggaagctatcttgacagacaaaatttcgaagtcagccaaaaaggatcgtatcctggcgcgctaccccaaccaaaagagcaccgggatctttgcagagttcctaaaactcattgttggaaatcaggccgacttcaagaaacattttaacctggaagataagacgcctcttcagttcgctaaagacagttatgatgaggacctggagaatttgctcggccagataggcgatgaatttgccgacctgttctccgcagctaagaagttatacgactctgtgctgctcagcgggatccttactgtcaccgatctgtccacaaaagccccattgtcagcgagtatgattcagcactatgacgagcacagagaagatctaaagcagctgaaacagtttgtgaaggccagcctccccgagaaataccaagaaatcttcgcagactcttccaaggatggatatgctggttacatagagggcaagactaaccaggaggccttttacaaatatctgtcaaaacttctgaccaaacaggaagggagcgagtacttgctcgaaaagattaaaaatgaggacttcctgaggaagcaacggacatttgataacggaagtatccctcatcaggtacacttaaccgaactgcgagctatcattcgcagacagtctgagtattacccattcctaaaggagaacctcgacaggatcgaaaagattctgacgtttcggataccctattacgttggccctcttgcccgcgagaagtccgatttcgcatggatgactagaaaaacagacgatagcatcaggccatggaattttgaagacttggtggataaggagaaatcggccgaggctttcattcatcgtatgaccaacaatgacctgtatctcccggaagagaaggtcctgcccaaacactctcttatctacgaaaagttcactgtgtacaacgagctgacaaaggtgcggtttttggcggaaggtttcaaagactttcagttcctcaatcgaaagcaaaaagagaccatctttaactccctgttcaaggagaaaagaaaggtcacggaaaaggatattatatcatttttaaataaagttgacgggtatgagggaatcgcaattaagggcatcgaaaaacagttcaacgccagtctgagcacctaccacgatctaaagaaaattctcggcaaggactttctggataatacagacaacgagcttatcttggaagatatagtgcagactctgaccctcttcgaggacagggagatgatccgcaagcggctggatatttataaagactttttcacagaatcccagttaaagaaactgtacagaaggcattatactgggtggggacgcctttctgctaagttgatcaatggtattcgaaacaaagagaatcaaaagaccatcctcgattacctgatagacgatggcagcgccaaccggaattttatgcagctaattaaggacgcagggctgtcattcaaacctatcattgacaaggcccgtacaggaagtcactccgataacctcaaagaagtagtgggcgagctggctggtagcccagccatcaagaaagggatacttcagtctttgaagatcgtcgacgaactggtgaaagttatgggctatgagcccgagcagattgtggtcgaaatggcaagagagaaccaaaccactgcgaagggattatcaaggagtcgccagcggctcacgacactgagagaaagccttgctaatctgaagtccaacatcttggaggagaaaaagcctaaatacgtgaaggatcaggtagaaaatcatcacctctctgacgataggctgttcctatactatctgcagaacggcaaagacatgtacaccgatgacgagctcgatattgacaatctgtcgcaatatgatatcgaccatataattccacaggcctttatcaaggacgatagcatcgacaaccgagttcttgtgtcctcagcaaagaatcgcgggaaaagtgatgacgtcccctctgtggaaattgtcaaggattgcaaagtgttctggaagaaattgctggacgccaagttaatgagccagcggaagtacgataacctcactaaagctgagagaggaggtctgacctccgacgataaggccaggtttatccaacgtcagcttgttgaaacacgccagattaccaaacacgtggcacggatactggacgagagattcaataacgagctagattcaaagggcaggcgaatccggaaagtaaagattgtcactctcaagagcaatctggtgtctaactttcgcaaagagttcgggttttataagatcagagaagttaataactaccaccatgctcacgacgcctatttgaatgcggtggtcgccaaagctattctgacaaagtacccgcagttagaacctgagttcgtgtacggagattatcccaaatacaactcctataagacgaggaagagtgcaaccgaaaaactctttttctacagcaacatcatgaatttcttcaagactaaagtaacactggccgacggcaccgtggttgtcaaggacgatatagaggtgaacaatgacacaggtgagatcgtgtgggataaaaagaaacatttcgctactgtccggaaggttctttcttatccacaagtgaacattgtgaagaaaaccgaaatccagaccgggggcttttccaaggagtcaattctggcccacggaaatagtgacaaattgatccctcgaaagacgaaagatatatacctcgaccccaagaagtatggcgggttcgatagcccaattgtagcatactcggtcctggtggttgcggacatcaaaaagggaaaagcccagaagctaaaaacagtgactgaactgcttggtatcaccattatggagagatcccgctttgaaaagaacccctctgctttcctcgagagcaagggctacctgaatataagggatgacaaattgatgatcctgcctaagtattcattatttgagctcgaaaacgggcgtcggagactgcttgccagtgcaggagagctgcagaaaggcaatgaattggctctcccaacacaattcatgaagtttctgtacctagcctccaggtataacgagctgaaaggtaagccggaggaaattgagcagaagcaggaatttgtcgtgcagcacgtttcttactttgatgacatccttcaaattatcaatgatttcagcaaccgcgtgatactcgcagacgccaatctggagaaaatcaacaagttgtatcaggacaataaagaaaacattcccgtagatgagttagctaacaatatcattaacctgtttactttcacctccctcggggcgcctgccgcatttaagttcttcgacaaaatcgtcgatcgaaagagatacacgtcaacaaaagaggtgctgaatagcacccttatacatcagagtattactggcctgtatgaaacacggatcgacttgggaaagctaggcgaggattga

SEQ ID NO: 3143 - RNA, 4116 nt, synthetic construct
  misc_feature 1..4116: note = Cas9 variant
  source 1..4116: mol_type = other RNA
atgaaggtgaacaattaccacatcggcctggacattgggaccagctccataggatgggtcgccatcggtgaggatggcaaacccctcagaattaaggggaaaacagctatcggagcaaggcttttccaggaaggcaaccctgccgcggaccggcgcatgtttcgaactacgcgtagaaggctgtctcggcgcaagtggagattgaaattactggaggaaattttcgatccatatatcaccccggttgactcaacatttttcgctaggctaaagcaaagtaatctcagccccaaggattcccggaaagagtttaagggttctatgctgttccctgaccttactgatatgcagtaccataaagactatccaaccatataccatctgcgccacgccttgatgacacaggatgaaaagtttgacatccgaatggtgtatctcgcaattcaccatatcgtaaaatacagagggaacttcctaaattcgacccccgtggattcatttaaggccagcaaggtcaacttcgtggaccagtttaaaaagctgaatgagctctatactgctattaaccctgaggaaagtttccaaatcaatttagcaaactccgaggatataggacaccagtttctggacccatctattaggaaattcgacaagaaaaagcagatccccaaaattgttcctgtgagcgtcgatgacaaggccacagataagatcaatggcaaaatcgcttccgaaattataaacgccatccttggctacaagtcaaaattggacgtggtagttcagtgcaccccagtggatagtaagagctgggcgctgaaattcgacgaggaggatattgacgcaaagctacaaaagatcctcccggaaatggatgagaatcagcagtctataattgccatcctgcagaacctttactcccaagtcacgctgaatcagatcgtgcccaacgggatgtcattgagcgaaagtatgattgagaaatataacgaccaccatgatcacctcaagctgtacaaaaagatcattgaccagttagctgaccctaaaaagaaggccgcactgaaaaaggcttattctcaatacgtgggagatgacggtaaagtcatagaacaggccgatttttggtccagcgttaagaaaaatctcgacgattcggacctttctaagcagatcatggatctgattgacgcggagaagttcatgccaaaacagcggacttcccaaaacggcgtgatcccccatcagttgcaccagcgtgagctagatgaaatcattgagcaccagtcaaagtattacccttggctggccgaaataaatccaaacaaacatgacctccacctggcaaagtataaaatcgaggaacttgtagcttttcgcgtgccctactacgtcgggccgatgattacccctgatgaccaagccaagagtgctgagacagtgttcagctggatggagagaaaaggaaaggaagccggccagatcactccctggaattttgatgagaaggttgacaggaacgcatccgccaatcggttcattaaacgaatgaccacaaaggacacctatctgatcggtgaagatgtgttgccagacgagtctctcctgtacgaaaaatttaaggtcttaaacgagctgaatatggtgcgcgtaaacgggaaactactcaaggttgctgataagcaggcgatattccaggacctgtttgagaattataaacatatcagcgtgaagaaacttcaaaactacattaagtcaaaaacgggattgcctagtgatcccgaaatctccggcctgagcgacccagagtatttcaataactctctcggcacttacaatgattttaagaagctgttcgggaacaaagtcgacgaacccgatcttcaggacgattttgagaagattgtggagtggtcaacagtcttcgaagacaaaagaatcctgagggagaagttgaacgaaataacctggctcagtgatcagcagaaagacgtgctggagagctcccggtatcaaggatggggtcgcttatctaagaagctgctaactggcattgttaatgaccagggggaaagaatcattgatgagctctggaacacaaataaaaacttcatgcagatccaatcggacaatgattttgcaaagaggatacacgaggccaacgctgaccagatgaaagccgtggatgtagaagacgtcctggcagatgcctacaccagccctcagaataagaaagctatccgtcaggtggttaaggtggtcgacgatattcaaaaagccatgggaggcgtggcaccaaagtacatctccattgagttcacgcggtcagaagaccgaaacccgagaaggaccatcagtcgccagcggcagcttgagaatacattgaaggatactgcgaaatctctggctaagagcataaaccccgaactcctgtccgagttagacaatgccgcaaaatcaaagaaaggtctgaccgacagactttatttgtactttacacagctcgggaaggatatttatactggcaagcctatcaacatcgacgagattagcacctacgatatcgaccatattctgccacaagccttcgtaaaagatgactctctaaataacagggtgctggtttccaaggctataaataacggaaaaagtgataacgtccccgtgcagctctttggcgccaagatggggcacttctggaaacagctggcagaagctggacttatcagcaagcgcaagttgaaaaatctgcagacagaccctgataccatttctaagtatgccatgcacggttttatccgacggcaattagtggagacttcccaggtcattaaactcgttgcgaacatcctgggcgacaagtaccgtaatgataacacgaaaataatcgaaattacagccagaatgaatcatcagatgagggacgagttcgggtttatcaagaaccgcgaaattaatgattatcaccatgctttcgacgcataccttaccgcctttctgggacggtacttgtatcacagatacatcaagctcaggccatatttcgtgtacggcgactttaaaaagttcaaagaggataaggtgactatgcgaaacttcaattttctgcacgacctaaccgatgacacacaagagaaaatagctgatgccgaaaccggtgaggtaatttgggaccgcgaaaactcaatccagcagctgaaggatgtctatcattacaagttcatgctcatcagtcacgaggtgtatactctgagaggggcaatgtttaatcagacagtttaccccgcgagcgacgccggcaaacggaaacttattccgataaaagctgataggcctatcaacgtgtacggaggctattcggggtccgccgacgcatacatggctattgtccgtatccataataagaaaggagataagtatcgcgtggttggtgtgccaatgcgggccagagacaggttggatgcagccaaaaaggtatctgacgctgactgtgatcgagcgctgaaggacgtcttaacgccccaactcaccaaaactaagaaaagccggaagacaggcgagattacccaggtggtggaagatttcgagatcgtcctggggaaagttatgtaccgccagcttatgatagacggagataagaagtttatgctgggctcaagtacatatcagtacaacgccaaacaactggtgctctccgaccagtctgtaaagactctggcaagcaaaggtagattggatcctctgcaggaatccatggactataataacgtgtacaccgagatcttagataaggtcaaccagtacttctcactctatgacatgaataaatttaggcacaagctgaaccttgggttcagcaagtttattagtttccccaatcataacgtgtttgatggcaatacgaaggcttcttccggaaagcgggaaatcctggaggaggttttgaacggcctccacgccaatccaaccttcgggaacctgaaagacattggaatcacaactcctttcggccaactacagcagcccaatggtatactgcttagcgacgaagccaagattcgataccagtcgccaaccgggctctttgagagaacagtgtcactgaaagatttgtga

SEQ ID NO: 3144 - RNA, 4116 nt, synthetic construct
  misc_feature 1..4116: note = Cas9 variant
  source 1..4116: mol_type = other RNA
atggacaagaaatacagcatcggcctggatattgggaccaactccgtgggatgggccgtcataacagacgattataaggttccctctaaaaagttcaaagtgctcggtaatactgacagacactcaatcaagaagaaccttattggcgctctgttgtttgatagtggggagacggcagaagccaccaggttaaaacggacagcgcgccgacgttacactagaaggaagaatcggatccgctatctgcaggagattttcagctccgaaatgtctaaagtagacgattcgtttttccatagactagaggaatcatttctcgtggaggaggacaagaaacacgaaaggcatcctatcttcggaaacatagtcgatgaggtggcttaccacgaaaagtatccaaccatctaccatctgcggaagaaacttgccgacagcacagataaggcagacctgcgcttgatttatctcgccctggctcacatgatcaaatttcgaggccacttcctgattgagggtgatctcaatccggacaacagtgacatggataagttatttatccaactggttcagacctacaatcagcttttcgaggaaaaccccataaatgcatccagagtggacgccaaagctattttgtctgccaggctgagcaagtcccggcgtctagagaacctcatcgcgcagctgcctggggaaaaacgcaatggactttttggcaacctgattgcattgtcactcggcctgactccaaatttcaagagtaactttgatttagccgaggacgctaagctgcaactcagcaaagatacatacgacgatgaccttgataatctgttggcccagatcggggaccagtatgcagatctattcctggctgccaagaacctctctgacgcgatcctgctttccgacattctgagagtcaactcagaaataaccaaagcccccttgagcgcaagtatgatcaagaggtacgatgagcatcaccaggacctcacgctgttaaaagctctggtgcggcaacagctacctgagaagtataaggaaattttctttgatcagtctaaaaatggatacgccggttatatcgacggcggggcttcccaggaggagttctacaagtttataaaaccaattctcgagaagatggatggaactgaagaactgcttgccaaattgaaccgagaggacctgctccgcaagcaaagaaccttcgataatggcagcatcccccatcagatccacctgggtgaacttcacgcaattctgaggcggcaggaggacttttatcctttcttgaaggataaccgcgaaaagatcgagaagattctcacatttagaataccatactacgtagggccgctggccaggggaaattcgcgtttcgcttggatgactcggaaatctgaagagaccatcacaccctggaactttgaggaagttgtggacaagggcgcgtccgcacaatcattcattgagcgaatgaccaattttgataaaaacttacctaatgaaaaggtcctgccaaagcatagtctactctatgagtacttcacggtgtataacgagctgactaaagtgaagtacgtcacagaaggcatgagaaaacccgagtttcttagcgggaagcagaaagaagccatcgttgacttgctgttcaagaccaataggaaagtgactgtaaagcagctcaaggaggattatttcaaaaagatcgaatgctttgactccgtggagatttctggagtcgaggaccgcttcaacgctagcctgggtacataccacgatttactgaaaataatcaaggacaaagattttcttgacaatgaagagaacgaagatattttggaggacatcgtgctcaccctgacgctattcgaagataaggagatgattgaggaacggctgaagaaatatgccaatctctttgacgataaggttatgaaacagctgaagagaaggcattacaccggctgggggcgcctttcacgaaaattgatcaacggaatacgggacaagcaaagtggcaagacaatcctggatttcttaaaatccgacggttttgcaaaccgtaatttcatgcagctcattaacgatgacagcctgacttttaaggaggccatccagaaagctcaggtgtctgggcaaggccactcacttcatgaacagattgccaatctggcaggaagtcctgcgatcaagaaaggcatattgcagagcgtcaaggtggtagacgagctcgttaaggtgatggggcacaaaccagaaaacattgtcatcgagatggctagagagaatcagaccacacaaaagggacagaaaaactccagggaacgcatgaagcggattgaggaaggtatcaaagagctgggctctcagatactaaaggagcaccccgtggaaaatactcagctgcaaaacgagaaactctacctgtattaccttcagaatgggagagatatgtatgtcgaccaggaattggatatcaacaggctgtcggactacgatgtggaccatattgttccgcagagcttcatcaaggatgactccattgataataaggtgttaacccgatcagacaaaaaccgcggaaagagtgataatgtaccttctgaggaagtcgtgaaaaagatgaaaaactattggcggcaactcctgaatgccaaacttatcacacagagaaagtttgacaacctgaccaaagcagagaggggcggtctaagcgagctcgacaaggccgggttcataaaacgtcagctggttgaaactcgccaaattacgaagcacgtggctcagatcttggattcccggatgaacacaaaatacgacgagaatgataagctgatcagagaagtcaaggtgattaccttaaaatcaaagctcgtaagcgactttaggaaagatttccagttctataaggtgcgagagatcaacaattaccatcacgcccacgacgcatacctgaacgctgttgtcggcactgcccttattaaaaagtatcccaagctggaatctgagtttgtgtacggagattataaagtgtacgacgtccggaagatgatagcgaaatccgagcaggaaatcggcaaggccaccgctaaacgcttcttttatagtaatattatgaacttctttaagacagagatcaccttggcaaatggggaaattagaaagaggccactcatcgagactaacgaagagacaggagagatagtttgggataaaggtcgggacttcgccacggtgcgaaaggtgctgagcatgcctcaagtaaatatcgtcaaaaagaccgaagtgcagactggcgctctaacaaacgagtctatttacgccagagggtcctttgataaactgatctcacgcaagcataggttcgaaagtagcaaatatggaggctttggttcgcccaccgttacatactccgtgcttgtcgtggcaaagtctaaggttcaggacgggaaagtgaagaaaattaagactggcaaagagctcatcggaataaccctgttggataagctggtattcgagaagaatccattaaaatttattgaagacaagggctacgggaacgtccagatcgacaaatgtatcaagctccccaaatatagcctgttcgagttcgaaaatggaacgcgtcggatgcttgcgtcagtgatggccaacaataacagtagaggcgatctgcaaaaggctaacgagatgtttttgcctgccaagctcgtgaccctgctataccacgcacataaaattgaatcctctaaggagctggagcacgaggcttatatacttgaccattacaatgatctctatcagctgttgagctacatcgaaaggttcgcctccttatatgtcgacgttgagaaaaacatttcaaaggtgaaagaactgtttagcaatatcgaaagttactctatttccgagatctgcagctcggtaataaacctcctgacacttactgcatcaggtgccccagctgatttcaagtttctggggaccacaatcccgcgcaagcgatacggatctccccagagtattttgtccagcactctaatccaccaatctattaccggcctgtatgagacgagaatcgacctcagccagctgggtggcgattga

SEQ ID NO: 3145 - RNA, 4116 nt, synthetic construct
  misc_feature 1..4116: note = Cas9 variant
  source 1..4116: mol_type = other RNA
atggacaagaaatacagcatcggcctggatattgggaccaactccgtgggatgggccgtcataacagacgattataaggttccctctaaaaagttcaaagtgctcggtaatactgacagacactcaatcaagaagaaccttattggcgctctgttgtttgatagtggggagacggcagaagccaccaggttaaaacggacagcgcgccgacgttacactagaaggaagaatcggatccgctatctgcaggagattttcagctccgaaatgtctaaagtagacgattcgtttttccatagactagaggaatcatttctcgtggaggaggacaagaaacacgaaaggcatcctatcttcggaaacatagtcgatgaggtggcttaccacgaaaagtatccaaccatctaccatctgcggaagaaacttgccgacagcacagataaggcagacctgcgcttgatttatctcgccctggctcacatgatcaaatttcgaggccacttcctgattgagggtgatctcaatccggacaacagtgacatggataagttatttatccaactggttcagacctacaatcagcttttcgaggaaaaccccataaatgcatccagagtggacgccaaagctattttgtctgccaggctgagcaagtcccggcgtctagagaacctcatcgcgcagctgcctggggaaaaacgcaatggactttttggcaacctgattgcattgtcactcggcctgactccaaatttcaagagtaactttgatttagccgaggacgctaagctgcaactcagcaaagatacatacgacgatgaccttgataatctgttggcccagatcggggaccagtatgcagatctattcctggctgccaagaacctctctgacgcgatcctgctttccgacattctgagagtcaactcagaaataaccaaagcccccttgagcgcaagtatgatcaagaggtacgatgagcatcaccaggacctcacgctgttaaaagctctggtgcggcaacagctacctgagaagtataaggaaattttctttgatcagtctaaaaatggatacgccggttatatcgacggcggggcttcccaggaggagttctacaagtttataaaaccaattctcgagaagatggatggaactgaagaactgcttgccaaattgaaccgagaggacctgctccgcaagcaaagaaccttcgataatggcagcatcccccatcagatccacctgggtgaacttcacgcaattctgaggcggcaggaggacttttatcctttcttgaaggataaccgcgagaaaatcgaaaagattctcacatttagaataccatactacgtagggccgctggccaggggaaattcgcgtttcgcttggatgactcggaaatctgaagagaccatcacaccctggaactttgaggaagttgtggacaagggcgcgtccgcacaatcattcattgagcgaatgaccaattttgataaaaacttacctaatgaaaaggtcctgccaaagcatagtctactctatgagtacttcacggtgtataacgagctgactaaagtgaagtacgtcacagaaggcatgagaaaacccgagtttcttagcgggaagcagaaagaagccatcgttgacttgctgttcaagaccaataggaaagtgactgtaaagcagctcaaggaggattatttcaaaaagatcgaatgctttgactccgtggagatttctggagtcgaggaccgcttcaacgctagcctgggtacataccacgatttactgaaaataatcaaggacaaagattttcttgacaatgaagagaacgaagatattttggaggacatcgtgctcaccctgacgctattcgaagataaggagatgattgaggaacggctgaagacctatgcccatctctttgacgataaagttatgaagcagctgaaaagaaggcactacacaggctgggggcgcctttcacgaaagttgatcaatggaatacgggacaaacaaagtggcaagactatcctggatttcttaaagtccgacggttttgcaaaccgtaacttcattcagctcatccatgatgacagcctgacctttaaagaggccattcagaaggctcaggtgtctgggcaaggccactcacttcacgaacagatcgccaatctggcaggaagtcctgcgattaaaaagggcatattgcagagcgtcaaagtggtagacgagctcgttaaggtgatggggcataagccagaaaacatcgtcattgagatggctagagagaatcagacaactcaaaaaggacagaagaactccagggaacgcatgaaacggatcgaggaaggtataaaggagctgggctctcagatcctaaaagagcaccccgtggaaaatacccagctgcaaaacgagaagctctacctgtattaccttcagaatgggagagatatgtatgtcgaccaggaattggatattaacaggctgtcggactacgatgtggaccatatcgttccgcagagcttcattaaagatgactccatcgataataaggtgttaacacgatcagacaagaaccgcggaaaaagtgatgacgtaccttctgaggaagtcgtgaagaaaatgaagaattattggcggcaactcctgaacgccaaacttataacccagagaaagtttgacaatctgactaaggcagagaggggcggtctaagcgagctcgataaagccgggttcattaagcgtcagctggttgaaacgcgccaaatcacaaaacacgtggctcagatcttggactcccggatgaacaccaagtacgatgagaatgacaaactgattagagaagtcaaggtgatcactttaaagtcaaaactcgtaagcgattttaggaaggacttccagttctataaagtgcgagagattaacaactaccaccatgcccacgatgcatacctgaatgctgttgtcggcaccgcccttataaagaaatatcccaagctggaatctgagtttgtgtacggagactataaggtgtacgatgtccggaaaatgatcgcgaagtccgagcaggaaattggcaaagccacagctaagcgcttcttttatagtaacatcatgaatttctttaaaaccgagattactttggcaaacggggaaatcagaaagaggccactcatagagacaaatgaagagacgggagagatcgtttggaacaagggtcgggacttcgccaccgtgcgaaaagtgctgagcatgcctcaagtaaatattgtcaagaaaactgaagtgcagacaggcgctctaaccaacgagtctatctacgccagagggtcctttgataagctgatttcacgcaaacataggttcgaaagtagcaagtatggaggctttggttcgcccacagttacttactccgtgcttgtcgtggcaaaatctaaggttcaggacgggaaggtgaaaaagatcaaaaccggcaaggagctcataggaattacgctgttggataaactggtattcgagaagaatccattaaagtttatcgaagacaaaggctacgggaacgtccagatcgacaagtgtattaaactccccaagtatagcctgttcgagttcgaaaatggaacccgtcggatgcttgcgtcagtgatggccaacaataacagtagaggcgatctgcaaaaagctaatgagatgtttttgcctgccaagctcgtgacactgctataccacgcacataagatagaatcctctaaagagctggagcacgaggcttatatccttgaccactacaacgatctctatcagctgttgagctacattgaaaggttcgcctccttatatgtcgacgttgaaaagaacatctcaaaagtgaaggagctgtttagcaatattgaaagttactctatctccgagatatgcagctcggtaatcaacctcctgactcttaccgcatcaggtgccccagctgatttcaaatttctggggacaactattccgcgcaagcgatacggatctccccagagtatcttgtccagcaccctaattcatcaatctatcacgggcctgtatgagacaagaatagacctcagccagctgggtggcgattga

SEQ ID NO: 3146 - RNA, 4116 nt, synthetic construct
  misc_feature 1..4116: note = Cas9 variant
  source 1..4116: mol_type = other RNA
atgaacaataacaattacagcatcggcctggacattgggaccaactccgtgggatgggccgtcataacagatgactataaggttccctctaaaaagatgagagtgctcggtaatactgataaaaggttcatcaagaaaaaccttattggcgctctgttgtttgacgaggggacgaccgcagaagatcggcgcttaaagcgaacagcccgtagaaggtacactcggcgcaagaatagactgaggtatctacaggagatcttcgcggaagagatgtcaaaagtagacagtagctttttccaccggctcgatgactcctttctggtgcctgaagataagtctggatcgaaatacccaattttcgctacccttgccgaggagaaggaatatcataaaaagtttccgacaatctaccatctgcgcaagcacttggcagactcaaaagagaaggccgatctccgactgatatatctggctctcgcacacatcaccaaatacagaggccatttcttatacgaagaggcctttgacattaagaacaatgatatccagaaaattttcaacgagtttatcaatatatatgacaacactttcgaaggtagcagtctgtccgggcaaaatgctcaggtcgaggccatttttacaggaaagatctctaaaagcgtgaagagggaacacgttcttaagttgttccccgacgagaaatccaccggcctgttctcagaatttctaaagctcattgtgggcaaccaggcggatttcaaaaagcactttgacctggaggagaaagcaagtcttcaattcagcaaggatacgtacgacgaagatctggagaatttgctcgggcagatcggagacgattttgccgacctgttcttagtcgctaagaaactgtatgatgccatcctcctttctggtattctgactgtgaccgacccttccacaaaggcaccattgtcagctagcatgatagaacggtacgagaaccatcaggaagatctagccgcgctgaaacagtttatcaagaacaatctccccgagaaatatgccgaggtattcagtgaccaatctaaggacggctacgcagggtatattgatggaaagactacccaggaagcgttttacaaatacatcaagaacctgctttccaaattcgagggcgccgactattttctggataagatagaacgtgaggacttcttgcgcaaacagagaacatttgataatggtagcattcctcaccagatccatctccaagaaatgaacgctatcctgaggcggcagggggagcactacccattactgaaggagaataaggagaaaattgaaaagatcctaaccttcaggattccctattacgttggacctctcgcccgcggcaacagagacttcgcatggctgacgcgaaattcggatcaggccatacggccatggaactttgaagagatcgtggacaaggcttcttccgcggagtcattcattaataaaatgactaactatgatctttacttgccggaagagaaagtcctgcccaagcacagtctcctgtatgaaacatttgcagtgtacaatgagcttaccaaagtgaagttcatcgccgaaggcctgcgcgactaccaatttttcgatagcgggcagaagaaacagatcgtcaaccagttgtttaaggagaaaagaaaggttactgagaaagacattatacattatctccacaatgtggatggatacgacggtatcgaactgaagggcattgagaagcaattcaacgcttccttatctacatatcatgacctgctaaaaatcattaaggataaagaatttatggacaatcacaagaaccaggagatcctcgaaaacatagtacataccctgacgatcttcgaggatagggagatgattaaacagcgtcttgcccagtacgacagcatctttgatgaaaaggtgattaaggcattgacccggcgacactatacagggtggggaaaactgtcagccaagctcatcaatggcatatgcgacaaaaagactggtaaaaccattctggattacttaatcgacgatgggtataacaatagaaacttcatgcaactgattaatgacgatggccttagttttaaggagatcatacagaaggctcaggtcgtgggaaaaacagacgatttgactcaggttgtgagggaactctccggcagccctgccatcaagaaagggattctgcaatctatcaagattgtcgacgagctagtgaaaatcatgggatacgcaccagaatcaatagtaattgagatggcgcgcgagaaccagaccacagctaagggtaaaaagaatagtcagcagcggtacaagagaatcgaagacgccctgaaaaacctcgcacccggcctggatagcaccatctccaaggagaatcctactgacaacattcaacttcagaatgataggttgttcctgtattacttacagaacgggaaagacatgtatacgggagaagccctcgatatcaatcaactgtcttcgtacgacattgatcacataatcccacaggctttcattaaggacgatagccttgacaaccgcgttctgacatcctcaaaagataatcgaggcaagagtgacaacgtgccctctttggaggtcgtgaagaaacggaaggccttttggcagcagctcctggacagcaaactaatctccgagcgtaagttcaacaatctgaccaaagcagaaagaggtgggctcgatgagagggacaaggtcggctttattaagcgccaactggtggaaactcggcagatcaccaaacatgttgctagaatacttgatgccaggttcaacacagaggtgtcagaaaagaatcagaaaatccgaagcgtaaagattatcaccttgaaatctaacctggtctccaattttcgcaaggagttcaagttatataaagtgcgggagattaacgactaccaccatgcgcacgatgcctatctcaatgctgttgtggcaaaggccatcctgaaaaagtacccgaaacttgaacctgagtttgtctacggagactatcagaagtacgatctgaagagatatataagtaaaagcaaggaccccaaagaagtggagaaggctactgaaaaatacttcttttattctaacctactcaatttctttaaggaggaggtacactacgccgatggcacaattgtgaaaagggaaaacatcgagtattccaaggacacgggggaaatcgcatggaataaggagaaagatttcgttaccattaagaaagtcctgtcatacccacaagtgaacatagtgaagaaacgtgaagtccagactggaggtttcagtaaggagagcatcttgcctaagggcaattcggacaaactgattccccgcaagacaaaagatatcttatgggacaccacaaagtacgggggatttgactccccagttattgcgtattctatcctcctgatagccgatatcgagaaaggcaaggctaagaaacttaagactgtgaaaaccctggtgggtattacgatcatggaaaaggccgcattcgagaaaaaccccattacctttttggaaaataaggggtaccataacgtacggaaggagaacatcctctgtctgcctaaatatagcctattcgagctggaaaatggcagaaggcgacttctcgcttcagccaaggagctgcagaaaggaaacgaaatagtcttgccagtgtacctgacaactttactctatcacagtaagaatgttcataaactggacgagccggaacaccttgagtacattcagaagcatcggtatgagtttaaagatctgttgaacctcgtgtccgagttctctcaaaagtacgtcctggcagaagccaatctagaaaagatcaaaagcctgtacgtggacaacgagcaggctgatatcgaaattcttgctaattcctttatcaacctcctgaccttcacagccttgggcgcacccgctgcctttaagttctttgggaaagacgttgatcgcaagagatatactaccgtgtcagagatattaaatgccacgctgattcaccagagcatcacaggactctacgagaccaggattgacctgagtaaacttggcgaagattga

SEQ ID NO: 3147 - RNA, 4116 nt, synthetic construct
  misc_feature 1..4116: note = Cas9 variant
  source 1..4116: mol_type = other RNA
atgaccgagaagaactacagcatcggcctggacattgggacaaattccgtgggatgggccgtcataactgatgactataaagttcccgctaagaaaatgaaggtgctcggtaacacggataaaaagtacatcaagaaaaatcttctgggcgcattgttattcgacaacggggaaaccgccgaggcgacaagactgaagaggactgctcggcgccgatatacccgtagaaagaataggctacggtacctccaggaaatttttgccgaggaaatggcaaaggtagatgagtctttcttttatcgcctggacgagtcattccttacaaccgatgacaaagattttgaaagacaccctatcttcggaaacaaggccgacgagattaagtaccatcaagaatttccaactatctatcacctgaggaaacatttggctgatagtcacgagaaggcagacctccggctgatatacctggccctcgctcatatgatcaaattccgcggccactttttaattgagggtgaactgaatgccgagaacacagatgtgcagaaacttttcgaagcgtttgtcgaggtgtacgaccgaaccttcgacgatagcaatttgtccgaaatcacggttgacgcatcttcgattctgactgagaaattttcaaagagcagaaggctagagaacctcatcaaacactatccgaccgaaaagaagaatacactgttcgggaaccttgtggccctggctttgggactccagcccaatttcaaaaccagttttaagctgtccgaggatgccaaattacagttctctaaggacacttacgaagaggatctggaagaactcataggcaaaattggcgacgagtatgcagatctttttacaagcgctaagaacctgtacgacgccatcttgctatccgggattctgaccgtcgcggataatacgactaaggcccctctctcagcaagtatgatcaaacggtataacgaacatcaagtggacctgaagaaacttaaggagttcatcaaaaacaatgctagcgataagtacgacgaaatttttaacgacaaggataaaaatggatatgccggttacatagagaacggcgtaaagcaggacgagttctacaaatatctgaagacaaccttgtctaaaatcgatgggtccgactactttctcgataagattgagcgtgaggacttcctgcgcaagcagagaacttttgataatggatcaatcccacaccagatacatttacaagaaatgcacgctattctgaggcggcagggcgagcactatgccttcctaaaagaaaaccaggcaaagatcgagaaaatcctcacatttcggattccctactatgttggtcctctggcccgcaagaatagcagattcgcttgggcggagtaccatagtgacgagaaaatcaccccatggaactttgatgaaattatagacaaggaaaaatctgcagagaagttcatcacgaggatgacccttaatgatttgtatctgcccgaagagaaggtgctccctaaacactccctggtctacgagacatacactgtgtataacgaacttaccaaggtgaaatacgtcaatgagcagggaaagagcaacttctttgacgccaatatgaaacaagaaattttcgagcatgtttttaaggaaaaccggaaggtgacaaaagataagttcctgaattatttgaacaaagagtttccagagtaccgcatccaggacctcatcgggctggacaaggaaaacaaatcgttcaatgcttctttaggcacttatcacgatctgaagaagattctagacaaatcctttctcgatgacaagaccaacgagacaataatcgaagatattatccagaccctgactcttttcgaggacagagatatgattaggcaacgtttgcagaaatactcagacatctttacgccgcagcagctgaagaaactcgaacggcgacattatacaggctgggggagactgagttacaagttaataaatggaatcaggaacaaggagaatggtaaaagcattctggattaccttatcgacgatggctatgccaaccgcaatttcatgcaattgatttccgacgataccctcccctttaagcagatcataaaagacgcacagattatcggggacattgatgacgtaacttctgtggtccgggagctgcctggaagcccagccatcaagaaaggcatactacagtcagtgaagatcgttgatgaactggtgaaagtcatgggtcacaaccccgacaatattgtgatcgagatggctagagaaaaccaaaccacaaatagggggcgcaaccagagtcagcagcgactcaagaagctgcaagattcccttaaagagttgggcagcaatattctgaacgaggaaaagccttcttacatcgagggaaaagtagaaaataaccacttacaggacgatcgactcttcctgtattacatacagaacggcaaggacatgtataccggggatgagcttgacattgatcatctgtcagactacgacatcgatcacatcattccacaggcctttatcaaagacgatagtattgacaatcgtgttttgactagctccgcaaagaacagaggaaagtctgatgacgtgccctcgctcgatatagtccatgacaggaaagcggattggatccgcctgtataagagcggtctaatttccaaacggaagttcgacaatctgacaaaagctgaaagaggcgggctcacggagaacgataaggccggattcatcaagaggcaactggtggagacccgacagattactaaacacgtcgcacagatccttgactcacgctttaatacagaacgggatgagaacgacaaggtgataagaaatgttaaagtgatcaccttgaagagtaacctggtatctcaattcaggaaagactttaagttctacaaggtccgtgaaattaatgattaccaccatgcccacgacgcttatttaaacgccgtggttggcacagcactcctgaaaaagtacccgaaacttgctcctgagtttgtgtatggtgaatacaagaaatatgatatccgcaagttcattactagctccggggacaaggccaccgcgaaatactttttctattcaaatctgatgaactttttcaagcgggtcatcagatacagcaatggcaaagtggtagtgaggcccgttatagagtgctctaaggatacgggagagattgcctggaacaaacagaccgactttgaaaaggtccgacgggtgctatcctacccacaggtgaatatcgtcaaaaaggttgagacacagactggcgggttcagtaaggaaagcatcctccctaaaggaaactctgataagctgattccccgcaaaaccaagaaattcagatgggacacaccaaagtatggtggctttgattcccccaacatagcttactcagtgttcgtgatcgcagacgtagagaaggggaaagccaagaaattgaagactgtcaaagaactggtgggaattagtatcatggagaggagctcgtttgaggaaaatcctgttgtgttcttagagaagaagggctatcaaaacgtccaggaagataatctcattaaactgccaaagtactccctttttgagttcgagggtgggcggcgaagactgttggcttctgccagcgaactccagaaaggcaacgaggtggttctgtcacgccatctagtggaactgctttatcacgcacatagggtaaatagttttaacaattccgagcacctcaagtacgtctctgaacacaaaaaggagttcggagaggtgctgagctgtgtggaaaactttgcgaagtcctatgtcgacgttgagaaaaatttgggcaagatccgtgccgtggctgataaaatagacaccttctcaatcgaagacattagcatcagttttgtaaacctgttaacgctcacagccctgggggcaccggctgatttcaattttcttggagagaagattccccggaaaagatacacctctactaaggaatgcctgaacgccacattgatccatcagtccataaccggcctctacgagactaggattgacctgagcaaactaggtgaggaatga

SEQ ID NO: 3148 - RNA, 4116 nt, synthetic construct
  misc_feature 1..4116: note = Cas9 variant
  source 1..4116: mol_type = other RNA
atgaacctgagaaatgtggagagctaccaggtcggcctcgacatcgggaccggatccgttggttgggccgtgcttgatgacaacggcgatctgtgcaggttcaaggggaaacccacatggggatctcgggtatttcctactgctgaaacggcagccgaggcgcgcgtgcaccgaggccaacgtagaaggtatgaccggcgcagacagaggattgatttgttacagcggttctttgctgacgaagtcgccaaggtggatccagagttctttatacgcctgaatcaggcacgactacatccggaaaacagagaccccgcccacgctgattacaggtggcctctcttcaatggttcaaactttaccgagaaagactattaccggcaattcccaacaatctatcatctgcgtgcacaccttctgaagagtgatgagcccgccgacattcgcttggtttacctcgctctgcataatatcgtgaaacacagagggaactttctgcaccaggataatcctagcctctccgccaggaacgcgaatgtcggagacgcagtggaagccttatgtctggctcttgacgagtggtgcggcgcccatgatgtagaatgtgcatgcgacgaggctgccttggcggaggccctgggcgatgcatctctacggccaggggaaaagcgagagcgcgctgaagccgctctcggagttgagaaggcccacaaaaagctggcaaaagccgtgtcgtcagctgtcgtgggttatgcggcagaatttggccatgtgtttttcgccgagagcgaggggagtaagtttgctctttccaacgacgaaaaagtcgaggcctacgtttgtcccgatgaaggaagagacctgttcgatgcaatgagggccgtgcactctagctacgtattgatgggcattctctccgaggctcagggtgaactgttatcagtgtgcaaggtcggggagtatgagcggtacaagcgcgacctggaaactctcaaaagtcttgtgagagcctatggacctgagaggtacgatgagttcttttgtggcccattctatgaaggcacccgtgactacgatccggggaaggcacagggatatacaaaatacaatctgggtgcgagcaagttgtctcacgaagactttctaaaagaggttcaaaagctgctcaaagacatcggcgctcaggccgatgagcggtacgcagacatagaacgagccatcgaggctggggccttcctgagaaggcttaagacctccgataacggaactattccctatcagctgcatttggaagagatggacgcaatcattgagcgccaggctgccttttaccctttcctcgcgcaagaaaaggataaactgaagtcattagtgagctttcggatcccatattacgtcggccccctgacacagaaaaatgccgctagagacggtaagggggaggcaaggttcgcctggagttctcgcaaacctggcatggaagatgctcgagtgtatccatggaactgggaggacgtaatagataaggaccagtccgccgaagattttattcggcgtatgaccggaacgtgcacttacctaaagggcgagcccgttctcgcaagatgtagcctggactatgagcttttctgcgtgttgaacgaactggcgggggccaggtggacccaagatggagacaaatcgtaccgctttgacgctgccgatcggctcggtatcgtcgaggacctgttcaagaaaagaaagagggtgacatacgaagcagctgagaaatggcttgcccgaactcacggcccggaatctgggaagtccgcaggaggcgcctatcatgtctcaggtgggcagggcgaggatgcttttgagagtcagctgagctcccactacgacttctgtaagattttgggagtggatgaactctctgacgcggatgaggccatggcagaagacatcatcctgtggaataccgttttcgaggatcgcagcattttaaaacggaagataaaactggcttatggcgacagactaggggatgcccaggtgaggaagctctgccaaaaacgttacacaggatggggtcgcctgtcaggcgaacttttgcgggggctgagaagtgccaccgacaacggacctaagacgatcatggatattctcctggagggcgaccccaatcatgctaggcgaatgggtgcagccatgaacttaatggagatcctgcacgacgatcttttggaatttcaggcgaagatagacgagcacaatcgggaacgcgctctcgccgtagggggcatgtccgtcgatgaggtgactggaagcccagcactgagaaggggcattaaccaggccctacgggttgtggacgagatcgctgggatcgcaggaaaacctcccgcccatatttatgtcgaagtgacacgagatgagggcgcgagaaataagggtcgcaggaccacttctcgttaccgggctctggaagccgcactctcaagtatcaaagcccagtgcgctgacgtatatgccgagctgaaggaaagagatccaagggcacttgacgatgagcgcttgacactgtacttcatgcaatgtgggaaatgcatgtacagcggagacgctttagatattaacaagctccagacctatcaggtggaccacatactgccccagtcctacgttaaagacgattcttttgagaataaggtccttgtgcgacctgacacgaaccaaagaaagggcgataccctgttgctcgacgaacggctgatcgccaggatgcgcggtttctggcgtacactaagagatgcggagctgattggcgagaaaaagtttaataacctcactcggacctcggtgagcgacgaacagatgaaaaagttcgtctccaggcagctggttgaaacagggcagatggtgaaacaagtgcagcagcttttgcaagcccgctatccagagtcagaggtacagccggtcaaggcaggagtgagtcatcagctgcgagttggctgtgctttagccaagtctagagaaatcaatgattttcaccacgctcatgacgcatacctcgcctgccaggtggggcggttcgtccaatataggcacagcgccgtgtactccgagcccgttaaaatggctgcggtggtaaagcagtttatcaaaaagcaggcagaagattatcgcagaactagggagctgcctggatcagacggcttcattgtcagctcttttatgaccccaggtttcgatgtgaaaacaggggaagtgtttcgggacgcctgggatgctggagccgagatagaccgtatccgccgatgtttcgactacaaggattgcttcatttccagaatgcccgaggaaacccatggcgcattttgggacgccactatctacagtcctagggctgcgggtaagacgcttagcctgccactaaaacggggcctcgatccccgcaagtatgggtcttactccagagagcagttcgcctatttcttcgtctacgaagcagttaaaccgaagaaaaagcaaagggtgctggagtttgctcctgtaccagtgcgggtcgcctcagcattggccaacgaccccgatgctctggaggactatgcccgagaattagcggaggcagaaggactcgtgttcgagcgcattagaaggcggaaggtttacaaatatcagcagatcatagtgggcgatagtcgtctgtacgtcacagggagagaagaggtgaggaatgcccgccagcttgcttttagccaagacgagaccaagctgatctgtcggattgaacagggagaggaatgcgaggaaggcgagttgctcgatctgttccgatcgatgcagagaaaatacctagcctgtgctcctaggctggcacgccttatgaaggttgccgagatggaagagggttttatcgctgccactgcatccgggaaacgggaagtgctcctgtctttgaccagcattgcggccgctcacagaaactcaatcgacctgaagcccataggacgtaaaggcagttccggtcaaatgaagattacattctctaaggagttaagcaccaacggcatcctctttgtcgattcctcagtaactgggatgttcgaaaggcggtgccgcctgggactttga

SEQ ID NO: 3149 - RNA, 4116 nt, synthetic construct
  misc_feature 1..4116: note = Cas9 variant
  source 1..4116: mol_type = other RNA
atggagaacaagaattacagcatcggcctggacattgggaccaactccgtgggatggtctgtcataacagatgactataaagttccctcaaagaaaatgaaggtgctcggtaatactgataaaagattcatcaagaagaaccttattggcgccctgttgtttgacgaagggacgaccgctgaggcaaggcggttaaaacgcacagcccgacgtagatacactaggcggaagaatcgcctgagatatctacaggaaatcttcgcggaggaaatgagtaaagtagatagctcctttttccacaggctcgacgattcttttctgattcctgaggacaagcggggatcgaaatacccaatcttcgctacccttgccgaggaaaaggagtatcataagcaatttccgacaatataccatctgcgcaaacagttggcagattcaaaggagaaaaccgacctccgactgatctatctggccctcgctcacatgattaagtacagaggccacttcttatacgaagatacttttgacatcaaaaacaatgatattcagaagatcttcagcgagtttataagtatttatgacaacacattcgaaggttcctctctgagcgggcagaatgcacaagtggaggccatctttaccgacaaaatttccaagtcagctaagagggaacgggtccttaaattgttccccgatgagaagagtacgggactgttcagcgaatttctaaaactcatcgtgggcaaccaggccgacttcaagaaacattttgatctgggcgagaaggcgcctcttcagttctctaaggacacttacgatgaggacctggaaaatttgctcgggcagatcggagatgactttgcagatctgttcttagttgccaaaaagctgtatgacgctattctcctttccggtatactgaccgtgacagatccatcaactaaagcccccttgagcgcaagtatgatcgagcgttacgaaaaccaccaaaaggacctagctgtcctgaaacagtttattaagaataacctccctgagaagtatgacgaagtgttctctgatcagtccaaagacggctacgccgggtatatcgatggaaagaccacacaggaggcgttttacaaatacataaagaatctgcttagcaaattcgagggcaccgactattttctggaaaagattgagcgcgaagatttcttgagaaagcaaaggacgtttgacaacggttcgatcccacaccagatccatctccaggagatgaacgccattctgcggcgacaaggggaacactaccccttcttaaaagataataaggagaaaatcgagaagattctgactttccgcataccttattacgtaggaccactagcaagaggcaacagggactttgcttggctcacacgcaattctgatgaagccatccggccgtggaacttcgaggaaattgttgacaaggcttcctcagccgaggattttatcaataaaatgaccaactatgacctgtaccttcccgaggaaaaagtgttgcctaagcatagtctgctctatgagactttcgcagtctacaatgaactgacaaaggtgaaatttatcgccgagggccttagagattaccagttcctggacagcgggcagaagaaacagattgtgacccaattgtttaaggagaaaaggaaggtcacggaaaaggacataatccagttcctccacaacgttgatggatatgacggtattgagctgaaaggcatcgaaaagcagtttaatgcttccttatctacctaccacgatctgctaaaaattatcaaggacaaagagttcatggatgacagcaagaacgaagagatactcgaaaatatcgtgcatacactgactatttttgaggatcgtgagatgatcaagcagcggcttgcgcaatatgactcattgttcgatgaaaaagtaattaaggcactgatccgaagacactacaccgggtggggaaaactcagtgccaagctgatagacggcatttgcgataaacagacaggtaacactatcttagactatctgattgatgacgggaagaataacaggaattttatgcagcttatcaacgacgatggcttgtccttcaaggagataacccagaaagctcaagtggtcggaaagacagacgatgtgaaacaggttgtgcaggaactcccaggcagccccgccatcaagaaagggattctgcagtctatcaagattgtcgacgagctagtgaaagtaatgggacatacccctgaatcaatcgttatagagatggcacgcgagaaccaaactacggcccggggtaagaagaatagtcagcagagatacaaaaggattgaagatgctctgaagaacctcgccagcggcctggactccaatatccttaaagagcacccaacaaacaatatccaattgcagaacgatcgcctgttcttatattacctccagaatgggcgagacatgtacaccggaaagcccctggatattaaccagctttcttcgtatgacatcgatcatattgtgccgcaagcatttataaaagacgacagcctggataatcgggtcttgacttccctcaaggacaaccgtggcaagtcagataatgtgcctagtatcgaagtcgtgcagaaaagaaaggcgttctggcagcagctgctagactctaaactgattagcgagaggaagtttaacaatctcaccaaagctgagcgcggtgggctggatgaacgggacaaggttggcttcatcaagagacaacttgtggagacaaggcagattaccaaacacgtagcccagatcttggatgcacgatttaacaaggaagtcaatgagaaagacaagaaaaaccgcactgtgaagataatcacactgaagtccaacttagtttcaaatttccggaaagaatttagactctacaaggtgagggagattaacgattatcaccatgcccacgacgcttacctgaatgccgtcgtggcaaaagctatccttaagaaatatcccaagctggagccagaatttgtatacggagattatcagaagtacgacctaaaacgttacattagccgctctcggaaccctaaggaggtggaaaaagccacggagaagtatttcttctactccaatctcctgaactttttcaaagaagaggttcattatgcggatggcaccatcgtcaagagagagaatatagaatacagtaaagacactggggagattgcctggaacaaggaaaaggacttcgctacaatcaaaaaggtgttgagctatccccaagtgaatatcgtcaaaaagagggaggttcagaccggaggtttttctaaagaatccattctgccaaagggcaactcagataagttaataccccgaaaaacaaaggacatcctctgggagactaccaaatacgggggattcgatagtcctgtgattgcatatagcatcctgcttattgccgacatcgagaagggcaaagctaagaagctgaaaacggtgaagaccttggtaggtataacaatcatggaaaaagccgcatttgaggaaaatccaattactttcctcgagaacaaggggtaccacaatgtccggaaagagaacatcctgtgtctaccgaagtactcgctgtttgaacttgagaatggccgcagaaggctcctggcgtccgccaaggaattgcagaaaggaaacgagattgtgctgcccgtttatttaaccacactcctgtaccactctaagaacgtgcataaacttgatgaacctgagcacctggagtatatccaaaagcatcggaatgagttcaaagacttgctcaacctggtcagcgaattttcacagaagtacgtgctagctgatgccaatctggagaaaatacagaacctttatgcagacaatgaacaggctgatattgaaatcctcgccaacagtttcatcaatctgttgacttttaccgcattaggcgccccagctgcgttcaagtttttcgggaaggacattgatcgaaaaagatacacgacagtttccgagatcctgaacgccaccctcatacaccaatctattactggactgtatgagacacgcatcgaccttagcaagctgggcgaagattga

SEQ ID NO: 3150 - RNA, 4116 nt, synthetic construct
  misc_feature 1..4116: note = Cas9 variant
  source 1..4116: mol_type = other RNA
atggacaagaaatacagcatcggcctggatattgggaccaactccgtgggatgggccgtcataacagacgattataaggttccctctaaaaagttcaaagtgctcggtaatactgacagacactcaatcaagaagaaccttattggcgctctgttgtttgatagtggggagacggcagaagccaccaggttaaaacggacagcgcgccgacgttacactagaaggaagaatcggatccgctatctgcaggagattttcagctccgaaatgtctaaagtagacgattcgtttttccatagactagaggaatcatttctcgtggaggaggacaagaaacacgaaaggcatcctatcttcggaaacatagtcgatgaggtggcttaccacgaaaagtatccaaccatctaccatctgcggaagaaacttgccgacagcacagataaggcagacctgcgcttgatttatctcgccctggctcacatgatcaaatttcgaggccacttcctgattgagggtgatctcaatccggacaacagtgacatggataagttatttatccaactggttcagacctacaatcagcttttcgaggaaaaccccataaatgcatccagagtggacgccaaagctattttgtctgccaggctgagcaagtcccggcgtctagagaacctcatcgcgcagctgcctggggaaaaacgcaatggactttttggcaacctgattgcattgtcactcggcctgactccaaatttcaagagtaactttgatttagccgaggacgctaagctgcaactcagcaaagatacatacgacgatgaccttgataatctgttggcccagatcggggaccagtatgcagatctattcctggctgccaagaacctctctgacgcgatcctgctttccgacattctgagagtcaactcagaaataaccaaagcccccttgagcgcaagtatgatcaagaggtacgatgagcatcaccaggacctcacgctgttaaaagctctggtgcggcaacagctacctgagaagtataaggaaattttctttgatcagtctaaaaatggatacgccggttatatcgacggcggggcttcccaggaggagttctacaagtttataaaaccaattctcgaaaagatggatggaactgaggaactgcttgccaaattgaaccgagaggacctgctccgcaagcaaagaaccttcgataatggcagcatcccccatcagatccacctgggtgaacttcacgcaattctgaggcggcaggaggacttttatcctttcttgaaggataaccgcgaaaagatcgagaagattctcacatttagaataccatactacgtagggccgctggccaggggaaattcgcgtttcgcttggatgactcggaaatctgaagagaccatcacaccctggaactttgaggaagttgtggacaagggcgcgtccgcacaatcattcattgagcgaatgaccaattttgataaaaacttacctaatgaaaaggtcctgccaaagcatagtctactctatgagtacttcacggtgtataacgagctgactaaagtgaagtacgtcacagaaggcatgagaaaacccgagtttcttagcgggaagcagaaagaagccatcgttgacttgctgttcaagaccaataggaaagtgactgtaaagcagctcaaggaggattatttcaaaaagatcgaatgctttgactccgtggagatttctggagtcgaggaccgcttcaacgctagcctgggtacataccacgatttactgaaaataatcaaggacaaagattttcttgacaatgaagagaacgaagatattttggaggacatcgtgctcaccctgacgctattcgaagataaggagatgattgaggaacggctgaagaaatatgccaatctctttgacgataaggttatgaaacagctgaagagaaggcattacaccggctgggggcgcctttcacgaaaattgatcaacggaatacgggacaagcaaagtggcaagacaatcctggatttcttaaaatccgacggttttgcaaaccgtaatttcatgcagctcattaacgatgacagcctgacttttaaggaggccatccagaaagctcaggtgtctgggcaaggccactcacttcatgaacagattgccaatctggcaggaagtcctgcgatcaagaaaggcatattgcagagcgtcaaggtggtagacgagctcgttaaggtgatggggcacaaaccagaaaacattgtcatcgagatggctagagagaatcagaccacacaaaagggacagaaaaactccagggaacgcatgaagcggattgaggaaggtatcaaagagctgggctctcagatactaaaggagcaccccgtggaaaatactcagctgcaaaacgagaaactctacctgtattaccttcagaatgggagagatatgtatgtcgaccaggaattggatatcaacaggctgtcggactacgatgtggaccatattgttccgcagagcttcatcaaggatgactccattgataataagatcttaacccgatcagacaaaaaccgcggaaagagtgataatgtgccttctgaggaagtagtcaaaaagatgaaaaactattggcggcaactcctgaatgccaaacttataacacagagaaagtttgacaacctgaccaaagcagagaggggcggtctaagcgagctcgacaaggccgggttcattaaacgtcagctggtggaaactcgccaaatcacgaagcacgttgctcagatcttggattcccggatgaacacaaaatacgacgagaatgataagctgattagagaagtgaaggtcatcaccttaaaatcaaagctcgtgagcgactttaggaaagatttccagttctataaggtacgagagattaacaattaccatcacgcccacgacgcatacctgaacgctgtggttggcactgcccttatcaaaaagtataccaagctggaatctgagtttgtctacggagattataaagtgtacgacgtgcggaagatgatagcgaaatccgagcaggaaattggcaaggccacagctaaacgcttcttttatagtaatatcatgaacttctttaagaccgagattactttggcaaatggggaaatcagaaagaggcccctcatagagacaaacgaagagacgggagagatcgtctgggataaaggtcgggacttcgccaccgttcgaaaggtgctgagcatgccacaagtgaatattgtcaaaaagactgaagtacagacaggcgctctaaccaacgagtctatctacgccagagggtcctttgataaactgatttcacgcaagcataggttcgaaagtagcaaatatggaggctttggttcgcctacagtgacttactccgttcttgtggtcgcaaagtctaaggtgcaggacgggaaagttaagaaaatcaagaccggcaaagagctcataggaatgacgctgttggataagctggtgttcgagaagaatcccttaaaatttattgaagacaagggctacgggaacgtacagatcgacaaatgtatcaagctcccaaaatatagcctgttcgagttcgaaaatggaacccgtcggatgcttgcgtcagtcatggccaacaataacagtagaggcgatctgcaaaaggctaacgagatgtttttgcccgccaagctcgtgacactgctataccacgcacataaaattgaatcctctaaggagctggagcacgaggcttatatacttgaccattacaatgatctctatcagctgttgagctacatcgaaaggttcgcctccttatatgtggacgtcgagaaaaacatttcaaaggttaaagaactgtttagcaatatcgaaagttactctatttccgagatctgcagctcggtgataaacctcctgactcttaccgcatcaggtgcccctgctgatttcaagtttctggggacaactatcccacgcaagcgatacggatctccgcagagtattttgtccagcaccctaatccaccaatctattacgggcctgtatgagacaagaatcgacctcagccagctgggtggcgattga

SEQ ID NO: 3151 - RNA, 4116 nt, synthetic construct
  misc_feature 1..4116: note = Cas9 variant
  source 1..4116: mol_type = other RNA
atggacaagaaatacagcatcggcctggatattgggaccaactccgtgggatgggccgtcataacagacgattataaggttccctctaaaaagttcaaagtgctcggtaatactgacagacactcaatcaagaagaaccttattggcgctctgttgtttgatagtggggagacggcagaagccaccaggttaaaacggacagcgcgccgacgttacactagaaggaagaatcggatccgctatctgcaggagattttcagctccgaaatgtctaaagtagacgattcgtttttccatagactagaggaatcatttctcgtggaggaggacaagaaacacgaaaggcatcctatcttcggaaacatagtcgatgaggtggcttaccacgaaaagtatccaaccatctaccatctgcggaagaaacttgccgacagcacagataaggcagacctgcgcttgatttatctcgccctggctcacatgatcaaatttcgaggccacttcctgattgagggtgatctcaatccggacaacagtgacgttgataagttatttatccaactggtgcagacctacaatcagcttttcgaggaaaaccccataaatgcatccagagtcgacgccaaagctattttgtctgccaggctgagcaagtcccggcgtctagagaacctcatcgcgcagctgcctggggaaaaacgcaatggactttttggcaacctgattgcattgtcactcggcctgactccaaatttcaagagtaactttgatttagccgaggacgctaagctgcaactcagcaaagatacatacgacgatgaccttgataatctgttggcccagatcggggaccagtatgcagatctattcctggctgccaagaacctctctgacgcgatcctgctttccgacattctgagagtgaactcagaaataaccaaagcccccttgagcgcaagtatgatcaagaggtacgatgagcatcaccaggacctcacgctgttaaaagctctggtacggcaacagctacctgagaagtataaggaaattttctttgatcagtctaaaaatggatacgccggttatatcgacggcggggcttcccaggaggagttctacaagtttataaaaccaattctcgagaagatggatggaactgaagaactgcttgccaaattgaaccgagaggacctgctccgcaagcaaagaaccttcgataatggcagcatcccccatcagatccacctgggtgaacttcacgcaattctgaggcggcaggaggacttttatcctttcttgaaggataaccgcgagaaaatcgaaaagattctcacatttagaataccatactacgttgggccgctggccaggggaaattcgcgtttcgcttggatgactcggaaatctgaagagaccatcacaccctggaactttgaggaagtggtcgacaagggcgcgtccgcacaatcattcattgagcgaatgaccaattttgataaaaacttacctaatgaaaaggtgctgccaaagcatagtctactctatgagtacttcacggtgtataacgagctgactaaagtcaagtacgttacagaaggcatgagaaaacccgcctttcttagcggggagcagaagaaagctatcgtggacttgctgttcaagaccaataggaaagtaactgtgaagcagctcaaggaagattatttcaaaaagatcgagtgctttgactccgtcgaaatttctggagtggaggaccgcttcaacgccagcctgggtacataccacgatttactgaaaataatcaaggacaaagattttcttgacaatgaggaaaacgaggatattttggaagacatcgttctcaccctgacgctattcgaggataaggaaatgattgaggagcggctgaagacctatgcacatctctttgacgataaagtgatgaagcagctgaaaagaaggcactacacaggctgggggcgcctttcacgaaagttgatcaatggaatacgggacaaacaaagtggcaagactatcctggatttcttaaagtccgacggttttgccaaccgtaacttcattcagctcatccatgatgacagcctgacctttaaagaagctattcagaaggcccaggtctctgggcaaggccactcacttcacgagcagatcgcaaatctggcgggaagtcctgctattaaaaagggcatattgcagagcgtgaaagtagttgacgaactcgtgaaggtcatggggcataagccagagaacatcgtgattgaaatggccagagagaatcagacaactcaaaaaggacagaagaactccagggagcgcatgaaacggatcgaagagggtataaaggaactgggctctcagatcctaaaagagcaccccgtcgagaatacccagctgcaaaacgaaaagctctacctgtattaccttcagaatgggagagatatgtatgtggaccaggagttggatattaacaggctgtcggactacgatgttgaccatatcgtgccgcagagcttcattaaagatgactccatcgataataaggtattaacacgatcagacaagaaccgcggaaaaagtgataatgtcccttctgaagaggtggttaagaaaatgaagaactattggcggcaactcctgaatgcaaaacttataacccagagaaagtttgacaacctgactaaggccgaaaggggcggtctaagcgagctcgacaaagctgggttcattaagcgtcagctggtggagacgcgccaaatcacaaaacacgtcgcccagatcttggattcccggatgaataccaagtacgacgaaaacgataaactgattagagaggtgaaggtaatcactttaaagtcaaaactcgtgagcgactttaggaaggatttccagttctataaagttcgagaaattaacaattaccaccatgcacacgacgcttacctgaacgccgtcgtgggcaccgcgcttataaagaaatatcccaagctggagtctgaatttgtgtacggagattataaggtctacgacgttcggaaaatgatcgccaagtccgagcaggagattggcaaagctacagcaaagcgcttcttttatagtaatatcatgaacttctttaaaaccgaaattactttggccaatggggagatcagaaagaggccactcatagaaacaaacgaggaaacgggagagatcgtgtgggataagggtcgggacttcgctaccgtgcgaaaagtactgagcatgcctcaagtcaatattgtgaagaaaactgaggttcagacaggcgccctaaccaacgaatctatctacgcaagagggtcctttgataagctgatttcacgcaaacataggttcgagagtagcaagtatggaggctttggttcgcccacagtgacttactccgtccttgtggttgcgaaatctaaggtgcaggacgggaaggtcaaaaagatcaaaaccggcaaggaactcataggaattacgctgttggataaactggtattcgagaagaatccattaaagtttatcgaggacaaaggctacgggaacgtgcagatcgacaagtgtattaaactccccaagtatagcctgttcgagttcgaaaatggaacccgtcggatgcttgcctcagtgatggctaacaataacagtagaggcgatctgcaaaaagccaatgaaatgtttttgcctgcaaagctcgtcacactgctataccacgctcataagatagagtcctctaaagaactggagcacgaggcctatatccttgaccactacaacgatctctatcagctgttgagctacattgaaaggttcgcatccttatatgttgacgtggagaagaacatctcaaaagtaaaggaactgtttagcaatattgagagttactctatctccgaaatatgcagctcggtgatcaacctcctgactcttaccgcctcaggtgctccagcggatttcaaatttctggggacaactattccgcgcaagcgatacggatctccccagagtatcttgtccagcaccctaattcatcaatctatcacgggcctgtatgagacaagaatagacctcagccagctgggtggcgattga

SEQ ID NO: 3152 - RNA, 4116 nt, synthetic construct
  misc_feature 1..4116: note = Cas9 variant
  source 1..4116: mol_type = other RNA
atggagaacaagaattacagcatcggcctggacattgggaccaactccgtgggatggtctgtcataacagatgactataaagttccctcaaagaaaatgaaggtgctcggtaatactgataaacacttcatcaagaagaaccttattggcgccctgttgtttgacgaagggacgaccgctgaggcaagaaggttaaaacggacagcccgccgacgttacactagaaggaagaatcggctgcgctatctacaggaaatcttcagtgaggaaattggaaaagtagatagctcctttttccatagactcgacgattcttttctgatccctgaggacaagaggggctcgaaatacccaatattcgcgacccttgctgaggaaaagaagtatcacaaacaatttccgacaatctaccatctgcggaagcagttggccgattcaaaagagaagaccgacctccgcctgatttatctggcactcgcccacatgatcaaataccgaggtcatttcttatacgaagaggcttttgatattaagaacaatgacatccagaaaatattcaacgagtttattagcatctataataacactttcgaagggaatagtctgtccggacagaacgtgcaagtcgaggcaatttttacagataagatctctaagagcgccaaaagagaaagggtgcttaagttgttccccgacgagaaatccaccggcctgttctcagaatttctaaagctcatcgttggcaatcaggctgacttcaaaaagcactttgatctggaggagaaggcccctcttcagttcagtcgggacacgtacgatgaagacctggagaacttgctcgggcagattggagatgactttgcggatctgttcttagtggccaaaaagctgtatgacgcaatactccttagcggtatcctgactgtcaccaatccatctacaaaagctcccttgtccgcctcaatgattgaacgttacgagaaccaccaaaaggatctagcaagcctgaaacagtttatcaagaacaatctccctgaaaagtatgacgaggtgttcagtgatcagtctgaggacggctacgctgggtatatagacggaaaaactacccaggaaacattttacaagtacattaaaaacctgctttccaagttcgagggcgccgattattttctggacaaaatcgaacgcgaggatttcttgagaaagcaaaggacctttgacaatggtagcatcccacatcagattcacctccaggaaatgaacgcgatcctgcggcgacaaggggagcattaccccttcttaaaggagaataaagaaaagattgagaaaatactgacgttccgcatcccttattacgtaggaccactagccagaggcaacagggattttgcatggctcactcgcaattcggaccaggctattcggccgtggaacttcgaagagatcgttgataaggcctcttccgctgaggactttatcaataaaatgacaaactatgatctgtaccttcccgaagagaaggtgttgcctaaacactcactgctctatgaaaccttcgccgtctacaatgagctgactaaggtgaagtttattgcagaaggccttagagactaccagttcctggatagtgggcagaaaaagcaaatagtgacacagttgtttaaagagaagaggaaagtcaccgagaaggacatcattcagttcctccacaacgttgatggatatgacggtatcgaactgaagggcattgagaaacagtttaatgccagcttatccacgtaccatgacctgctaaagatcataaaagataaggctttcatggacgatgcgaaaaacgaagcaatcctcgagaatattgtgcacaccctgacaatctttgaagaccgtgagatgattaagcaacggcttgcccagtatgattctttgttcgacgagaaggtaatcaaagctctgactcgaagacattacaccgggtggggaaagctcagcgccaaactgataaacggcatttcagataagcagacaggtaacactatcttagactatctgattgatgacggggaaatcaataggaactttatgcagcttataaatgatgacggcttgagtttcaaagagatcattcaaaaggcacaggtggtcggaaagaccaacgatgtgaaacaggttgtgcaggaactcccaggctcccccgccatcaagaaagggattctgcaaagcatcaagatagtcgacgagctagtgaaagtaatgggacacgctcctgaatctattgttatcgagatggcccgcgagaatcagacaaccgcacggggtaagaaaaactcacagcaaagatacaagaggatcgaagacagtctgaagattctcgcgagcggccttaattccaaaatcctgaaggagcatccaactgataacattcagttgcagaatgaccgcctgttcttatattacctccagaacgggaaagatatgtacacgggagaagctctggacataaatcaactttcttcgtgcgatatcgaccacattatcccccaggcctttattaaggatgacagcctggataaccgagtgttgacatcctcaaaagacaatcggggcaagagtgataacgtcccgtctctcgaggtggtcgacaagatgaaagtgttctggcagcagctgctagacagcaagctgatctcctatcgtaaatttaataacctcaccaaggcagagagaggtgggctgaacgaacttgataaagttggcttcataaagaggcaattggtggagactcgccagatcaccaagcacgtagcccagattctggacgctcggtttaataaagaagtcacagagaaggataaaaagaacagaaccgtgaaaatcattactttaaagtcaaatctcgttagcaacttcaggaaggaatttgagctgtacaaagtgcgagagatcaatgactatcatcacgcccatgatgcataccttaacgctgtcgtggccaaggcgatactgaaaaagtatcctaaactagaacccgagttcgtatacggagactatcagaagtacgatctcaagcgctacatttctcggtccaaagacccaaaggaaatcgagaaagccacagaaaagtactttttctatagtaatctgttgaactttttcaaagaggaggtgcactatgctgatggcacgatcgttaagagagaaaatattgagtacagcaaagacaccggggaaatagcatggaacaaggagaaggatttcgccactatcaaaaaggtcctgtctttacctcaagtgaatattgtgaaaaagagggaagtccagacaggaggtttttccaaagagtcaatcctccccaagggcaacagtgacaagctgattccacgtaaaaccaaggatatcctttgggacacaactaaatatgggggattcgacagccccgttatagcttactcgatcctgttgattgccgatatcgagaagggcaaagcaaagaagctcaaaaccgtgaagacgctggtgggtattaccatcatggaaaaagacgcgtttgagaagaatcctatagccttcctagaaaacaaagggtatcacaatgtatgtaaggagaacattctgtgccttccaaagtactccctctttgagctggaaaacggccgccggagattgctggcttctgccaaagagttacagaagtgtaatgaaatcgtcctcccggtgtacctgacaactcttctgtatcatagcaaaaacgttcacaagttggatgagcccggacatctcgaatacatccaaaaacacaggaatgagttcaaggacctgctaaacctggtgtcagagtttagtcagaaatatgtccttgcagatgctaatctcgaaaagattaagaacctgtacgccgacaatgagcaggcagatatcgaaatattggccaactccttcattaatttactgacctttacagctctcggcgcgcctgccgcattcaaatttttcgggaaggacgtggatcgaaaacggtatactaccgtttctgagatcctgaacgctacgcttattcatcagagcatcacaggactgtacgaaacccgcatagacttgtccaagctaggcgaggattga

SEQ ID NO: 3153 - RNA, 4116 nt, synthetic construct
  misc_feature 1..4116: note = Cas9 variant
  source 1..4116: mol_type = other RNA
atgaaggtgaacaattaccacatcggcctggacattgggaccagctccataggatgggtcgccatcggtgaggatggcaaacccctcagaattaaggggaaaacagctatcggagcaaggcttttccaggaaggcaaccctgccgcggaccggcgcatgtttcgaactacgcgtagaaggctgtctcggcgcaagtggagattgaaattactggaggaaattttcgatccatatatcaccccggttgactcaacatttttcgctaggctaaagcaaagtaatctcagccccaaggattcccggaaagagtttaagggttctatgctgttccctgaccttactgatatgcagtaccataaagactatccaaccatataccatctgcgccacgccttgatgacacaggatgaaaagtttgacatccgaatggtgtatctcgcaattcaccatatcgtaaaatacagagggaacttcctaaattcgacccccgtggattcatttaaggccagcaaggtcaacttcgtggaccagtttaaaaagctgaatgagctctatactgctattaaccctgaggaaagtttccaaatcaatttagcaaactccgaggatataggacaccagtttctggacccatctattaggaaattcgacaagaaaaagcagatccccaaaattgttcctgtgagcgtcgatgacaaggccacagataagatcaatggcaaaatcgcttccgaaattataaacgccatccttggctacaagtcaaaattggacgtggtagttcagtgcaccccagtggatagtaagagctgggcgctgaaattcgacgaggaggatattgacgcaaagctacaaaagatcctcccggaaatggatgagaatcagcagtctataattgccatcctgcagaacctttactcccaagtcacgctgaatcagatcgtgcccaacgggatgtcattgagcgaaagtatgattgagaaatataacgaccaccatgatcacctcaagctgtacaaaaagatcattgaccagttagctgaccctaaaaagaaggccgcactgaaaaaggcttattctcaatacgtgggagatgacggtaaagtcatagaacaggccgatttttggtccagcgttaagaaaaatctcgacgattcggacctttctaagcagatcatggatctgattgacgcggagaagttcatgccaaaacagcggacttcccaaaacggcgtgatcccccatcagttgcaccagcgtgagctagatgaaatcattgagcaccagtcaaagtattacccttggctggccgaaataaatccaaacaaacatgacctccacctggcaaagtataaaatcgaggaacttgtagcttttcgcgtgccctactacgtcgggccgatgattacccctgatgaccaagccaagagtgctgagacagtgttcagctggatggagagaaaaggaaaggaagccggccagatcactccctggaattttgatgagaaggttgacaggaacgcatccgccaatcggttcattaaacgaatgaccacaaaggacacctatctgatcggtgaagatgtgttgccagacgagtctctcctgtacgaaaaatttaaggtcttaaacgagctgaatatggtgcgcgtaaacgggaaactactcaaggttgctgataagcaggcgatattccaggacctgtttgagaattataaacatatcagcgtgaagaaacttcaaaactacattaagtcaaaaacgggattgcctagtgatcccgaaatctccggcctgagcgacccagagtatttcaataactctctcggcacttacaatgattttaagaagctgttcgggaacaaagtcgacgaacccgatcttcaggacgattttgagaagattgtggagtggtcaacagtcttcgaagacaaaagaatcctgagggagaagttgaacgaaataacctggctcagtgatcagcagaaagacgtgctggagagctcccggtatcaaggatggggtcgcttatctaagaagctgctaactggcattgttaatgaccagggggaaagaatcattgatgagctctggaacacaaataaaaacttcatgcagatccaatcggacaatgattttgcaaagaggatacacgaggccaacgctgaccagatgaaagccgtggatgtagaagacgtcctggcagatgcctacaccagccctcagaataagaaagctatccgtcaggtggttaaggtggtcgacgatattcaaaaagccatgggaggcgtggcaccaaagtacatctccattgagttcacgcggtcagaagaccgaaacccgagaaggaccatcagtcgccagcggcagcttgagaatacattgaaggatactgcgaaatctctggctaagagcataaaccccgaactcctgtccgagttagacaatgccgcaaaatcaaagaaaggtctgattgacagactttatttgtactttacccagctcgggaaggatatctatacaggcaagcctatcaacattgacgagatcagcacttacgatattgaccatatactgccacaagccttcgtaaaagatgactctctaaataacagggtgctggtttccaaggctatcaataacggaaaaagtgataacgtccccgtgcagctctttggcgccaagatggggcacttctggaaacagctggcagaagctggacttattagcaagcgcaagttgaaaaatctgcagaccgaccctgatacaatctctaagtatgccatgcacggttttattcgacggcaattagtggagacctcccaggtcatcaaactcgttgcgaacatactgggcgacaagtaccgtaatgatgacactaaaatcattgaaatcacggccagaatgaaccatcagatgagggatgagttcgggtttattaagaatcgcgaaatcaacgactatcaccatgctttcgacgcataccttacagcctttctgggacggtacttgtatcacagatacataaagctcaggccatatttcgtgtacggcgattttaaaaagttcaaagaggacaaggtgaccatgcgaaatttcaactttctgcacgatctaactgacgatacccaagagaaaattgctgacgccgaaacaggtgaggtaatctgggatcgcgaaaattcaatccagcagctgaaggacgtctatcattacaagttcatgctcattagtcacgaggtgtataccctgagaggggcaatgtttaaccagactgtttaccccgcgagcgatgccggcaaacggaaacttataccgatcaaagctgacaggcctattaatgtgtacggaggctattcggggtccgccgatgcatacatggctatcgtccgtattcataacaagaaaggagacaagtatcgcgtggttggtgtgccaatgcgggccagagataggttggacgcagccaaaaaggtatctgacgctgattacgaccgagcgctgaaggatgtcttaacaccccaactcacgaaaaccaagaaaagccggaagactggcgagatcacacaggtggtggaagacttcgagatagtcctggggaaagttatgtatcgccagcttatgatcgatggagacaagaagtttatgctgggctcaagtacctaccagtataatgccaaacaactggtgctctccgatcagtctgtaaagacactggcaagcaaaggtagattggaccctctgcaggaatccatggattacaacaatgtgtacactgagattttagacaaggtcaaccagtatttctcactctacgatatgaacaaatttaggcacaagctgaatcttgggttcagcaagtttatcagtttccccaaccataatgtgtttgacggcaacaccaaggcttcttccggaaagcgggaaattctggaggaggttttgaatggcctccacgccaacccaacgttcgggaatctgaaagacatcggaataaccacacctttcggccaactacagcagcccaacggtattctgcttagcgatgaagccaagatccgatatcagtcgccaactgggctctttgagagaaccgtgtcactgaaagacttgtga

SEQ ID NO: 3154 - RNA, 4116 nt, synthetic construct
  misc_feature 1..4116: note = Cas9 variant
  source 1..4116: mol_type = other RNA
atgaaggtgaacaattaccacatcggcctggacattgggaccagctccataggatgggtcgccatcggtaaagatggcaagcccctcagagttaaagggaagacagctattggagcaaggcttttccaggagggcaaccctgccgcggaccggcgcatgtttcgaactacgcgtagaaggctgtctcggcgcaaatggagattgaagttactggaagagatcttcgatccatatattaccccggtggactcaacatttttcgctaggctaaagcaaagtaatctcagccccaaagattcccggaaggaatttaaaggttctatgctgttccctgaccttactgatatgcagtaccataagaactatccaaccatctaccaccttcgccatgccttgatgacacaggacaaaaagtttgatatacgaatggtatatctcgcaatccaccatattgtgaagtacagagggaatttcctgaactcgacccccgtcgactcatttaaagccagcaaggtggatttcgttgaccagtttaaaaagctgaatgagctctatgctgcaatcaaccctgaagagagtttcaaaattaatttagccaactccgaggatatcggacaccaatttctggacccatctataaggaagttcgacaaaaagaagcagattcccaaaatcgtgcctgtcatgatgaatgataaggtgactgaccggcttaacggcaaaattgctagcgaaatcatccacgccattttgggctacaaggcgaaactggatgtagttctacagtgcacaccagtggactccaagccgtgggcactcaagttcgatgacgaggatatagacgccaaactggaaaagatccttcccgagatggatgagaatcagcaatcaattgtcgctatcctgcagaacttgtacagtcaggtgaccctcaatcagatagtgcctaacgggatgagcctgtctgaatccatgattgagaaatataacgaccatcacgatcatttaaagctgtacaaaaagctcatcgaccaacttgccgacccaaagaaaaaggcagtcctgaaaaaggcttattcacagtacgttggagatgacggtaaagtgatcgaacaggccgagttttggagcagtgtaaagaagaatttggatgactctgaactatccaaacaaattatggatctgatcgacgcggagaagttcatgcccaaacagcgtacgagccagaacggcgtgattcctcaccagctccaccaacgcgagctggatgaaataatcgagcatcagtcgaagtattacccatggcttgtcgaaattaatcccaacaaacacgacctgcatttggccaagtataaaatcgagcagctcgtggcatttagagttccgtactacgtggggcctatgatcactcccaaggatcaggctgaatctgccgagaccgtcttctcctggatggagaggaagggaacagaaactggccaaattaccccatggaattttgacgagaaagtggatcggaaggcttcagccaaccgattcataaaacgcatgacaaccaaggacacgtatctgatcggtgaagatgtattacctgacgagagtctgctatacgaaaaatttaaggttctcaatgagctgaacatggtgagagtcaatgggaagctgttgaaagtggcagacaagcaggccattttccaggatctgtttgagaactataaacacgtcagcgtgaagaaactccagaattacatcaaggctaagactggactgccctccgacccagaaatttctggccttagcgatcccgagcatttcaacaattcactgggcacatataacgactttaaaaagttgttcgggagtaaagttgatgaacctgacctccaagatgactttgagaagatcgtggagtggtccaccgtattcgaagataaaaagatactgagggagaagttaaatgaaatcacttggctgagcgaccagcagaaagatgtcctagagtcttcacggtaccagggatggggtcgcctcagtaagaaactgcttacaggcattgtgaacgaccaaggggaaagaatcattgataagttgtggaacaccaataaaaacttcatgcagatccagagcgacgacgattttgcgaagaggatacacgaggcaaatgccgaccaaatgcaggctgttgatgtggaggacgtcctggccgatgcatatacgtccccacagaacaaaaaggccattcgtcaggtggtaaaggtggttgacgatatccaaaaagctatgggaggcgtcgccccgaagtacatttctatcgagttcacccggtcggaagaccgaaatcccagaaggacaataagccgccagcggcagctcgaaaacactctgaaagataccgcaaagtccttagcgaaatcaatcaatcctgagctgcttagtgaattggacaacgctgccaagtctaagaaaggtctcacagatagactgtacctatattttactcagctggggaaggacatttacaccggcgagccaatcaatattgacgagctcaacaaatatgatatcgaccacatactgccccaagcattcattaaggataatagccttgacaacagggtgttggtgctgacagccgtcaataacggaaaatccgataatgttcctttacgcatgtttggcgctaagatggggcatttctggaagcagctcgccgaagcaggactgatctcaaaacgaaaacttaagaacctgcagaccgacccagatactatcagcaagtacgctatgcacggttttattcggcgtcagttggtggagacgtctcaagtgatcaaactcgtagccaacattctgggcgacaagtatagaaatgatgacacaaagataatcgaaattaccgcgaggatgaaccatcagatgcgcgatgagttcgggtttatcaaaaatcgggaaattaacgactaccaccacgccttcgatgcttatctaactgcatttctgggaagatacctctaccataggtatatcaagctgcgaccctacttcgtctatggcgactttaaaaagttccgcgaggacaaagtgaccatgcggaatttcaactttcttcacgatttgacagacgatacccaggagaagatagccgacgctgaaactggtgaggttatctgggatagagaaaattccattcaacagctgaaggacgtgtaccattataaattcatgttaatcagtcacgaggtctacacactccgtggggccatgtttaaccagacggtgtatccggcaagcgatgcgggcaagaggaaactgattcctgttaaggccgaccgcccagtgaatgtatacggaggctactctgggtccgctgatgcctatatggcaatcgtccggatacataacaaaaagggagacaaatacagagtggtgggtgtccccatgagggctcttgatcgactggacgccgcaaagaatgtttcagatgccgacttcgaccgggctctaaaggatgtgctcgcgcctcagctgaccaaaactaagaaaagtcgcaagacaggcgagattacccaagtaatcgaagactttgagatcgtgttggggaaagtcatgtatagacagctgatgattgatggagacaagaagttcatgttaggcagctcgacataccagtataacgccaaacagctcgtgctgtccgatcaatctgttaagactcttgcaagcaaaggtaggctggaccccttgcaggaatcaatggattacaataacgtgtataccgagatactcgacaaggtcaatcagtactttagtctgtacgatatgaacaaattccggcacaagctaaacctggggttttccaagttcatctcttttccaaatcacaacgtgcttgacggcaatacgaaagttagctccggaaagcgagaaattctccaggagatcctgaacggcttgcatgctaatcctaccttcgggaacctgaaagatgtgggaattacaactcccttcggccaattacagcagccaaatggtatcctcctgtcagacgagaccaagataagatatcagagcccgacagggctttttgaacgcactgtcagtctgaaagacttgtga

SEQ ID NO: 3155 - RNA, 4116 nt, synthetic construct
  misc_feature 1..4116: note = Cas9 variant
  source 1..4116: mol_type = other RNA
atggacaagaaatacagcatcggcctggatattgggaccaactccgtgggatgggccgtcataacagacgattataaggttccctctaaaaagttcaaagtgctcggtaatactgacagacactcaatcaagaagaaccttattggcgctctgttgtttgatagtggggagacggcagaagccaccaggttaaaacggacagcgcgccgacgttacactagaaggaagaatcggatctgctatctgcaggagattttcagcaacgaaatggctaaagtagacgattcctttttccatcgcctagaggaatcttttctcgtggaggaggacaagaaacacgaaagacatcctatcttcggaaatatagtcgatgaggtggcctaccacgaaaagtatccaaccatctaccatctgaggaagaaacttgcagactcgacagataaggccgacctgcggttgatttatctcgctctggcacacatgatcaaatttcgcggccacttcctgattgagggtgatctcaacccggacaattcagacgttgataagttatttatccaactggtgcagacctacaaccagcttttcgaggaaaatcccataaacgccagccgagtcgacgctaaagccattttgagtgcgagactgtccaagtctaggcggctagagaatctcatcgcacagctgcctggggaaaagaagaacggactttttggcaatctgattgccttgagcctcggcctgactccaaacttcaagtccaattttgatttagctgaggacgccaaactgcaactctcaaaggatacatacgacgatgaccttgataacctgttggcacagatcggggaccagtatgctgatctattcctggccgcgaaaaacctcagtgacgccaccctgcttagcgacatcctgcgtgtaaattctgaaattacgaaggcacccttgtccgcttcaatgataaaacgctacgatgagcatcaccaggacctcactctgttaaaggccctggtgagacaacagctacctgagaagtataaagaaatcttctttgatcagagcaagaacggatacgctggttatattgacggcggggccagtcaggaggagttctacaaatttatcaagccaatactcgagaaaatggatggaaccgaagaactgcttgcaaagttgaatagggaggacctgctccggaagcaacgaacattcgataacggctctattccccatcagatccacctgggtgaacttcacgccatcctgcgcagacaggaggacttttatcctttcttgaaagataatagggaaaagattgagaaaatcctcacttttcggattccatactacgttgggccgctggctcgcggaaactccagattcgcgtggatgacccgtaagagcgaagagacaataaccccctggaattttgaggaagtggtcgacaaaggcgcatcggcccaatctttcatcgagaggatgacgaactttgataagaatttacctaacgaaaaggtgctgccaaaacattccctactctatgagtacttcactgtgtataatgagctgacaaaggtcaaatacgttaccgaaggcatgcggaagcccgcttttctttcaggggagcagaaaaaggccattgtggacttgctgttcaaaactaaccgaaaggtaacagtgaagcagctcaaagaagattatttcaagaaaatcgagtgttttgacagtgtcgaaatcagcggagtggaggacagattcaatgcatccctgggtacctaccacgatttactgaagattataaaagacaaggattttcttgacaacgaggaaaatgaggatatcttggaagacattgttctcacgctgaccctattcgaggataaggaaatgatcgaggagaggctgaaaacatatgcccatctctttgacgataaggtgatgaaacagctgaagcgccggcactacactggctgggggagactttctaggaaattgattaacggaatccgcgacaagcaaagcggcaagaccatactggatttcttaaaatcagacggttttgctaaccgaaatttcatccagctcattcatgatgacagtctgacatttaaggaagccatccagaaagcacaggtctccgggcaaggccacagccttcacgagcagattgcgaacctggctggatctcctgccatcaagaaaggcatattgcagtcagtgaaggtagttgacgaactcgtgaaggtcatggggcataaaccagagaatattgtgatcgaaatggcacgggagaaccagactacccaaaagggacagaaaaatagtcgtgagagaatgaagaggattgaagagggtatcaaagaactgggcagccagatactaaaggagcaccccgtcgagaacacacagctgcaaaatgaaaaactctacctgtattaccttcagaacgggcgcgatatgtatgtggaccaggagttggatatcaatcggctgtccgactacgatgttgaccatattgtgccgcaatctttcatcaaggatgactcgattgataacaaggtattaaccagaagcgacaaaaataggggaaagtccgatgacgtcccttcagaagaggtggttaaaaagatgaaaaactattggcgacagctcctgaatgccaaacttatcactcagcgcaagtttgacaacctgacgaaagctgaacggggcggtctaagtgagctcgataaggccgggttcataaaaagacagctggtggagacaaggcaaattaccaagcacgtcgcacagatcttggactctcgtatgaatactaaatacgatgaaaacgacaagctgatccgcgaggtgaaggtaattaccttaaaaagcaagctcgtgtccgattttcggaaagacttccagttctataaggttagagaaatcaacaattaccaccatgctcacgatgcctacctgaacgcggtcgtgggcacagcccttattaaaaagtatcccaagctggagtcagaatttgtgtacggagactataaagtctacgatgttaggaagatgatagctaaaagcgagcaggagatcggcaaggcaaccgccaaacgattcttttattctaatattatgaacttctttaagactgaaatcacattggctaatggggagattcggaagcgcccactcatcgaaacgaacgaggaaaccggagagatagtgtgggacaaaggtagagatttcgccactgtgaggaaggtactgtccatgcctcaagtcaatatcgtgaaaaagacagaggttcagaccggcgcactaacaaacgaaagtatttacgcgcgggggagctttgacaaactgatctctcgaaagcatagattcgagtcctcaaaatatggaggctttggtagtcccactgtgacctacagcgtccttgtggttgccaagtcgaaggtgcaggatgggaaagtaaagaaaattaagacgggcaaagaactcatcggaataaccctgttggacaagctggtcttcgagaagaatccattaaaatttattgaggacaagggctacgggaacgtgcagatcgataaatgcatcaagctccccaaatattccctgttcgagttcgaaaatggaacacgcaggatgcttgcttctgtgatggccaacaataacagccgtggcgacctgcaaaaggcaaatgaaatgtttttgcctgctaagctcgtcactctgctataccacgcccataaaattgagtcaagtaaggaactggagcacgaggcatatatacttgatcactacaacgacctctatcagctgttgtcctacatcgaacggttcgcctctttatatgttgatgtggagaaaaacattagcaaggtaaaagaactgttttccaatatcgagtcatacagcattagtgaaatctgttcttccgtgataaacctcctgacccttacagctagcggtgcgccagccgacttcaagtttctggggactaccatcccgagaaagaggtacggatcgccccagtcaattttgtctagtacgctaatccatcaatccattacaggcctgtatgagacccgcatcgatctcagccagctgggttctgactga

SEQ ID NO: 3156 - RNA, 4119 nt, synthetic construct
  misc_feature 1..4119: note = Cas9 variant
  source 1..4119: mol_type = other RNA
atgaacaatgagtacttcgtgggctttgacatcgggaccaacagcgtcggagccgctgttacagatgaaaagtatcacgtgctgaaattcaagggtaatgcaatgtggacttccgccgtatttgagtctgcgcagcaatcagctgacagaaggctcaaccggacggcccgccgacgtcttgatagaagtcagcagaggcgggacctgttgcaggaattaattgcacccgccataacccctgtggatccacgcttctttgacagaatcagggagagcgctctgtgggcagaagataaaacaactggctcccggttcacctacttttctgacgaggggtatacagataagcaataccataaagagtatccgaccattcaccatctaatctgctcgctcatgaatgaccccgcccctcacgatccacgcctggtctacattgcttgttcatatatgcttactcatcgaggacacttcctgaacgaagccgacaaggagaagatcgatgacgtgttggacataagaagggtttttaatgaactctgcagctggttcacaagttacggcatcgaggtgcccttttcctgtttccctgaggaatttggtaacgtcctgaccgcgaatcggggagtgcaggatcgtacgcgcgcattctacgacctcctgttcgccggaaagaagccaaaaccctctgaggatgaccaggtagatattgacgttttaatcaagctgattagcggcggcaaaatcgaactttccaagttgtttctgaacgaggaatattcagagctagagaataacaagatacagctcagtgatgctgggttcgacgaaaaagagcctgaactgagaagcgagcttggagatgactttggtctggtggccgcagctaagaatatttacgattggtctttgctcactggcgtcctgggggaatgcaaatccatctcagaggccaaggtgaaaacctatgagaagcacagcgaagacttagcggccctgaggcgggtggtccgaaaataccatccagacaagtataaggagattttcaaaaagtacgttgtgggaaactatacaagttactctggcaatgtaaaatccgcaggtaagatcagcgaaactaaactcaagcgctgtaaccaagctgagttttgcgattaccttaagtcgaaactgaaggacgtgaaaccggcccccggggatgacgaatgtgagagagtcttgaaggagatctctaaacacaccttctgccctagacaggtgacaaccgataaccgggttattccatatcagctatactatacggaactgaagaaggtgctcgagaatgctaaacgctacataccccagctgaacgtcactgacgaatatggatccgccgcagataagatcctttcactgatgacatttaggattccttactatgtgggcccattggttaaaaagaatgacagtagcaacgcctggatcgtaaggcgtggcgaggggcggatactcccctggaatttcgatgagctggtggacaaagataagtgtgaagacgagtttattcgaagaatgacctgcaagtgtacttacatcgctgggaaaaacgtcttaccgaaaaattccctgctatactgcaaattcatggtgctcaacgaaatcaataacattaagatcaatggtgagaggatttctgtcggcgataaacaaaagatatatacagaactgtttgagaaaaagcgcaaggtgaccgttcgggacatcagaaaccttttgacgagcgaggggaggctgaaagcgggagacaccttcggcggtattgatatcacagtgaagtcaagtctcaaacctcagcatgacctgaagcgccttatggcagccggggtaatcactgaagctgatgccgaggaaattatagagcgaattacctgcacaactgacgtctcccggctgcgtacctggttgggcaaatttggactcagcgcagccgatgctaagtacgtgtctggcctgaagtattcagacttcgggagattaagtagggagttcctgacagaagttaatgatgtggaccccgccaccggagaggtcatcaacccaaatatcattactatgatgtgggaaaacaacatcaatctaatggagctcctgagccagaaatactcctatcgctctcaaatagaatcgatgaaccgggagtactatgcagcgaatcctcttacgttggatgaaagaatgagcgagatgtacatcccctccgctgtgaggcgaccagtaaagcgcacaattgagatgatgaaagaatacatgcacatcatgcggaagccccctaaaagaatttttatcgagatggccagggaactgaccgacctcgataacaagggtaagcgtacttcaagtcgccggaataccctgttagagttctttaaaaagtgtccacaggacacaaccgagctgagagcacagcttgagaaaaagtctgatgacgaattgaggagcgaaaaactctatctgtacttcgcccagctaggcaagtgcatgtattccggggagtcaatagacattgaacgactgggaagcaagctctacgatgtggaccacatctttccgcaagctcgggttaaagatgactctattgagaacaaggtcctggtgctttccgatttgaatggcgccaaaagtgaccgctatcccatcaacgcagatataagaaataagatgcatagcttctgggacaaactgcactctatcggtttaattggggagaagaaatacgaaaggctcactcggtccacaggctttacggatgacgagctggctggattcatctcacgacagcttgtggaaaccagacagagtactaaggccgtcgcggccctgttggctgaggaatttcctgagagcgagattgtttatgtgaaggcaggcctcgcctcgcagttccgccatgaatttgggctgctaaaatgtagggagatcaacgatctgcaccatgctaaggacgcctacctcaatatagtgatgggaaacatttaccacgtaaaattcacaaaggacccaatgaattttgtcaaagaatatcgtcggaaggagcaagtgttcgatctgaagatccagtccatgcttacccacgacgcaatcagaaacggtgaaacagcgtggattggcgatgggacttggttggagaccgttaaaaagcagatggagaaaaataacatcaggtacgtgcgctattctttccgaagaaagggagccctgtttaacttaatgcccgaacggaaaaatcctagcctcctgccaaggaagaacggcaagaatatggtccttcccgctgagaaatacggtgggtataacaatacggccgcatcattctttagtctggtgaagtaccattccgctaaaggctctggagttgtgattataccggtagaactaatccacgcccatcgctatgagcacgacagctccttcgcagaggaatacgccctccgtgtcctggctgatattgtgtcattgaagaaaggcgacgtgctgcagagcgtcgagtttcctttagggagtagaatcctcaaggttaacaccctgcttgatattgacggattccgggcgaatatcacaggcaaggattctggtgggaaatacctgggaatatccagcgcctcgtcattgatcatttctcaagtggacactacctatatcaagagggtaattagtatcaacgaacgcatatccgcatgcgagaaaaataagcagagctacacaattcgaccagaatttgatgtgatcacttctgagagaaacatcgagatttataatatgctctgtgagaaaataagctcccggcccttctgcatcaagtttgctaacacctcagacacgttcgtcagtggcagggaaaagtttattgccctgagcctaaatgaacaggtgaaaacactgaccaacatgctttctgttttcaagactggtcgcgcctccggctgtgatctcacaaatatcgggggaagtaaaaacaccgctattgtgaagctgaacgcagtcttgtcaaatctgaaagacttcaagagcgtgagaatcatagaccagtcccctactggcttatacgagaaagtttctcccaacctcctgtcgctttga

SEQ ID NO: 3157 - RNA, 4119 nt, synthetic construct
  misc_feature 1..4119: note = Cas9 variant
  source 1..4119: mol_type = other RNA
atgaccaagaaaaactacagcatcggcctggacattgggacaaattccgtgggatgggccgtcataactgatgactataagatccccgctaaaaagatgaaagttctcggtaacacggataaggagtacattaagaaaaatcttctgggcgcattgttattcgactctggggaaaccgccgaggcgacaagactgaagaggactgctcggcgccgatatacccgtagaaagaacaggctacggtacctccaggaaatctttgccgaggaaattgcaaaggccgataattcattctttcaacgcctggacgagagtttccttacagatgacgataaagactttgatagccaccctatcttcggaaacaaggctgaggaagacgcatatcatcagaagttttccaccatataccacctgagaaaatatttggccgattctccagagaagtcggacctcaggctggtgtacctggctctcgcccatatgatcaaataccggggccacttcttaattgaaggtgagctgaaggcggagaatactgacgtacagaaactttttacagatttcgtggaagtctatgaccgcacctttgatgactcacatttgagcgaggtgacggttgatgcaagttccatcctgactgaaaagatttctaaaagccgaagactagagaacctcatcgaatcctacccgaaggagaagaaaaataccctgttcgggaaccttatagccctgtcattgggactccagcccaattttaagacaaacttcaaactgagtgaggacgctaagttacaattcagcaaagatacttatgaagaggacctggaagaggtgctcgaaaagattggcgatgactacgccgatctttttacctctgcaaagaatctgtatgacgctatcttgctatccggcattctgacagtcgacgattcaagcaccaaagcccctctcagtgcgtctatgatcaagaggtacgccgagcaccacgaggacctggaaaaacttaaggcattcatcaaaacgaacaagccaaatctgtatcatgatatttttaaggacgagactcagaacgggtacgctggatacatagaaaacggtgtgaaacaggatgagttctataagtacttgaaaacaatcctctccaagaccgacggcagcgaatattttctggataaaattgagcgggaggacttcttacgtaagcagcgcacttttgataatgggtcgatcccccaccaaatacatctgcaggaaatgcacgccattctaagaaggcagggagactactatcctttcctcaaggagaaccaggatcggatcgagaaaatcctgacatttcgaatcccatactatgtaggcccccttgctcgcaaaaattctagattcgcctgggcagaataccactccgacgagaaaattaccccttggaactttaataaggttattgataaagaaaagtcagccgagaaattcataacgaggatgaccttgaacgacctgtacctcccagaagagaaggtgctgccgaagcatagtcacgtctatgaaacatttgctgtgtacaatgagcttactaaaatcaagtatgtgaacgagcaaggtaaagaagcgttcttcgacagcaatatgaagcaggagatttttgatcatgtcttcaaagaaaaccggaaggttaccaaggagaaactgttgaattacctcgacaaggaatttcccgagtatcgcatccaggatctgatcgggttagacaaagagaacaagtccttcaatgcatctctgggaacataccacgatctaaagaagattctcgacaagagctttctggatgacaaagtgaacgaagaggtaatagaagatatcattaagactcttaccttgttcgaggacagagaaatgatccaacagaggctgcataaatattcagatatttttagtacacagcagctcaagaaactggagcgtcggcactacaccggctggggccgattatcctacaagctgatcaatgggataagaaacaaggagaacaataaaactatccttgaatatttgattgacgatggatacgccaacaggaatttcatgcaactcatcaacgacgacacgctgccttttaagcagattatcaaagatgctcagataattggtaatatcgacgatattgccgcagtggtccacgagctaccaggcagccccgccatcaagaaagggatactgcagtctatcaagattgtggacgaactcgttaaagtgatgggacataaccctgataatatcgtcattgagatggctcgcgagaaccaaacaaccaatcggggcagatcacagagtcagcagaggctgaagaaacttcaagacagcttgaaagaactgggttccaacatcttaaataagaaaaagccatcttatgtggaggataaagtagaaaacgttcacctccaggacgatcgcctgttcctttactatatacagaatgggaaggacatttacactggcgaggaactggatatcgaccgattgtcggactatgatatcgaccatattatcccccaggcctttattaaggatgacagcatagataaccgggtgctcacctcctcagcgaaaaatcgtggaaagagtgacgatgtcccgaacctggacatcgtgagagcaaggaaagctgattgggtccgcctatacaagtctggcctgattagcaaacggaagttcgacaacctcacaaagtccgagagagggggactgaccgaggccgataaagcaggttttatcaagaggcaacttgtggaaactcgacagattacaaaacacgttgcccagatcttggacgctcgcttcaatacggagcacgatgaagacgacaaggtgatacggaacgtaaaagtcatcaccctgaagtcaaatttaattagccaattcagaaaggattttaaattctacaaggtgagggagatcaacgactatcatcacgcccatgatgcatacctcaatgctgttgtgggcactgccctgcttcgtaaatatcctaagctggcgcccgaatttgtctacggggagtataaaaagtacgacgtgcgcaagctaattacatcttccagtgataaagccaccgctaagtatttcttttacagcaacctcatgaatttctttaaacgggtagtgagatactctaacggaagggttatcgtccgaccagtgatagagtattccaaggacacaggcgaaattgtgtggaataaagagactgatttccggaccatctgcaaggtcctgtcataccctcaggttaacatcgtgaaaaaggtggaaagtcagacgggtgggtttagcaaggagtcgattttgcccaaaggcgactccgataagctgataccacgcaaaaccaagaaagtatattgggacacaaagaagtacggaggcttcgattctcccatcattgcatatagcgtctttgtggttgccgacgtggaaaaagggaaggctaaaaagctcaaaaaggtcaaggagttagtgggaatctcaattatggagagacctagtttcgagaaaaatccaatcgttttcctggaaaagaaaggttacaggaacgtgcaggaagatactcttataaagctgccgaaatattccttgtttgagttcgagggcgggcggcgaagactcctggcctctgcaagcgaactacaaaagggaaatgaggtagtcctgtccgaccgccttgtggaactcctgtaccacgcgcatagggtgaactcatttaatagcaccgagcacttgaagtacgtcagtgaacacaaaaaggagttcggcgaggttctgtcttgtgtggaaaactttgccaactcctatgtagacgtggagaaaaatttagataagatccgtgctgtcattaacaaaatcgacacattcagcattgaagagatctcgacttcatttgtgaatctcctgacccttacggccctgggtgcacccgctgatttcaactttttggggaagaaaatacctcggaagagatacacatctaccaaggaatgcctcaatgccactctgattcatcagagtatcacaggcctatatgagaccaggatcgacctgtccaaacttggagaggataagtga

SEQ ID NO: 3158 - RNA, 4119 nt, synthetic construct
  misc_feature 1..4119: note = Cas9 variant
  source 1..4119: mol_type = other RNA
atgaccaagaaaaactacagcatcggcctggacattgggacaaattccgtgggatgggccgtcataactgatgactataaggttcccgctaaaaagatgaaagtgctcggtaacacggataagaagtacatcaaaaagaatcttctgggcgcattgttattcgactctggggagaccgccgaagcgacaagactgaaaaggactgctcggcgccgatatacccgtagaaagaacaggctacggtacctccaggagatttttgccaatgaaatcgcaaaagtagatgagtcattctttcaacgcctggacgaaagtttccttacagatgacgataagacctttgacagccaccctattttcggaaacaaggccgaggaggatgcttatcatcagaaatttccaactatctaccacctgagaaagcatttggcagactcctctgaaaaagccgatctcaggctggtgtatctggctctcgcccacatgataaagttccggggccactttttaatcgagggtgaactgaatgcggagaacacagacgtccagaaaattttcgcagactttgtgggggtttacaatcgcaccttcgatgactcgcacctttcagagatcacggtggatgtcgccagcattttgactgaaaagatcagtaaatcccgaagactggagaacctaataaagtactatccgaccgaaaagaaaaatacactctttggaaacctgattgctcttgccctgggcttgcagcccaatttcaagactaacttcaaactctctgaggacgcaaagctgcaatttagcaaagatacctacgaagaggacttagaggaactgctcggcaagatcggggatgactatgctgatcttttcacatccgccaagaatctgtacgacgcgattttgctatcaggaatcctgaccgtggatgacaacagtacgaaagcccctctcagcgcatctatgatcaagaggtatgtagagcaccatgaagacctggagaaacttaaggaatttattaaagctaacaagtccgagctgtaccacgatatattcaaggacaaaaataagaacggttatgccggctacatcgagaatggggttaaacaggatgaattttacaagtatttgaaaaacattctctcaaagatcaagatagacggaagcgattacttcctggacaaaattgagcgggaagactttttacgtaagcagcgcactttcgataatggcagtatcccacatcagatccatctgcaagagatgcacgctattctaagaaggcagggtgattattacccctttctcaaagaaaagcaggaccggatcgagaaaattctgacattccgaataccttattacgtggggccacttgtccgcaaggattctagatttgcctgggcagagtataggtccgacgaaaagatcaccccctggaacttcgataaagtgattgacaaggagaaaagcgccgaaaagtttatcactcggatgacattgaatgacctgtacctccctgaggagaaagtgctgccaaagcattcgcacgtctacgaaacctatgctgtttacaacgagcttacgaaaatcaagtatgtgaatgaacagggaaaggagtctttcttcgattccaacatgaaacaagaaatttttgaccatgtattcaaggagaatcgcaaagtgaccaaggagaaactgttgaactacctcaataaggaatttccggagtatagaataaaggatctgatcggcttagacaaagaaaacaagtcattcaatgcgagtctgggcacataccacgatcttaaaaagattctcgacaaagcatttctggatgacaaggtcaacgaggaagtgatcgaggatattatcaagactcttaccttgttcgaggacaaagatatgatacatgaaaggctgcagaagtatagcgacatctttacagccaaccagctcaaaaagctggagcgtcggcactacactgggtggggacgattatcctacaaactgattaatggtatcagaaacaaggaaaataacaaaaccattcttgattatttgatcgacgacggctctgctaataggaacttcatgcaactcataaatgatgacacactgccctttaagcagattatccaaaagagccaggttgtgggggatgtcgacgatattgaggccgtggtacacgacctacctggatcaccagcaatcaaaaagggcatactgcagagtgttaaaatcgtggatgaactcgtcaaggtgatgggtgggaaccccgacaatattgtcatcgagatggcccgcgagaaccagaccactaatcggggcagatcccagagccagcaaaggctgaaaaagctacagaactctttgaaggaactgggatcaaatattttaaacgaggaaaaacctagttacatcgaggataaggtggagaatagccatctccagaacgaccagctgttcctttattacatacaaaacggcaaagatatgtatacgggggacgaactggacattgatcacttgtccgactacgatatcgaccatatcattccacaggcttttatcaaggatgactctattgataatcgcgttctcacatcgagcgccaaaaaccgaggaaagtccgacgatgtgccctcactggacatagtacgggcacgtaaggcggagtgggtcagactatataaaagtggtctgatctctaagaggaaattcgataatctcaccaaggctgaacgcggcgggctgactgaggccgacaaagcaggatttattaagcggcagcttgtggaaaccagacagatcacaaagcacgttgcccaaattttggatgctaggttcaacaccgagcacgacgagaatgacaaagtgatccgagatgtcaaggtgataactctgaaaagcaacttagtatcccagttccgcaaggactttgagttctacaaagtgcgggaaatcaatgattaccatcacgcccatgacgcatatctcaacgctgttgtcggcacagccctgcttaagaagtacccgaaactggcgtcagaatttgtgtatggtgagtacaagaaatatgatattagaaagttcatcacgaatagctctgacaaagccaccgctaagtactttttctattccaacctaatgaactttttcaaaactaaggtgaagtacgcagatgggacagtctttgaaaggcctattatcgagaccaatgccgacggcgagatagcttggaataaacagattgatttcgaaaaggttcgtaaagtgctcagttacccccaagtgaacatcgtaaagaaagtcgagacacagactggaggctttagcaaggaatctatcctgccaaagggggactccgataaattgattcctcgcaagaccaaaaaggtgtattgggacacgaaaaagtacggaggtttcgattcacccaccgttgcctatagtgtgttcgtcgtggcagacgttgagaagggcaaagcgaagaaactgaagacagtgaaagaattagtagggataagcatcatggagcggtcgtttttcgaggaaaatccagtcgagtttctcgaaaacaagggataccacaacattagagaggacaagctgatcaaacttcccaagtattccctgttcgagtttgaaggcggtaggcgacggttgctcgcctctgctagcgagctgcagaaagggaatgaaatggtgctacctggctacctggtggagcttctctatcatgcccaccgcgcagataacttcaattcaactgaatacctgaactacgtcagtgagcacaagaaagagtttgaaaaggttttgtcctgcgtggaggacttcgctaatctgtatgtagatgtggagaaaaacttatctaagattagagccgtcgcagacagcatggataatttttccatcgaagaaatatcaaacagcttcatcaatctcctgacccttacagccctgggagctccagcggactttaacttcttgggcgagaagattccgaggaaacggtacaccagtactaaggagtgtctcaatgccacgctgatccatcagtctattacagggctatatgaaacccgaatcgatctgtccaaacttggagaggaatga

SEQ ID NO: 3159 - RNA, 4119 nt, synthetic construct
  misc_feature 1..4119: note = Cas9 variant
  source 1..4119: mol_type = other RNA
atgaacagcgacaagagagaggattactatgtgggcctggacatggggaccggatccctcggtggcgccgtcacagatactcagtaccaccttctgaaagttaaggggaaagacttctggtttgtgagggaatatgagacggctaagtctcaattggatcggcgcacccatcgaatcgcaaaacgtagattacagaggcacaaggcccggattggactgatacgctcatacttcgcggaagacatcctaaagcatgatcccctcttttatattagacaggacaatagtaaatactatcacgaggataaggacgtaaggctgacaactaaagatagcatcttcgctgaccctggctacggtgataaggaataccttgacgacaaagagtatccaaccatttttcatctgcggcaggccttgctccgcgatcaaatcaaggacgaggaacgatactccagattcctgtatctggcaataatcaacatgtttgagcacagggggcacttcctcttaaatacagaatcttcggatctgaacgccgacatgattaaggatgtgggagagcttgtcatgaatgctatctgcggcgtgtcagagtacggcagcgttacctataaagaaattatcgagatattggaagacaagaacattagtcggactgccaaaaaggatcagatcgcatccaaaattgacatcaagaaatctgagaaggctcagatggaacgtatcaagtgtctgtgcgggatggaggccgatgcgcgcgtgatgtttgagattgaagcagacgagaaaataaagatcgccttccagcaagctgcctttgaagatgagaaagaagagattgaggcagtcatcggagaagacagatacctaataattgagaatatgaagcagctctatgactacagccagctgcagtccgtgcttaacggtttcgattacctgtcagacgctagggtacaaatgtatgaaaaacataaggaggatttgcacctcctgaagaaagtttaccggaagaatttagaccgagaaatctatgatcgcatgtttagaagtggcgaggaggggagctactgtgcctattctaactccacaaattcagtggacagcctggcggaagccaaaaagtacaggcggaacatgaaaaagcgcagtcagaaggatctctatgacagaatcaaaaaggatcttaaagaggtccatgacgcagatgctgacgccattaggaaggaaatggagctggagcgtttcttgccgaaacagatcaccggagctaatggcattatacccaaccaagtgcaccggaaggaactaaagaaaatcctggagaatgccgaacaccatctcgatttcctgaaggagaaagacgaatctggttacacggtgtccgagcgaattttgatgctgtttagctcgaacatcccttactatgtcgggccagttggatctggctccaagactggctgggcaaaaatccaggagtcaggacaggtgttgccctggaacatggaacagaagattgacatagagcaaaccagtgaaagattcatcacaaatctcattagggagtgcacttacctgagcggggaaaaagtattacctaagcagtccctgctatatgagtcttactgtgtgctcaacgagatcaataacctgcgcattcacggtaagcggatcgtcccagaacttaaacaggatatatataaggaggtgtttcagggcttcagattggggaaaaaggttaccaaaaagaatatctgcacatacctgattaacaggggactcatcaccgaagagagcgaagtgtcaggcattgacaaggagatcaatgcctatctgcccagttacggtaaaatgtacggggtctttggcgagcgccttcgagaagaggctgtgcaagaaatagcggagaagattatctattacggaacgatttatggcgatgcaaaatccatgttccggaagaaactgaaccagtacgtaagcgacgggtggatgactgagtatcaggccaagcgtatctctggatacaagtttaaagattgggctagattgtcaaggagtatgctctgtctgagcggttgcgacaagtccacaggcgagaaaatatctttaatccgcgccatgtgggaatataatctgaacttcatggaactaatttaccgggaggattttaccttccagaaggaactcgaggagagaaggaaagcactggggaagactcttcaagaatttcagttcgaggacttggatgaatactattactcggcccctgttaagcgaatgatctggcaggctgtgcaggccctgaaagagattacacaaatcatgggacataatccaaagcgcatatttattgaaatgacccggacggaggaggaaaaaggcgagcagggtagaaagaacagcagggaaaaacgtctcctgaagatgtatgagtccatccgcgacgaacggaattgggcagcggagatcaaaaacgctaatgcctcagggaagttaaacagtaagaaactgtacctttattacttgcagatgggcagagatgtctataccggagagccgattgacatcgaagatctcttcgacgactctaggtacgatattgaccacatatacccccgaagcctgacaaacgataataacatcgagaataacctagtgctggtctccaagactattaatcaaaacgaaaagaaaaatgactatcctgtgccagagaaaatccggcgcaacaagaaggttagaaatctctggcataccctgcacaaaatgggcttcatgaacgatgagaagtacaataggcttacatcaactgaacggttgagcgaggaccagctggcagggtttattgcccgacagttagtggaaaccgctcagggagccaaaggtatcgcagagctcatgaaggctatgctgcccggcacagatatagtatatgccaaagcgagaaacgtctctgacttccgcaaggaatacaagatgcttaaatccaggctggtgaatgattatcaccatgcccaagacgcttacttgaacatcgttgtggggaatgtctattttatgaagttcacccgtaaccctatgaactttgtgaaaactgaggcacggagagatggaaggaattacgactacaacctctataagatgtacagtaaagacattatccgcaatggcgagaaggcctggattgctacgagcgaacagggtccagggacaatccgactggtaaaggagaccatgggcagaaacactcccataattacccggcaggccttcgaacagaggggagagctatttaatctgcaaccggtgggcaaatattctgcaaagaaagataactacgttcctctcaagatcaatgacgagaaaatgcaggatgtctccaagtatgggggatacacatcactgaaccccagttatttcatctttattgaacacggcccagagaagaaacgcaagaaatgtttcgaagtgatacatagctactacgcggcccagatcaagaccgagaaagaccttattgattttcttctgcagaagggttataaaaatcctcgtgtgatcaacgctagaattaagaagaatgccttaatcaaatacaacgggtatttcctctacataatcggaatggacgcacggaagaatattgaattttcgaacgctactgccatgtgcctgaaaaataagtatatccaatacgtctgtaaacttgagaagatgaacaaggcaattctgctatccgaaaaacagaagacaaacctccactgggatgagaaaatcacgtgcgagtctaatctggaattgtatagggagctgaccgaaaagcacttacatagcatataccagcgccacccccgatcaattggcaaatgcctcgccgacggtgagggcgctttcaagctgcttgatatcgaggaacaagttaagatcatttgtgacatcgtgcagtacacaagtttccagagaggggtgttttccctgaaagtattgggaggcccaaaggaggtcgggcggataaggatttctggaaacatgactgaagcgaaagagtgcaagctcgtgaattatagcatcaccggcatgtacaaaacagaaatggatctgctaaagaagtga

SEQ ID NO: 3160 - RNA, 4122 nt, synthetic construct
  misc_feature 1..4122: note = Cas9 variant
  source 1..4122: mol_type = other RNA
atggagaagacctacagcatcggcctggacattgggacaaactccgtgggatggtctgtcataactgatgactataaagttcccgccaagaaaatgaaggtgctcggtaatacggataaaaagtacatcaagaaaaaccttctgggcgctttgttattcgactcaggggaaaccgcagaggtaacaagactgaagaggactgcccggcgccgatatacccgtagaaagaataggctacggtacctccaggaaatttttgcgaaggagatggctaaagtggatgaaagtttctttcaacgcctggaggagagcttccttacagacgatgacaagacctttgattcccaccctatcttcggaaacaaggccgaagaggacgcatatcatcaggaatttccaactatttaccacctgagaaaacatttggccgattcttcggagaaggctgacctcaggctggtctatctggcactcgcccacatgatcaaattccggggccactttttaatagagggtgaactgaatgctgagaacacagatatccagaagttgttcaatgactttgtggaaacctacgacaaaattgccgatgagtcacatttgagcgaagttgacgcgagttccatcctgacgaacaagatttctaaaagccgccgactagagaatctcatcaagcagtacccgactgagaagaaaaacaccctgttcgggaatcttgtggcactggtcttgggactccaacccaactttaagacaaatttcaaactgtccgaagatgccaagttacagttctcaaaagacacttatgatgaggacctggaggaactccttggcaagataggcgatgactacgctgatctgtttaccgccgcaaagaacttgtatgacgctattctactgagtgggatcctcacagtggatgacaatagcaccaaagcccctctgtctgcgtccatgattaagagatacgaggaacaccatgaggaccttgaaaaactgaagaaattcatcaaggtaaacaactttgataagtatcacgagatcttcaaagacaagtcaaagaatggatacgccggttatattgaaaacggcgttaagcaggatatattttacaaacatcttaagagcatcattagtgagaagaatgggggacagtacttcctcgacaaaatcgaaagggaggattttctgcggaagcaacgtacgttcgacaacggctctataccacaccagattcacttacaggagatgcgcgcaatcctgagaaggcagggtgaatattacccctttctaaaagagaatcaagctaagatcgaaaagattctcactttccggatcccttattacgtggggccactggcccgaaaggattcccgctttgcttgggccaactatcatagcgacgagcccattacaccttggaatttcgatgaggtcgtggacaaagaaaagtcggcagagaagtttataaccagaatgactcttaacgatttgtacctgccagaagagaaagtgctcccgaagcactctcatgtctatgaaacattcaccgtttacaatgagctgacgaaaatcaagtacgtgaacgagcagggagaatccttctttttcgacgccaatatgaaacaggagatttttgatcacgtattcaaggaaaacaggaaggtgaccaaagctaaacttctgtcatatttgaataacgagtttgaagagttccggatcaatgacctcatcggcctggacaaagatagtaagagctttaacgcgtccttaggcacataccatgacctgaaaaagattctagataagtctttcctcgacgataaaactaacgagcaaataatcgaagacattgtcctgacccttacattgtttgaggatcgcgacatgatccacgaaagactgcagaagtatagcgatttctttacttcacagcagctcaaaaagctggagaggcgtcactacaccgggtggggacggttaagttataaactgattaatggtatccgaaacaaggaaaataacaagacaatacttgacttcttgatcgatgacggccatgcaaatagaaactttatgcaactcattaatgatgagtccctgagcttcaaaaccatcattcaggaggcccaggtggttggggacgtggacgatatcgaagctgtcgtgcacgacctacccggatctcctgccataaagaaaggcattctgcagtcagtaaagatcgttgatgagctcgtgaaagtcatgggtgacaacccagataatattgtgatcgaaatggcaagggagaaccaaactacgaatcgcgagcggagtcagagccagcagagactgaagaaacttcaaaactccttgaaggaactggggtctaatatattaaacgaggaaaagccctcgtacatcgaggacaaagtcgaaaatagccatctccagaacgatcagctgttcctttattacattcagaacggcaaggacatgtacacaggagatgagctggacatcgatcacttgtccgactatgacattgatcacatcatacctcaagcctttattaaagacaattcaatcgataacagggtgctcaccagttctgctaagaatcgcggcaaaagcgacgatgttccatccctggacatcgtgcgagcccggaaggcagagtgggtacgtctatacaagtcagggctgattagcaaaagaaagttcgataacctcactaaagcggaaaggggaggtctgaccgaggctgacaaggccggctttatcaaacgccagcttgtcgaaacacggcagattaccaagcatgtggcacaaatattggatgccagattcaatactaagagggacgagaacgataaagttatccgagacgtgaaggtcattacactgaaatctaatttagtgtcccagtttcgcaaggagttcaaattttataaggtacgggaaatcaacgattaccaccatgctcacgacgcctatctcaatgcagtggttgggacggctctgcttaagaaataccccaagctgaccccggagttcgtctatggagaatacaaaaagtacgacgtgagaaaactaattgccaagagtagcgatgactattctgagatgggcaaggcgactgccaaatactttttctattccaacctcatgaactttttcaagacagaagtgaaatacgctgatggtagggtcttcgagcgtcctgacatcgaaaccaatgcagatggggaggttgtgtggaataagcagaaagactttgatatagtgcgcaaggtactgtcatatccccaggtcaacatcgtgaaaaaggttgaggaacaaacagtgggccagaatggaggcttgttcgacaacaacattctggccaagccagagaaagatgacaagaaaaagttatttcctatcaaaaagagtctcagcactacctcgtacgggggatatgctcgggccacgattgcatactccatcctgatagtctctgagttcggtaagaataaagaacttaagctgttgggcctccccctgctagataaagtgaagtacgagaaaaacccaattgcgtatctgaatagcatcgggatcattaacgttaagtcaatatttaaacttcccaaatactgcctcttcgaatttcaggagaagaataccaactatagaaggtacatggtgagtaatcaggaactgaaacgagccaaccaattgttcctgacatgtaaggagactgaattagtatataaatacatcaagtccgacaatgataacacccatctcgtcggaaatgagaagacaattctgtctatctggaacaaacttgtgatttttatggagcggactaagctgatcgacaaaaagttgttcgctagcctcaaacagctgaaggacgaagtggatctaataaatatcctggacatgaccgccaaatcccttgattttacgaagatttcagcaggccagaagaaaatcacaattagcgacagtctctctctgcctatcaagcgctggcagttctccagcgatgagaaaatgttgaagcaattaaaaaccgctactctgatacaccagtcggtcacaggtctctatgaaaccagaattgacctgtcaaaacttggggaggaatga

SEQ ID NO: 3161 - RNA, 4122 nt, synthetic construct
  misc_feature 1..4122: note = Cas9 variant
  source 1..4122: mol_type = other RNA
atggagaagacctacagcatcggcctggacattgggacaaactccgtgggatggtctgtcataactgatgactataaagttcccgccaagaaaatgaaggtgctcggtaatacggataaaaagtacatcaagaaaaaccttctgggcgctttgttattcgactcaggggaaaccgcagaggtaacaagactgaagaggactgcccggcgccgatatacccgtagaaagaataggctacggtacctccaggaaatttttgcgaaggagatggctaaagtggatgaaagtttctttcaacgcctggaggagagcttccttacagacgatgacaagacctttgattcccaccctatcttcggaaacaaggccgaagaggacgcatatcatcaggaatttccaactatttaccacctgagaaaacatttggccgattcttcggagaaggctgacctcaggctggtctatctggcactcgcccacatgatcaaattccggggccactttttaatagagggtgaactgaatgctgagaacacagatatccagaaacttttcaatgactttgtggaaacctacgacaaaattgccgatgagtcacacttgagcgaagttgacgcgagttccatcctgacgaacaagatttctaaaagccgccgactagagaatctcatcaagcagtacccgactgagaagaaaaacaccctgttcgggaatcttgtggcactggtcttgggactccaacccaactttaagacaaatttcaaactgtccgaagatgccaagttacagttctcaaaagacacttatgatgaggacctggaggaactccttggcaagataggcgatgactacgctgatctgtttaccgccgcaaagaacttgtatgacgctattctactgagtgggatcctcacagtggatgacaatagcaccaaagcccctctgtctgcgtccatgattaagagatacgaggaacaccatgaggaccttgaaaaactgaagaaattcatcaaggtaaacaactttgataagtatcacgagatcttcaaagacaagagcaaaaatggatacgccggttatattgaaaacggcgttaagcaggatatattttacaaacatctcaagagcatcattagtgagaagaatgggggacagtacttcctcgacaaaatcgaaagggaggattttctgcggaagcaacgtacgttcgacaacggctctataccacaccagattcacttacaggagatgcgcgcaatcctgagaaggcagggtgaatattacccctttctaaaagagaatcaatccaagatcgaaaagattctcactttccggatcccttattacgtggggccactggctcgaaagaacagccgctttgcctgggctaaatatcattcggatgagcccattacaccttggaatttcgacgaggtcgtggataaggaaaagtctgccgagaaatttataaccagaatgactcttaacgacttgtacctgccagaagagaaggtgctcccgaaacactcccatgtctatgaaacatacgcagtttacaatgagctgaccaagatcaaatatgtgaacgagcagggaaaggaatcattcttcgatagtaatatgaagcaggagatttttgaccacgtattcaaagaaaacaggaaggtgacgaaagagaaacttctgaattacttgaacaaagaatttcccgagtatcggatcaaggatctcatcggcctggacaaggagaataaatcattcaacgcctccttaggcacctaccatgacctgaagaaaattctagataagtcttttctcgacgataaagtcaacgaagaggtgatagaagacatcattaagacactgactcttttcgaggataaggacatgatccacgaacgcttgcaaaaatatagcgatatttttaccgctaatcagctgaagaaactcgagagaaggcactacacagggtggggacgtctgtcatataagttaatcaacggtatacggaataaagagaacaataagactatcctggactaccttattgatgacggcagtgcgaaccgaaatttcatgcagttgatcaacgatgacaccctcccttttaaacagattatccaaaagtcccaggttgtgggggatgtcgacgacatagaagcagtggtacatgatctgccaggaagccccgccattaagaaaggcatcctacagtctgttaagattgtggacgagctggtcaaagtgatgggtgggaatcctgataacatcgtcatagaaatggctagagagaatcagacaaccaacaggggccgctcacaaagtcagcagcggctcaagaaactgcagagctcccttaaggagttgggatctaatatcattaacgaagagaagccatcgtacatcgaagacaaagtggagaatagccatctgcaaaacgatcagttattcctctattacattcagaacggcaaggacatgtatactggggatgaactggacatcgatcatctttccgactacgatatagaccacattatcccccaggcctttatcaaagacgattcaattgacaatagagttctgacgagttctgcaaagaacaggggaaaaagcgatgacgtgccgtccttggatatcgtacgcgcccgaaaggctgagtgggtccggctctataagtcaggtctgattagcaaacgtaagttcgacaatctaacaaaagccgagagaggcgggctgaccgaagcagataaggcgggatttataaaaaggcaactcgtggagactcgccagatcaccaagcacgttgctcagattctggacgcccggttcaacacagaacatgatgagaatgacaaggtgatcagagatgtcaaagtgattacccttaagtctaacttggtatcccaattcaggaaagactttgagttctacaaggtgcgagaaatcaatgattatcaccatgcacacgacgcctacctgaacgctgttgtcggcactgccttactcaaaaagtaccctaagctggcacccgagtttgtgtatggtgaatacaaaaagtatgacgtgcgcaaacttatagctaagagtagcgatgaccattctgagatggggaaagccacagcgaagtacttcttttattccaatctgatgaacttctttaaaacgaaggtcaagtacgccgatggctcagtttatgaacggccaatcattgagaccaatgctgacggagaagtggtgtggaacaaacagaaggatttcgagatcattagaaaagtactaagttaccctcaggtcaatatcgtgaagaaagttgaggaacagactgtgggccaaaacgggggactctttgacaataacatactggcaaagcccgagaaggatgacaaaaagaaattgttcccaattaagaaaagcctgtcgacaacctcctacggtggctatgccagggctacaatcgcctactctatcttaattgtcagcgaatttgggaagaacaaggagctcaaactgcttggactgcccttgctcgataaggtgaaatatgagaagaatcctatagcatacctgaactcaatcggcattatcaatgttaaaagtattttcaagctaccaaagtattgcctgttcgaatttcaggagaaaaacactaattaccgtcgctatatggtgtccaaccaggaacttaagcgggcgaatcagttgttcctgacctgtaaagagacggaattggtatacaagtacatcaaatctgacaacgataatacccacctggtcggtaacgagaagacaatattaagcatctggaataaactcgtgatttttatggagagaactaagctgatcgacaagaaacttttcgcctccctgaagcaattgaaagatgaagtgaacctcattaatatcctggacatagcttcaaagagcattgactttaccaaaatcagtgccgggcagaagaagatcgtcctaaacgattctctgtcccttccgattaaaaggtggcagttcaagagcgacgagaaaatgctcaagcagctgaatgatgcaacattgatccaccaatcgataactggcttatatgaaacccgaattgacctgtcaaaactcggagaggaatga

SEQ ID NO: 3162 - RNA, 4122 nt, synthetic construct
  misc_feature 1..4122: note = Cas9 variant
  source 1..4122: mol_type = other RNA
atgaacctgagaagggcccgggactacagcatcggcctcgatcttgggaccggatccgtgggttgggctgtcacagacgcagagggcaatctgtattctttcaaggggcgccccgccatgggatcacgaacttttcctaacgcggaaccagctagtgttgcccgtattccgagaggccagaggcggcgctacgagagaaggcggcaacgcataaaattgttacagcagttctttatgagcgatatggaacgagtggaccccgatttctttacgagactgaatcagtccaccctactcgcagaggacaaggatgaaaggatcgcctcttgcgcttggcctattttcaactcgtcagactttacagagaaagattattacaagaaattcccaactatctatcaccttcgggcatttctttgtgagagcgacgaaaagggtgatctgcgtttggtatacctcgccctgcataatattgtgaagcaccgcgggaacttcctgtatcaagacaatcccgctctcagtgcctccgatgcgtctgtcgacgaggcagtgagacagttagttgacgccctggctgaatggtgccagaacaaagagatcgagcttagctgtgatgccggaaggataatcgaagtgtttggcgacgcatccttgcggcgaaccgataagcgcgaccagctgaaaggcctactcgggctgcctgctgatcttgccaagacaatgggaaaagagctggcgtcagccgtcttgggttacgcagctaatttcagtaagatttttctcatcagcgacgccgaacataagttctctctgggcaacgatgagaaagtggaagagttcgagaccatttgcccaaatgaatgtacttccttattttcagctctgagaacagcctacagcgcatatctccttagtgggatcctgagggacgccaacggaaagaccttgtctttctgcaaaaagaaagagtacgatcggtatcacgacgatctagctctgctcaaggcgctggtacgcgaatacgcacccgagtcctatcagagctttttcggcggtgaaagacttgttgtgaatgggaggatgacgaaacgttacgaccctactaaggccaagggatataccaaatacgacctggtccattcggctggctcttacgatgagttggccaaggacgtgaaaaagctcctgggctccttagcagccgatgactcacggtatcaacgaatgatgcaggcttttgatgaggaaagattcctgaggcgcctaaaaacaagtgacaacgggagcataccataccagctccacctggaggaacttcgggccattatcgcaagacaaggagagttttatccgttcttgaaggaagagtccaagaaaattgagtctctggtgagctttaggatcccctactatgtcggtcctctcactaccaagaatgcggctgttgatgtgcacggcaacaaacgcttcgcctggtcagaacgaaagccagggatggagagtgcaaaagtacggccctggaactgggacgatgtgatcgaccgtggaaagtccgccgaaaattttattgtcagaatgacaggcacctgtacgtacctgcagaacgagaaggtgcttcctaaatgcagcctgttgtatgaggagttctgtgttctcaatgagctgaacggtgctcattggtctgccgatggggaccacgaatgcccatttgatacttcagacaggcgcggcatagtgcaggacttattctgtggaaagcggagagtcagttacaaacaagtggaggattggctgaggcagcatggcagccgacgcgcacgggtatccgggggacagggtgcttctggcttcgaatcgaagatgagctcctacatctttttctcaaaagacgttctacacgtggatagaattgaccccgccgattttccgatgatcgaggagataattctctggaatacactgttcgaagacagggatatccttaaggagcgtatcgaagaggcgtatggggaccgcttgaacgccgaacagattaagaccatctgcaaaaagcggtttactggatggggcagactgagtaggcgactcctgacaggtattaaagctcaaaccgatcagggggacttatctataatggatatcctgcgggagggcgaccctaataacgatcaccgcggaaaggcaatggtcttcatgggcattcttcatagcgaggacttggggtttcagaaaaagatcgaccagatcaatcaagaaaaagtgtccgccggaaaggtctcactcgaggatctgcccggtagcccagctctaagaaggtctattaaccaggccatgcgggtggttgacgaaatagtgtccatcgcaaagtgccctcccagtcacatttacctggaggtaacgcgagatgaagacggcgcgagaaaagggcgcaggagcacccgtcggtatgatgccatcaaggctgccctcgagaaattcaaggaggaatctccaacatggtttgaccaggatgtcttcggagagtttagaaggtcccgcgcagaagacctggatgagcgactttcattgtacttcatgcagggcggtaaaagtctgtatagcgctactcccttaaagctcgagctgcttcataccaatcaataccaggtggaccacattatccctcagtcgtatataaaggatgactcctttgaaaacaaagccctggttttggcaggggagaatcagagaaagtctgacgccctcctgatcgatagctcaattcggacagctatggcgccatactggagggccctacatcaagcaggcctgatgggagacaaaaagttcaacagtctcatgtgttcctctatcagcgataaacgcgtgcgtggcttcattgctagacagctggtcgaaacttcccagatcgtgaaacttgccgggatgatgttgcaatcaaattacccggaggccgacgtacagcccgtgaaggctagcctgggacacgatttacgggttcaggcaggctttataaaatgcagggaagtcaacgacttccaccatgcccacgatgcgctcattgcttgtgaggtgggtcgctatatcaaccagtgccatcctgggatttacgacaatccaatcggatatgcccgagcagtgagagagctggtccggaagcaaaacgaagagatgaggaaatacggccgccttcccggtagtgccggctttatagttgggggattcatgagaacccacgtggatgtggacacaggcgaagtagtctgggatgctgaggaagaactgtctaggatccgggcatatctagactactccaatgtgtttgttacccgtatgagcgaggaaacttcgggggccctctggaacgcgacgatttattcacctcactacggaaagacagctccaaccctgcatatcaaacagggcttggatgtgcagcgctacggtgggtattctagtgccactttcgcatactttaccctgtatgtcgccgagaagggaaagaaacgaaaggctgaattactcggcattcccatctccgtggccagaaaaatagagggtgaaccgagcaagctggacgcattcgttgctcaggacgccgaggcgaaaaagctgaaacaccctctgattatcagggcccggatcttgaagtacgcacgctttgagatggaaggcaatcaattctattttgctgcccaggatgctgtgtactctgcaagacagctcgtactgaagggggacctatatagcgtcgccgccaaggcttgtgataagcatctgaacgactcctgcatttcaaatgaggatcttatcaggctctacgacgaactggtgcacaaaggagatttgctgtgtaacaagttcggcaatgtgacagacgtcttacgggcggggcgagagagatacgcaggactcagtattagcgagaaacgccagctggtttgcaacgtgcttgcctattacaggtctgctaccgcccgggtagatatatccctggtgggcggtccaaagcatgcagggaatttgggaatcgccttcgtcctcaacaatcccgaagctattgtgtttgttgaccaatcagtgactggcatgttcgagaagcgtacaagagtcgaactgtga

SEQ ID NO: 3163 - RNA, 4122 nt, synthetic construct
  misc_feature 1..4122: note = Cas9 variant
  source 1..4122: mol_type = other RNA
atgaagaaaatcctgggcctcgaccttgggaccaacagcattggatgggccctggtgaatgaggctgataacgaaagagagaagtcctctataatcaaaattggtgtcagggttaatcccttgacagtggacgaacagcaaaacttcgagaagggcaaatcaatcactacgaatgcagatcggaccttaaagcgcagtatgcgacgtaacctgcagagatttaagctaaggaaagaaaatctcattgagatcctgaagaaacagaagttcataaacgacgagacaatccttagcgaaaatgggaacaaatccacttttgagacctacaatctgcgggccaagtctgcgacagaagagattaccttggagcagttcgctcgcgtactcctgatgatcaacaagaaaagaggatataagtcgtcaaggaaagccaagagccaagatgaaggccagctgattgacggtatggagatcgccaaaaagctctacaatgataacttaactcctgggcagtttgtgttccagatactgaaagaaggaaagaagtatattccagacttttaccggagtgatcttcaagcagagttcgacaaaatctggtcctttcagaagcagttcaatccggatattttgacagaagagtttaacaaacagatcatcggcaagggcaaagtcaacaccacgaagattttcctggctaagtatgggatatacactatcgacaataaaggagcagataagaaatctcaagcctataactggcgcgtggaggctctaaccaatcagctcacaaaggaagaactggcctttgttattagcgaccttaacggtatcatatccaattcaagtggctacctggggagcatttctgaccgatccaaagaattgtacttcaacaagcagactgtgggacaatatctcatcgcgcagctgaaggagaatccccacacccagctgaaaaaccaggtcttctacagacaagattatttagacgaatttaatacaatctgggagacccaggcaaagttccataaagagctcacgaacgaacttaaggaggaaattagggatatcattatattttaccagcggaaactgaagtcacagaagggcttgatcagcttctgcgagtttgaaagtaaacaaattgagatcaatatcgacggtaagaaaaagctaaaaactgtggggtctaaggtatgtcctaaatccagcccactgttccaggtttttaagatttggcagatactcaacaatatccaggtgattgagaagtcgacaggaaaatctaagttcctggaacaagatgagaaagaaatcctttttaaggagctgaacttcaaagacaagatttccaagaccgatgccttgaaaatcctctataagaattacaaagagctggactttaacttcaaggaaaacatagagggcaatcgtactcaggctacatttttaaaagccttccagtcaatcattgaactgagtggccacgaggtcagcgatttctccaagatcaagaccgacgaaattctagagatcgtgacgcccatatttgaggggttcggatttaacaccaatctcctgcagttcaactctaatcttaaaggtaaggattttgaaaaacaagcagtgtatcagttgtggcatctgctctacagcttcgagggcgacaactcaaatacagggaacgaaaagctgattcagaaaatcagtgagctttacggatttgaacgcgagtatgctattatcatagccaatatctccttccaacctgactacggcagcctgtctactaaggcgattagaaagatcttgccacacctcaaagagggtattgaattttcactggcctgcgagtatgcagggtacaggcatagtaagaacagcttaaccaaagaagagaagaataaaaagatcctgaaagataagatagacattctacccaagaactccctccggaatcctgtcgttgagaaaatcctgaaccagatgatcaatgtggtaaacgctacaattgagacttatggcaagccagatgagatccgaattgaacttgcccgcgagttgaaaaagtctgctaaagaaagagaggacctgaccaacgccataaataagtcgacactcgatcacgagaagtacaaagcactgttacagaaggagttcggactgagcaacgtgtccaggaatgacatcattcggtataaactttacttggaactcgaacacaacggctttcataccctgtactcaaatacttatatcgagccgaacaagctattcagtaaagaatttgatattgagcacatcataccccagtctcgcctgttcgacgatagcttctccaataagacgatcgagtcaagaagcgccaacattgaaaaggggaatgagacagcttttgactacgtctctaacaaaaatggagaagtgggtctcaaggattatctgaaaaacatcgaggaccttttcaataacggcaagatttccaaaaccaagtacaataagttgaaaatgaagggggatgaaatccctagtgactttatagcgagggacctgcgtgatactcaatatattagcaaaaaggcaaaatctatcttagaggacctcgttaaggatgtggtctccaccggaggctcaatcacagaccggctgcgagaggattggcagcttattgacataatgaaggaactgaactgggataaatacgacaagttgggtctcaccgaggtgatcgaaaacaatgatgggcataaaattaacagaatcaaggactggactaaaaggaatgatcaccgccaccatgccatggacgctctgacaattgccttcacgaagcggagttatatccagtacctaaacaatctgaacgcaagaagcgataaatcgggctccatatacggaatcgagcagaaggaactctatagggacaagaataacaaactgcgctttaagccacccattcctcttgacgatttccgagccgaggctaaaaagcaattggagaataccctggtatctatcaaagccaagaacaaggttgcaactattaatatcaacaataccaaaaagcagggcggggaaaacaaaaagaaacagttaacaccacggggacagctccacctggagacaatatacggtagcattcaacagtatgtgactaaggaagagaaggtcggcgcgaattttaacaaagagcttatcgaaaaggtggctaataaaaagtgtcgtgaggccctgctaaaaagactcatcgagttcgacaacgatcccaagaaggcatttaccaggaaaaactcactgaataagaacccgttgtacattgacacgatcaaaacctataaggtccctgaaaaagtgaagacagttactaccgaaacaatatacactattcgcaaagatatcaatcccgacctgaagattgataaggtggtagacaaaaagatcaaaaacatattagagctccggctgaaggagttcaatggggatgccaaaaaggcttttagtaaccttgacgaaaagccaatttggctgaataaagagaagggaatctccatcaaaagagtcaccattacgggcatctctaacgccattgcattgcatgataagaaagacaaggaaggtaatttcatactcgacaaccaggggaagaaacaagctgtggatttcgttaatacaggcaacaatcaccatgtggccatctataaggacgagaaaggaaacctgcaggaaaatgtcattaccttttacgaggcggtggagagggtaaaccagggcatccctatcattgataagacttacaaacagaacgaagggtggcaattcctatttagcatgaagcagaatgagtatttcgtgtttcccaacgaaaagacaggattcaattccaacgagatagacctgcttaatccagaaaactaccacctcatctcacccaatctgtttcgagttcagaaaattgccaccaaggattatttctttcgccaccatttggagactaacgtcgagaatatcaccacaacgaaagacctgacctggaagcggttaggcattaacggtatcataaatatcctcaaagtgagaattaaccacatcgggcagattgtgagcgtcggagaatactga

SEQ ID NO: 3164 - RNA, 4122 nt, synthetic construct
  misc_feature 1..4122: note = Cas9 variant
  source 1..4122: mol_type = other RNA
atgaccaagaaaaactacagcatcggcctggacattgggacaaattccgtgggatgggccgtcataactgatgactataaggttcccgctaaaaagatgaaagtgctcggtaacacggataagaagtacatcaaaaagaatcttctgggcgcattgttattcgactctggggagaccgccgaagcgacaagactgaaaaggactgctcggcgccgatatacccgtagaaagaacaggctacggtacctccaggagatttttgccgaagagatgacaaaagtagatgaatcattctttcaacgcctggacgagagtttccttagatgggatgacgataataagaagctgggaaggtatcctatctttggcaacaaagcagacgtggtcaagtaccaccaggagttcccaaccatttatcatttgcggaaacacctcgccgatagctccgaaaaggctgacctgcgcctggtgtacctcgcattagcccatatgatcaaatttcgaggtcacttcctgatagagggggaacttaatgctgagaacactgatgttcagaagatctttgccgacttcgtgggagtctacgacagaacatttgatgactctcatttgtcggagattaccgtggatgcggcatcaatcctgacggaaaagattagcaagagtaggcggctagagaatctcatcaagtattacccgactgaaaagaagaacaccctgttcggcaatcttatagccctggctttgggcctccagcccaactttaaaatgaatttcaagctgtccgaggacgccaaattacaattctctaaggatagctatgaagaggacctgggggagctccttggaaagattggtgatgactacgcagatctgtttacatccgctaaaaacttgtatgacgccatcctactgtcaggcattctcatcgtagatgacaatagtactaaggcgcctctgagcgcctctatgatcaaacgttacgttgaacaccaggaggaccttgaaaagctgaaagagttcattaaggcaaacaagtccgaattgtatcacgatatatttaaagacaagaacaaaaatgggtacgctggatacatcgagaacggcgtgaagcaggatgagttctataaatacctcaagaataccctgtcaaagattgccggtagcgactactttttagataaaatcgaacgcgaggacttcctgagaaagcagaggacatttgataacgggagtataccacatcaaattcacctacaggaaatgcatgctatcctccggcgacagggagactattatcccttcctgaaagagaatcaggatcgcatcgaaaagattcttacctttagaatcccttactatgtcggcccattggccaggaaagactctcggttctcctgggcagagtaccacagcgatgagaagattacgccctggaactttgacaaagtgatagataaggaaaagtcggccgagaaattcatcactcgcatgacactgaatgacctctacctgcctgaagagaaggtgcttccaaaacactctcatgtctatgagacctacgctgtttataacgaactgactaagattaaatacgtgaatgagcaaggcaaggactcctttttcgattcaaacatgaagcaggaaatcttcgaccacgtatttaaagagaatagaaaggtgacaaaagaaaagttgctcaactatctgaataaagagttcccggagtacaggatcaaggatttaattgggctggacaaggaaaacaaaagttttaatgcgagcctaggaacctatcatgatctcaagaaaatactggacaaggcattccttgatgacaaagtcaacgaggaagtgatcgaggatattatcaagacgttgaccctgtttgaagacaaggatatgattcacgagcgtctccagaaatactccgacatcttcacagccgatcaactgaagaaattagagcggcgacattacactggttggggcagactgtcttataaacttataaacgggatcaggaataaagaaaacaataagaccattttggactacctcatcgacgatggaagcgctaaccgcaattttatgcagctgattaacgacgatacactacccttcaaacagatcatacagaagtcacaagttgtgggcgacgtcgatgacattgaggccgtggtacacgatctgcctggtagtccagcaatcaagaaagggattctccagtccgttaagatcgtggacgaactggtcaaagtgatgggcgataatcccgacaacatagtcatcgagatggcccgggaaaatcagactaccaacagaggaaggagccagtctcaacagcgccttaagaaattgcaaaattcactgaaggagttaggcagtaacattctcaatgaggaaaagcctagctatatcgaggataaagtggaaaactcccatctgcagaatgaccagctttttctgtactatattcagaacgggaaggacatgtacacaggagatgagttggacatcgatcacctctctgactatgatatagaccacattatcccacaggctttcatcaaagatgactcgattgataaccgagttctgaccagctccgccaagaatcggggtaaatcagacgatgtgcccagtctagacatcgtacgtgcaagaaaggcggagtgggtcaggctgtacaagtctggcctcattagcaaacgcaagtttgataacctgactaaagctgaaagagggggacttacggaggccgacaaggcaggcttcataaaacggcagttggtggaaacaaggcaaatcaccaagcatgttgcccagattctggacgctcgatttaatactgagtccgatgaaaacgacaaggtgatccgcgatgtcaaagtgattaccttaaagtcaaatctcgtaagccagttccggaaagacttcgagttttacaaggtgagagagatcaacgattatcaccacgcccatgacgcatacctgaatgctgttgtcggtacagcccttctgaaaaagtatccgaagctagcgtctgagttcgtgtacggggaatataaaaagtacgatataaggaaatttatcaccaactccagtgacaaggccactgctaaatatttcttttacagcaatctcatgaacttctttaagcgtgtgattcgctactctaatggcaaagtcatcgttcggcctgtggtggaatattccaaggatacagaggacattgcatgggataagaaatcaaacttcagaacgatctgcaaggtactgagttacccccaagtcaatatagtgaaaaaggttgaaacccagactggaggctttagcaaagagtcgattttgccaaagggggactccgataagctgatccctaggaaaacaaagaaagcctattgggacaccaagaaatacggaggtttcgactctcccacagtggcttatagcgtctttgtggttgccgatgtggagaagggcaaggcaaagaagttaaaaactgtaaaggaactcgtcgggatctcaattatggagcgaagtttcttcgaagagaacccagtggaatttctggagaataaaggataccacaacatacgggaggacaaacttatcaagctgcccaaatattccttgttcgaatttgagggcggtaagcgcagactcctggcgtctgccagcgaactacagaaagggaacgagatggtgattcctggccatctggtcaaacttctctaccacgctcagaggatcaattccttcaactcaaccaaatacctggattatgttagcgcccataagaaagagtttgaaaaggtgttgagttgtgtagaggacttcgcaaatctgtacgtggatgtcgaaaagaacttatctaaaattcgggctgtggccgactccatggataattttagcatcgaggaaatatcgaactcattcatcaatctcctgacgcttaccgcactgggagccccagctgactttaacttcttgggcgagaagattccgcgaaaaagatatacatctactaaggagtgcctcaatgcgaccctgatccaccaaagtattacagggctatacgaaactcgcatcgatctgtccaaaataggagaggaatga

SEQ ID NO: 3165 - RNA, 4122 nt, synthetic construct
  misc_feature 1..4122: note = Cas9 variant
  source 1..4122: mol_type = other RNA
atggagaacaagaattacagcatcggcctggacattgggaccaactccgtgggatgggccgtcataacagatgactataaagttccctctaagaaaatgaaggtgctcggtaatactgataaaagattcatcaagaagaaccttattggcgctctgttgtttgacgaagggacgaccgcagaggccaggcggttaaaacgcacagcgcgacgtagatacactaggcggaagaatcgcctgagatatctacaggaaatcttcgctgaggaaatgtcaaaagtagatagtagctttttccacaggctcgacgattcctttctgattcctgaggacaagaaaggatctaagtacccaatcttcgccacccttatagaggaaaaggagtatcataaacaatttccgacaatctaccatctgcggaagcagttggcagattcgaaagaaaagaccgacctccgcctgatttatctggccctcgctcacatgatcaaataccgaggccacttcttatacgaggatacttttgacattaagaacaatgatatccagaaaatattcaacgagtttatttcaatctataataacacattcgaaggtaatagcctgagtgggcagaacgtgcaagtcgaggcaatttttaccgacaagatctccaagtctgccaaaagagaaagggtgcttaagttgttccccgacgagaaaagcacgggactgttctccgaatttctaaagctcatcgttggcaatcaggctgatttcaaaaagcattttgacctggaggagaaggcccctcttcagttctcacgggatacttacgacgaagatctggagaacttgctcggccagattggggacgattttgcggacctgttcgtggcagccaaaaagttatatgatgctatactgctcagtggaatccttaccgtcacagacccaagcactaaagctcccctgtctgcatccatgattgaacgttacgagaatcaccaaaaggatttggctaccctaaaacagtttatcaagacaaacctgcctgaaaagtatgacgaggtgttctcagaccagagcaaagatggttacgccggctatatagacgggaagaccacgcaggagagtttttacaaatacattaagaacctcctgtctaaattcgaaggagcggattattttcttgagaagatcgaacgcgaggacttcctgagaaagcaaaggacttttgataatggctccatcccacaccagattcatttgcaggaaatgaacgccatcctccggcgacaaggtgagcactaccccttcctgaaagagaataaggaaaagattgagaagatattaacattccgcatcccttattacgtagggccactggcaagaggaaacagggactttgcttggctaacccggaatagcgatcaggccattcgcccgtggaacttcgaagagatcgttgacaaagcctcgtctgccgagtcctttatcaataagatgactaactatgatctctacctgcccgaagagaaagtgcttcctaagcattcattgctgtatgaaacattcgcagtctacaatgagctcaccaaggtgaaatttattgccgaaggcctgagagactaccagttccttgatagtaggcagaagaaagacatattttatacgctgttcaaggctgaggataaacgtaaggtgaccgagaaggacatcattcaatacttgcacacagtcgacggctatgatgggatcgaactcaaaggaattgagaagcagtttaacgcgagcctgtccacttaccacgacttactgaaaatcataaaggataaagagttcatggacgatccaaataacgaggaaatcctagagaatattgttcataccctcacaatctttgaggaccgggaaatgattaagcagcgactggcacagtatgattctcttttcgacgagaaggtgatcaaagccttgactagaaggcactacaccggttggggcaagctgagctcaaaactcataaacgggattcgcgataagcaaacaggaaaaaccatcctggactatttaatggatgacggctacaataaccggaactttatgcagctgattaatgatgacgaacttagtttcaaggagatcataaagaaagctcaggtagtgggtaagactgacgatgtcaaacaggtggttcaagaattgcccgggtcccctgccatcaagaaaggcattctccagagcatcaagctggtggacgagctagtcaaagtgatgggacatgagccagaatctattgtaatcgagatggcaagagaaaaccagacgacagccaggggcaagaaaaattcacagcaacgctacaaacgaatagaggatagtctgaagattctcgctagcgggctgaacgccaaaatccttaaggagcaccccaccgacaatatccagttgcagaacgatcggctgttcttatattacctccaaaatggacgtgacatgtatactggtaaaccgctggatattaaccagctttcctcttacgacatcgatcatattgttcctcaggcatttataaaggacgattcgctggacaatagagtgttgaccagcctcaaggacaacaggggcaaatccgataatgtcccctcactggaagtggtcgagaagatgaaaacattctggcagcaactactggacagtaagctcatctcttatcgcaaatttaacaatctgaccaaggcggaaagagggggacttgatgagcgggacaaggtgggcttcattaaaaggcagttggttgaaactcgacagatcacaaagcacgtggctcagattctggatgcccgctacaacacggaggtaaatgagaaagacaagaaaaaccggaccgtcaagatcataactttaaagagcaacctcgtgtccaattttagaaaagagttcaggctgtataagatccgtgaaattaacgattaccaccatgcacacgacgcctaccttaatgctgttgtggccaaagcaatcctgaagaaatatccaaagctagaacctgagtttgtctacggtgattatcaaaagtacgacctcaaacgctatatttcacggagcaaggatcccaaagaaatcgagaaggctacagagaaatacttcttttattctaacctgttgaatttctttaaggaagaggtgcattacgccgacgggaccatagtaaaaagagaaaacattgagtactccaaggatacaggcgaaatcgcgtggaataaggagaaagacttcgccactatcaagaaagtgctgagtttaccacaggttaacattgtcaagaaaagggaggtgcagaccggaggcttcagcaaggaatctatactccccaagggaaattccgacaaactgatccctcgaaagacgaaagatattctttgggacaccacaaagtatgggggttttgattcaccagtgatcgcttacagtattctgttgatcgcagacatagagaaaggcaaggccaagcggctcaaaactgtcaagaccctggttgggatcacaattatggaaaaagctactttcgaaaagagcccgatcgcctttctagagaacaaaggatatcacaatgtgcgcaaggaaaacattctgtgccttcccaagtactccctcttcgagctgaaaaatggcagaaggcggatgttggcatcggcgaaggaactgcagaaaggtaacgagatcgtgttacctgtacacctcaccacgctgctttatcatgccaagaatatacaccgactggatgaaccagagcatttggagtacattcaaaaacacagaaacgaatttaaggggctcctgaacctagtctctgagttcagccagaaatatgtgctggctgacgccaatcttgaaaagatcaagaacctctacgcagataatgagcaggctgacatcgaaattctggccaactcatttatcaatttgttaacattcaccgcactgggcgcccccgctgcgtttaaattctttggaaaggatgttgaccgcaaaaggtacactacagtgagtgagatactcaacgccaccctgattcatcaatccatcactggcctttatgagacccgtattgatctgtctaagttgggggaagactga

SEQ ID NO: 3166 - RNA, 4125 nt, synthetic construct
  misc_feature 1..4125: note = Cas9 variant
  source 1..4125: mol_type = other RNA
atggagaccaagttcacatactatctgggcctcgacatggggactgatagccttggatgggccgtgacggactcctcttaccacatcctgagagctaaaggtaaggatttgtggggcgtcaggttatttccctcagcagaaaccagtgttgagcggcgcacatatcgagtgaaccgtagaaggcggcagcgcgaagtagccagaattggggcgctgaaagagctattcgctgacgaaatagagaaggtggatcctggatttttcgtcaggctcgacgagagcaaatttcatatggaagatcggtccgagaataacaagcaaaagtacggcctgttcgccgacaaactgttttctgatgcaggttattacaagaaatatccaactatcttccaccttcgcaaggaattgctcgagtcggaggaaccgcatgacgtgcgactggtttacctggccctcttaaatatgtttaaacacagagggcatttcctgaactcaagccttcagattgagggagaaaatagtaacatcgctgagtcctaccagatgtttgtggataccttgacagacgaagatctggacttccccgagcaggtctctggcgagaggctacaagaaatttttcggagctccgactcacgtaagaagaaagtggagaatctcctggcagaaatgaaccttagtaagaaacagaagcgcgagatccagttcgtaaatctgatatgcggcttgaaagggaagctcagcgaactgttccctgataaagagtatgacgaggaacagaagaagatcgccttttctttccaagattccgactacgaggataaagaaaacaccattcaggagttactggacgaatcagagatgaatatgatctatgctgttaaggccgtgcacgatagcggagtcctcagtggtattatgaacggcgagagatacctttctgtggcgagggtggcatcctatgaaaaacacaagaaagacctgcagatcttgaaggatatactaaagaaatacgacactaaggagtattttgaaatgttccggaatgagagcgccaaatcggagtcttactccgcttacgtcgggtcagttaagtatcatggaacatttcgacgcggcctgagtggtgggaaacaggaagatctctacaagcacattaagaaagtgctgggaaagttcccacaagacgacgagggcgtaacctatatccttgaagagattgaaacggagagctttctgcccaaacagttgactgcctccaacggcgtgatccctaatcaggtccatgcaagagagatgctcgctatcctgaagcacgccgaattatacctgccattcctacaagagaaagatgacaccgggctctctgtgagcgaaaagattctgaaactttttatgttccagataccctattacgttggacctttgggtcaggagtataaagataagaaaggctacaacgtgtgggcggaaaggaaggcctcagggaaaatctacccatggaactttgaggacaagattgatgtcaaaaagagtgcagagaagttcatcggacggatggtgcgcagatgtacatatctgtccggcgaacaggctctcccgaaacaaagcctgctttacgagaagtttcaggtactgaatgaattgaacaatctcaggatacgtggtgagaaaattcccgtttctctgaagcaggaaatctatcacgacttattcggggatggcaaaaaggtgtcaatgactcggctgaccaactacctactccagaatggagtcatcagtggcgaggagaaggacagctgcatttccgggatcgatggaggtttccataactctctgtcgagcgtgggcaaatttaagggggtcttcggagacacagtgcacaccgatgaacatcgaaaaatgattgaggacataatcttttggggcacggttttcggtgatgggaagaaacttttgaaggaaaaggtggaggaggtatatggcaatcaactgactgaagcccagaaaaagagaatttttggattcaaattttcctcatggggcaggctcagtaaggctttcctgacaatggagggggcctctaaagacgacggagaaatcaagggtttaatccaggcaatgtgggataccaactgtaatctgatggagcttttgagcgaccgctttacttacaaggataaactcaacgaaatggtcacaaccgccgagaagcctctgtgcgagtggaaaattgaagacctagatgagatgtatctgtccgctccagtgaagcggatggtttggcagacgataagagtggtcgacgaagtgcaacagatcattggctgtccccctaaaaggatcttcgtagagatgacccgctcagatggggaaaagggaaaacgaacagtgagccggcagaagaagctcgttgacctgtacaaagcgcttggcaaggagggtaaaacttggtctgaggaattgtccgataccccagagagtcagtttcgtattaagaaactgtacttatattacctccaaatggggaagtgcatgtatacaggcgaagcaatcgagctggaacagcttatgaatgacaacctgtacgatatagaccacatctatcccagacatttcattaaggatgacaatatcagcaacaatttggtcctcgtgaaaaaggagaaaaacgcccacaagtctgactcctttccgattgagcctgaaatcaggaacaaaatgatgcccttctggaagtcactgcgcaagaaaggattcctaactgaggaaaagtacaatcggctgaccagaatgagtgcttttacagatgaggagaaagccgcattcataggcaggcagctcgtggaaaccagccaagggactaaggccattacgcagatctttgagcaggctttcgccaactcggaaattgtcttttccaaagcatctgttgtgagcgcgttccgacagaagtttgactgttataaggtgcgctgcgtaaataactaccaccatgctcacgatgcctacctgaatatcgtcgcaggaaacacatatcgggtgaaattcacctcaaatccacttaactttataaaggaggccaaaaagaatcctaacagtagagaaaataggtacaacatggacaaaatcttcgagtgggatgttactcgtaatggcgagaccgcttgggtggcccaaacaaaggaacatcccggtaccattcagttggtcaagaaatatctgaacaaaaattccccattaatcactaagatggtgtacgagaagcacgggggaattacacagaaagcaacgatctggtctgctaagaaagccgaaagcggcaacaccgacgcgtatatacccgttaagatgaacgatcctcgcctcgccgacgtgactaagtacggtggcgtaacaaccattgctgtcgcagggtatacactgcttgagtacaaagccggaggcaagactgtgcggtccctggaagctctaccaatctacctcgggggatcaaagaagctgaccgaggagcagatggtggaatattttagcaatgtcttgcaacaggagaacaaagaaaaggttgtgagtgatgtaatcattagaaagaaaatgatcccgtctggctccctgattaagtacaatggtttctattactatttagccgggaaaacgggagacaggataatcctcattagcgcagtgcagctgtgtcttcccatggataccatgctgtacatcaagaaaattgagaaggcgtgctcgacaggcaacttcgaagagaaggacaaaaatggtaagcaggtcttgtcaaaacaacagaacgagtttgtgtatgaactcatcatacagaagtaccaacagtctatcttcaaaaagaaggttggcgccattggggacactatcattgagaaacgagaaaagtttgctgagatcagtctggaggaacagtgtaaagtgctaatgcagatattcctgaattttcaatccggaattggcgtcgagcttaagatcatcgaagggggcaaaaagagcggagtgacctacctcaacaaaaaggttatgaatgtgcaggagctgaagttgattgatcagtctgtcacaggtgtattcagccgggaaatagacctgttaactatctga

SEQ ID NO: 3167 - RNA, 4125 nt, synthetic construct
  misc_feature 1..4125: note = Cas9 variant
  source 1..4125: mol_type = other RNA
atgaagaaaagatacagctattccatcggcctggacattgggaccaactctgtgggatgggccgtcataaatgaggattacaaggttcccgctaaaaagatgacagtgttcggtaacactgacaggaaaacgatcaagaagaatctccttggcaccgtactgtttgattcaggggaaacagcacaggcccggcgcttgaaacgaactaaccgtagaaggtatacccggcgcagatacaggttatgccaactgcagaatattttcgcgacagagatggtgaaggtcgacgatacctttttccagcggctaagtgagagctttttctattaccaggacaaggcttttgataagcaccctatcttcggaaactccaaagaagaacgcgcctatcataagacttacccaacaatttaccacctccgaaaggacctggcagatagagaccaaaaagccgatcttaggctgatctatttggctctctctcatataatcaagtttcggggccacttcctgattgagggtaaactgaatagtgagaacaccgacgtgcagaagctctttatcgcattagttacggtgtacaatctgcttttcgaagaggaaccgattgccggggagacttgtgatgctaaagccttgctgaccgcgaagacatcaaaaagcaagcgtctagagagtctcatctccgaatttcccggacagaagaaaaacggcctgttcggcaatcttctggcattggccctcgggctgcgccctaacttcaagtctaattttggattaagcgaggacgctaaactgcagataactaaggacacctatgaagaggaactcgataaccttctggccgagattggtgaccattacgcagatttgttcctagctgccaaaaatctgtccgacgcgatcctcctgtcagatattcttacactgagtgacgagaacaccagagccccattgagcgcatctatgatcaagaggtatgaggaacaccaagaagatctcgctctgttaaagaaactggtcaaggagcagatgcccgaaaaatactgggagatcttttccaacgccaagaaaaatggctatgctgggtacattgagggaaaggtgtcacaggaagacttctaccggtatataaagcctatcctaagccgactcaaaggcggtgatgagtttctggccaagattgaccgcgatgacttccttagaaaacagaggacgtttgacaacgggagtatcccacaccaaatacatttgaaggaactgcacgcaattctccggcgccaggagaaatactatcccttcctggccgaacagaaggagaagatcgagcaacttctgtgctttagaatcccttactatgtaggaccattggctaaaggcggcaattcttccttcgcgtggctcaagaggcgtagcgatgaaccgattactccctggaactttaaagacgttgtggatgaggaagcatcggcccaggctttcatcgaggggatgacaaattacgacacctatctgcctgaggaaaaggtcttaccaaaacattctcccctgtacgagatgtttactgtgtacaacgaactaacaaaggtgaaatatattgccgagaatatgaccaagcctctctacctgtccgcagaacagaaggaggccataatcgatcaccttttcaaacagacgcggaaggtcaccgttaaagacttgaaggagaaatatttctcacaaattgaaggactggagaacgtggatgtaacaggtgtggaaggcgcttttaatgccagtctcgggacttacaacgacctgttaaagatcatcaaggataaagcattcctggacgatgaggcgaatgctgaaattcttgaggagatagtcttgatcctcaccctgtttcaggacgaaaagctaattgagaaacgactggccaagtatgcaaacctcttcgagaaaagcgtgctgaagaaacttagaaaaaggcactaccgcggatggggccggttgtccagacagctgatcgatggtatgaaggacaaagcctctgggaagacaattttagactttctcaaagctgatgacttcgccaataggaactttatccagctgataaatgatagctcacttgacttcgaaaagctgatcgatgacgcacaaaagaaagctattaagcgcgaaagtttgactgaggccgttgcgaacctcgccggctccccagctatcaaaaagggcattctgcagagcctaaaagtggtcgatgagatcgtgaaggtaatgggacataaccccgacaatatagttattgaaatgtctcgagagaaccagaccacagcacaggggctgaaaaatgcccggcaacgtctcaagaagatcaaagaagtgcacaagaaaaccggatcaaggattctggaggataacagtgagagaatcactaatcttacgttgcaggacaaccgcctgtatttatacctcctgcaggatggtaaggacatgtacacaggccaggatcttgacataaataacctgagccaatatgacatcgatcatattatcccgcagtcctttattaaagacaattctatcgataacctagtcctcaccactcagaaggctaatcgggggaagtcggacaacgtgcctagcatagaagtcgtgagagatatgaaagacagggtttggcgacgccaactggccaatggagcaatttcccggcagaagttcgatcacttgaccaaagcggagagaggcggtctggccgactcagataaggctaggtttttacgtcgccagctcgtggaaacacggcagatcaccaaacatgtagcccaactgcttgacagtagattcaactctaagagcaatcagaacaagaaactggcaaggaacgtcaagatcattactttgaaatccaagatcgtgtcagattttcgaaaagacttcgggctctacaagctgcgggaggttaataactatcaccacgctcatgacgcctacctaaatgcagtggtcggcacagccctgcttaagaaatatcccaagctcgaagctgagttcgtgtacggagattataaacactttgacctggtaaagttgattagcaaatctgatccatccctgggcaaggcgacggccaaggtgttcttttacagtaacataatgaatttctttaaagaggaattaagcctcgcagacgggaccctgatgaagcgccctgttatcgagactaacacagaaaccggagaggtcgtgtgggataaagtgaaggacttcaaaacaattagaaaggtcctttcttacccccaggttaatatcgtgaaaaagactgaaattcagtccggtgctttttcaaaggagagtgtgctgagcaaaggcaactcggataagttgatcgagaggaaaaaggggtgggaccccaaaaagtatggaggcttcgattccccaaataccgcctactctatatttgtagtcgccaaggtggctaaacggaaggcacaaaaactcaagacggttaaagaaatcgtgggtattaccatcatggagcaggccgaatatgagaaggacaacattgcgttcctggaaaagaaagggtaccaggatatccaggagaagctactgataaaacttcctaagtatagcctctttgagctggaaaatggccgaagacgcttgttagcttcagccaacgagttccaaaaaggaaatgaactggcactcagtggcaagtacatgaagttcctgtatcttgcctccaggtacgacaaactgtctagcaagattgagtccgagcagcagaaaaagttgtttgtcgaacaacatctacactacttcgatgagatcctggacatcgtggttaaacacgctacatgttatattaaggcagaaaacaatctcaaaaagataatctcactgtacaagaaaaaggaggcctatagcattaacgaacaggcgcttaacatgttaaatctgtttatcttcacttcgctcggggctccatctacctttgtgttctttgacgagacaattgatcgtaaacggtacactacctccagcgacgtattgaacggaatcctgatacagcagtcgatcacgggcctctatgagacaagaattgatctgtcaaggttcggtggggactga

SEQ ID NO: 3168 - RNA, 4125 nt, synthetic construct
  misc_feature 1..4125: note = Cas9 variant
  source 1..4125: mol_type = other RNA
atgaagaaacagaagttcagcgactactatctgggctttgatatcgggaccaactccgtgggatggtgcgtcacagacctcgattacaatgttcttagattcaacaaaaaggacatgtggggttctaggctgtttgatgaggccaaaactgctgcagaacggcgcgtgcaacgaaattcacgtagaaggttgaagcggcgcaagtggagattaaacctgctagaggaaattttcagtgacgagataatgaaaatcgatagcaactttttcaggcggctcaaggaatcctctctgtggcttgaggacaaaaattcgaaggagaaatttacgctgttcaatgatgacaactataaggattacgacttttataagcagtaccccaccattttccacttgcgcgatgaactcatcaaaaatcctgagaagaaagacattcgactgatctatctggccctccattcaatatttaagagcagaggccacttcttatttgaagggcagaacctgaaagagatcaagaatttcgagacactttacaacaatttgattagtttcctggaagacaacggaatcaataaatccattgataaggacaacatcgagaagctagaaaagataatttgtgattctggcaagggtctcaaagacaaggagaaagaatttaaggggatcttcaacagcgataagcagctggtagcgatttttaaactttccgtgggatcaagtgtcagcctgaatgacttgttcgatactgacgagtacaagaaagaggaagtggagaaggaaaagatctcttttagggagcaaatctatgaagatgacaagccaatttactattccatactcggcgagaagatcgagctgttagatattgctaaatcattctacgactttatggttctgaacaatatcctcagcgacagtaactatatatctgaagccaaggtgaaactttacgaggaacataagaaagatctgaagaatttgaagtatattatccggaaatacaacaaggagaattacgacaaactattcaaggataaaaacgaaaataactatccggcatacatcggcctgaataaggagaaagacaagaaggaggtcgtggaaaaatcccgtctcaagattgatgacctgatcaaagtaattaaggggtatcttcccaaacctgagcgcatagaagagaaggataagaccatctttaacgagattctgaataaaatcgaattgaagacaatcctcccaaaacagagaattagcgacaacggaaccctgccctaccagatacacgaggttgaattagagaagatcctggaaaatcagtcgaaatattacgatttcctaaactatgaggagaacggtgtgtctactaaggacaagctcctgaaaacatttaagttcaggattccttactacgtcggcccacttaattcctatcataaagataaagggggaaactcatggatcgtgcggaaagaagagggcaagattttgccctggaattttgaacaaaaggtggacatcgagaaaagtgccgaagagttcataaagcgaatgaccaacaaatgcacgtacctgaatggtgaggatgtcatccctaaggacagcttcctctattccgaatacattatcctgaacgagcttaataaagttcaggtgaacgacgaatttctgaatgaggaaaacaagcgcaaaattatcgatgagttgttcaaggagaataagaaagtatctgaaaagaaatttaaggagtatctcctggtgaaccagatagctaatagaactgtcgaattaaaagggattaaggacagcttcaactcaaattacgtgagttatatcaagtttaaagatattttcggagagaagctgaacctagacatctacaaagagatatccgaaaagagcatcctctggaaatgtctgtacggcgatgacaagaagatttttgagaaaaagatcaaaaacgaatatggcgatattcttaataaggacgagatcaaaaagataaactctttcaagtttaatacctgggggaggttgtcagaaaaactgctcacaggaattgagttcatcaacctggagactggtgaatgctacagtagcgttatggaggcattacggcgcaccaattataacctgatggaacttttgtcctctaagtttacactccaggagtcgatcgataatgaaaacaaagagatgaatgaggtgagctacagagacctgattgaagagtcctatgtctcaccaagtctaaagagggccatcctgcaaaccctcaaaatttacgaagagataaagaagatcacgggccgtgtgccgaaaaaggtattcattgaaatggctcgagggggagatgagtctatgaaaaacaagaaaatccccgcccggcaggagcagctgaagaaactttatgacagctgtggcaatgatattgcgaacttttccatcgacataaaggaaatgaaaaattcattgagctcttacgacaacaattccctgagacagaaaaagttatacctctattacctgcaattcggtaaatgcatgtatactgggagggagatcgatcttgaccgcctgttgcagaacaacgatacatacgacattgatcacatctatcctcggagtaaggttattaaagacgatagcttcgacaatctcgtgctggtcctaaagaacgaaaatgcagagaagtctaacgagtacccagtgaaaaaggaaatccaggagaaaatgaagtccttttggagattcctgaaagaaaagaattttatatcagatgagaagtataaaaggctcaccggcaaggacgatttcgaactgcgcggatttatggcccgacaacttgtcaacgtgcggcagactacaaaagaggttggcaagattttgcagcagatcgagcccgaaatcaaaattgtgtacagtaaggctgagatagccagctcgttccgtgaaatgtttgacttcatcaaggtaagagagctgaatgacacccaccatgcaaaagatgcttacttaaacattgtcgccgggaatgtgtataacacgaagtttaccgaaaaaccttacaggtatctccaagagatcaaggagaattacgacgttaaaaagatttataactacgatatcaaaaatgcgtgggacaaggaaaactccctggagatagtgaagaaaaatatggaaaagaacacagtcaatatcactcgcttcattaaagaggaaaagggagagctttttaacctgaacccaatcaaaaagggtgagacctctaatgaaattatcagcataaagcccaaactatatgatggcaaggacaacaaactcaatgagaagtacgggtactatacatcactgaaagccgcatacttcatttatgtggaacacgagaagaagaacaaaaaggtaaaaactttcgagcggatcaccagaatcgatagtacattgattaagaatgagaaaaacctgatcaagtacttagtgtcccagaagaaactcctgaatccgaagataattaaaaagatctataaagaacagacccttattatcgactcttacccttatacttttacgggagttgatagcaacaagaaagtcgaactgaagaataagaaacagttgtacctcgagaagaaatacgaacaaatactgaagaacgctctaaaattcgtggaggacaatcagggcgagacagaagagaactataagtttatttacctgaagaaaaggaataacaatgaaaagaacgagaccatcgatgccgtgaaagaacgatataacatcgagttcaatgagatgtacgacaagtttcttgaaaaactctcctcaaaggattataagaactacattaataacaaactgtatactaatttcttgaacagcaaggagaaatttaagaaactgaagttatgggaaaagagtctcatcctgcgcgagttccttaaaatttttaataagaacacctacggtaaatacgaaataaaggactctcagacaaaagagaagctgttctcctttcccgaggacaccgggcggatcagattgggccagagctcgctcggaaataacaaggaactgctagaggaatcagtcactggcctgttcgttaaaaagattaaactttga

SEQ ID NO: 3169 - RNA, 4128 nt, synthetic construct
  misc_feature 1..4128: note = Cas9 variant
  source 1..4128: mol_type = other RNA
atgagcaacaagccctactccatcggcctggacattgggaccaattctgtgggatgggccgtcataacagatgactataaagttccttcaaagaaaatgaaggtgctcggtaacactgataaacacttcatcaagaagaatcttattggcgctctgttgtttgacgaggggacgaccgcagaagatagaaggttaaaacggacagcccgccgacgttacactagaaggaagaaccggctgcgctatctacaggagatcttctttgaagagatgagtaaactcgacagcggattctttcatagactggatgacttctttcttattccagaagataagaggggctccaaatacccgatcttcgcgaccctggctgaggagaaggaatatcacaagcaatttcccacaatataccatttgcggaaacagctcgccgactctaaggagaaagcagatctgcgcctgatctatctcaccttagcccacatgattaagtaccgaggtcatttcctgtacgaagagtcgtttgacatcaaaaataacgatattcagaagatcttcaatgagtttatatcaatttatgacaacactttcgaagggagcagtctttccggacagaatgctcaaatcgaggcaattttcacagacaaaatctctaagagcgccaagagagaaagggtattgaaactgtttcctgatgagaagtccaccggcctattctcagaatttctcaaactgatcgtgggcaaccaggctgacttcaagaaacactttgagcttgaggaaaaggccccactgcagttccccaaggatacgtacgacgaggatttggaaaatgtcctcgggcagattggagacgattttgcggacctgttcgtggcagccaaaaagttatatgatgctatactgctcagtggtatccttactgttaccgaccctagcacaaaagccccactgtctgcatccatgattgagcggtacgaaaaccaccaaaaggatttggctgccctaaaacagtttatcaagactaatctgcccgagaagtatgtggaggtcttctcagaccagagcaaagacggctacgcggggtatatagatggaaagaccacacaggaagccttttacaaatacattaagaacctcctgagtaaattcgagggcaccgactattttcttgataagatcgaacgtgaggacttcctgcgcaagcaaagaacgttcgataatggttctatccctcatcagattcacttgcaggaaatgaacgcaatcctcaggcggcaaggggagcattacccatttctgaaagagaacaaggagaaaattgaaaagatattaactttccgaatcccgtattacgtgggacccctggctcgcggcaatagagactttgcctggctaacaaggaactccgatcaggctattcggccttggaatttcgagaaaatcgtagacaaggccagctcggcagaagattttatcaacaaaatgaccaattatgacctctacctgccagaggaaaaggttcttcccaagcactctttgctgtatgagactttcgccgtgtacaacgaactcacaaaagtcaagtttattgctgagggcctgcgcgattaccagttccttgactccgggcagaaaaagcaaatagtgaatcagctgtttaaagaaaagagaaaggtgaccaaaaaggatatcattcactatttgcatacggtcgacggatacgacggtatcgagctcaaaggcattgagaagcagttcaacgcgtcactgagtacctatcacgatttactgaaaatcataaaggacaagaaatttatggatgacagcaagaatgaagcaatcctagagaacattgttcatacactcactatcttcgaagatagggagatgattaaacagcgtctggcccaatacgactccctttttgatgaaaaggtgatcaaggctttgacccggcgacactatacagggtggggaaaactgtctgccaagctcataaatggcatttgcgacaaacagactggtaacaccatcctggattacttaattgacgatggggagatcaatagaaacttcatgcagctgataaatgacgatggccttagcttcaagaaaatcattcagaagtcacaagtagtgggagagacagacgacgtcaaacaggtggttagggaattgcctggcagtccagcaatcaagaaagggattctccagtccatcaagatagtggatgagctggtcaaggtgatggaccatgcccccgaaagcattgtaatcgagatggctcgcgaaaaccagaccactgcccggggtaaaaagaactctcaacagagatataaaaggatcgaggattcactaaagaatctggcaagtggactcgacagcaacattctgaaagagaatccgacggataacatccagcttaagaatgaccgcttgtttctgtactacttacaaaacggcaaggatatgtatacaggggaagcgctcgacattaatcagctgtcctcttacgatatagaccacatcattcctcaggctttcatcaaagatgactcgcttgacaaccgagttctgaccagctccaaggataatcggggaaaatcagacaacgtgcccagtttggaggtcgtgcagaagcgtaaagccttttggcaacagctcctggattctaagctaattagcgaaagaaagttcaataacctgactaaagcagagaggggcggtctcaatgagcgcgacaaggtcgggtttatcaaacggcagctggtggaaaccagacagataacaaagcacgttgcccaaatccttgatgctaggtataacaccgaggtgaatgaaaaagacaagaagaaccgaactgtaaaaattatcacattgaagtccaacctggtctcaaatttccgcaaagagtttcggttatacaaggtgagagaaattaacgattatcatcacgcccatgacgcatacctcaatgctgttgtggccaaagcgatcctgaagaagtatccaaaacttgagcctgagttcgtctacggcgaataccagaagtatgatctgaaaaggtacataagccgttctcgcaaccccaaggaggtggaaaaagccacggagaagtactttttctattccaatctactcaactttttcaaagaagaggtacactatgctgacggaaccattgtgaagcgggagaatatcgaatacagtaaggatactggcgagatcgcatggaacacagaaaaagacttcgccaccattaagaaaatactgagctatccacaggttaatatcgtcaagaaaacagaggaacagactgtggggcaaaacggaggtttgtttgataataacattgtgtctaaggagaaggtcgttgacgcttccaaactgatccccattaagtcaggcttaagtcctaaaaagtacgggggatacgccagaccaaccatcgcatatagcgtgctcgtgacgtacaaacagaataacaagataaagaataccatggtaggcatcccggtcctgacaaaacttgagttcgaaagggaccccaacctgtatttgcgaaacctcggtattaataacgtgtcgcacgttatcaagctggtgaaatacactgtcctagagtttaagcataaatatgggacctaccggcgcttcattgtgtccaatcaggaactgaagagagcgaaccaaatctttgttacaactaagcagatgaaacttatatctcagtataccacgctcgataagaatgagcacgacagcctgttgaaaaacaatcagcaactgattcagtcaatctggaaccagttcttagagtttatgctcgccacagatctggtgaataagaaacagtacgacgaacttatcctgaccaacaatcaaactattgaggaatgtaggaacatcatgaatcgggtaataacaaccttgagtttcactaacattaatgctggccagaagaaaatcatttttgatgacaccctctccctgcctatcaagcgatggcagttcacagattctgacaagatggtcaaaaagataattgagagcacgctaatccatcagtccatcaccggactgtacgaaactagaattgatctttcaaaactcggcgaggactga

SEQ ID NO: 3170 - RNA, 4128 nt, synthetic construct
  misc_feature 1..4128: note = Cas9 variant
  source 1..4128: mol_type = other RNA
atgaaggagtaccacatcggcctggacattgggaccagctccataggatgggccgtgacagattctcagttcaaactcatgagaatcaagggtaaaactgctattggcgtcaggctttttgaagaggggaagacggcagccgaacggcgcaccttccgaacaactcgtagaaggctgaaacggcgcaagtggagattgcattatttagacgagatctttgcgccccaccttcaagaagttgatgagaacttcctaaggcggctcaagcagtcaaatattcatcctgaggacccagctaaaaaccaggcctttatcggaaagctgcttttcccggatctgttgaaaaagaatgaacgcggctaccccaccctcataaaaatgcgagacgagctgcctgtggaacagagagcacactatccagtaacaaacatctacaagctgagggaggccatgattaatgaggatcggcaatttgacctccgtgaagtgtatttagctgtccatcacatcgtgaagtaccgcggtcacttcctgaacaatgcaagtgttgataaatttaaggtggggagaattgacttcgataaaagttttaacgtccttaatgaggcctatgaagagttgcagaacggagaaggctccttcaccatcgagccctctaaggtggagaaaataggccagctgctactcgacactaagatgaggaaactggatcggcagaaggctgtagccaagctgctggaagttaaagtggcggacaaggaggaaacaaaacgaaataagcaaattgcaaccgccatgtcgaaattggtcctcgggtacaaggctgactttgccacggtggcaatggtgaacggaaatgagtggaagatcgatctgtcaagcgaaactagcgaggacgagattgaaaaattccgcgaggaattatccgatgctcagaacgacatcctgaccgagatcacatctctcttcagccagattatgcttaatgaaatagtccctaacggtatgtccatctcagagagtatgatggatagatactggactcatgagaggcagctggccgaagttaaggagtatttggcgacccaaccagccagcgcacggaaagaatttgaccaggtgtacaacaagtatattggccaggctcccaaagagaaggggttcgatctagagaagggactgaaaaagatcctctctaaaaaggaaaattggaaagagatagacgaactgcttaaggccggcgattttctgcctaagcaacgcatttccgctaacggtgtaatcccacaccagatgcatcagcaggagttggacagaatcattgaaaaacaagccaagtactatccgtggctcgcaacagagaatcccgccaccggggagagggatcgtcaccaggctaaatacgaactggaccagttagtgtcattccggatcccttattacgtcggaccactggtgacgcccgaggttcagaaggcgactagcggcgcaaaatttgcctgggctaagcgaaaagaagacggcgagattacaccttggaacctatgggataagatagacagagccgaaagtgcagaggccttcatcaagaggatgaccgtgaaagatacttacctcctgaatgaggacgtccttccagctaactctttgctgtatcaaaagtacaatgtgctcaacgaactgaataacgtacgcgttaatgggcggagactttccgtgggaattaaacaggatatctatacagagctgtttaagaaaaagaagaccgtcaaagccagcgacgtggcatcgttggtcatggcgaagacgaggggtgtgaacaaaccctctgttgaaggcctctccgatccgaagaaattcaattcaaacctggctacctacttagacctgaagagtatcgtgggggataaggtagacgataatcgctatcagatggacctagagaacattatagaatggcgaagcgtctttgaggatggagagatcttcgccgacaaactcacagaagtggagtggctgactgacgaacagcggtccgcacttgttaagaaacgttacaagggctggggtagattgtctaaaaagctgctcaccgggattgtggatgagaacggccaaaggatcattgacctgatgtggaatacagatcagaactttatgcagatcgtcaatcagcctgtgttcaaggagcaaatagaccagttaaaccagaaagccatcactaatgatggaatgaccctgcgcgaacgggtagagagcgtgcttgacgatgcttatacatcaccccaaaacaagaaagccatttggcaggttgtcagagtggtggaagacatcgtcaaggcagttggcaatgctccaaaaagtatttccatcgagtttgccaggaacgaagggaataagggagagataacccgaagccgccggactcagttgcagaaactcttcgaggatcaagcgcacgaactggtgaaggacacgtctctaacagaggaactggagaaggtgcctgatctctcagacagatactacttctattttacccagggtggcaaagatatgtacactggggaccccattaacttcgacgaaatcagtaccaagtatgatattgaccatatcctgccacagagctttgtaaaagatgactcccttgataatagggtcttgacatctcgtaaggagaacaataaaaagtcggaccaggtgcccgccaagctgtacgctgcaaaaatgaagccttattggaaccaattactcaaacagggactgataacccagcgcaagttcgagaatcttactatggatgttgaccagacaatcaaataccggagcctgggctttgtgaagagacaattggtcgaaacgcgacaggtgattaagctcaccgccaacatcctgggttccatgtatcaggaggctgggactgatattatcgaaacaagggccggcctaaccaaacaactgcgggaggagttcgacctcccaaaggttcgcgaggtgaacgattaccaccatgcagtagacgcgtacctgacaacttttgccggacagtatcttaatagaaggtacccgaaattgcggtcattctttgtctatggcgagtacatgaagttcaaacacgggagtgacctgaagttacgaaactttaatttctttcatgaactcatggagggagataagtctcagggtaaagtggtggaccagcaaaccggcgaactgataacgaccagagatgaggtcgctgactatttcgattgggttcaggaccttaagctgatgctagtgacaaaagagctcaagcgcagcaacgggaaactgttcgatgccactattcagaatgcaaactacaccaagttgaatgaaaggaagaaagtatttgtgcccctgaagaaagagttagacaagacactctatggatcctactcaggcatccagagctcttacatgactatcgtcaaaaagttcgataaaaagggttccacctatgctgtgcaacgtattcctgttatgtacagtaagctgcttgaactggagaaagaacagagcaagttgaaccggctcgtgcagtctatcgtcacgtccgacccacaggcccccaataactttgaggtgctgatgccttgcgttctatcagggcaactggtgattgataatggcagaaaattcacacttaccagttataggtaccagtgtagcactgcacagctctttctgccaaagaaagacttgaagtatatacagaacaatttcaaggagctgaaaaagacacccgataaacaagacaagatctttgaaaccatttacgacgatatcttaaaacaggtcgacaagtatttctcgctctacgatattaacaagtttcgctccaaactgcacgacggaaaggataaattccttgccctggagaattttggcgaaaaggagtctaaagacaaggtaatcactaagatattgcgagggctccacgctaacgcggaaagaaccagcctgaaagagatcggactatcaacaccgctgggccagttccaaagtggtgaagggggaattacgctttccgataacaccaagatcatttaccagtctcctactggcctcttcgaacggcatgtgtatctgaaagacttgtga

SEQ ID NO: 3171 - RNA, 4128 nt, synthetic construct
  misc_feature 1..4128: note = Cas9 variant
  source 1..4128: mol_type = other RNA
atgagaaagaaccaggagccctacaatatcggcctggacattgggaccagctccataggatggtctatcatgaacgataatttcgacctcatgagggtgaagggtaagaaaggcattggggtccggctttataacgaaggacaatcagccgctgagcgccgaatgcaccgtacagcaagaaggcggtacggccgcagaaagtggaggctgcggttgttagaagactttttcgatgagcatatggccgaagttgatgacacgtttttcgcgcgcctgaaagatagtaatatcagccctaaggacgataagaaatatcgaaagtccctactctttccaaaatctaagggtgtgacttaccaggacgatggggagttctataaaaagtacccgaccatgtatcacctgagatacgctcttatgacagagcataggaagtttgacctgcgggaaatttacttggccttccaccatatggtaaaatatcgtggaaactttctctacgatacttcggtggactcattcgaggcaaagaatctggacatcaaaggcaagtttgatgaaataaacgacctgctcagcagttataccgatttctacgtcgacaattccaacgccgctttagtggagtctatcctgcttgagaaaaatacaacccgcaaggataaaagcaagaagattgcaaaattgctgcacgttgaagacaaggagaaaggcaagaacaaaaaggccaaggatctagctactcagatctccaatgccgtgctcgggctgaaatgcaactttcaccttattttcgaactgcagcaaaagtattcattcgacttgtgtagtgagaaaacagaagagaatatcgcgaagctcagcgaggtcctggatgaaaaccagaaaatgttactgatgatactcaaggaggtgcaggaccaggtaatgcttaacgcatttgttccctctggaatgtccctgtcagaagccatgatgcaaaagtacgatgactatggtgagcagttgaaaatttaccatgaactagagcacagcgtgagtgacgattctgctgccaagctgagaggcgcatacagggactataatgataacatcattaaacggatcgacggggataataagaaagacaccttctacaagcgagtcaagaacatcctcacgaaaatttccaaggagtatgtggatcaggacgtgctggaaagctgcggaaaacttaagaaactgatagatgagaataagttgtttatccgccagagaactgctgccaacggcgtcctccctcatcaactgcaccagattgaaatgaggaaaatcatagacaatcagaaggagtactatccatggttagcggaacccaaccctaatgagaagcggcgcgtttactcgaaatataaggtggaggaactgattgccttcagaatcccatactacgtaggtcccctagtggatcctaacaatgcagacaaaaacaaggaggctaggttttcttggatggtccgtaaaaaggatggggaaatcaccccatggaatttctatgacaaggtggactgggccgagtccgctaacaattttattgagcggatgaaatcaaaggatacatacctcctgggagaagacgttgtgccgaaagagagtatgctttatcaaaagtacgaagtcttgaacgagctgaacaatctccgaatcaacgatagcggcctgtccgactctttcgaagatgtgaaacttaagcaggccatttataatgacctgtttaagaaacagaagatagtaaaaatcactgatttgcagaactacctcgttcaaaatcacaagtatctggtgaaacccaagattagcggcttagcagacgagaacagattcctgtcaagtctatccacctacagcgatctcaagacaatctttggggacaaagtcgatgacaggacctacttcaatgattttgagaagatggtggaatattctacggtcttcgaggacggacatgactacaaccagaaactggatgaatatacttggcttacaaaggaggaaaaatacaagatcggtaaaaagcgctatcggggctgggggaagttgtcaaagaagctgctcaccggactgagagacaaaaataaccacactattatggataatttatgggagacaaacaggaatttcatgcagatacagaccgccgacgagtttagtaagcaaatcgctgaagagaacgaacgccatctgaaaggcagcgtgtccgatgcgattaatgacatgtacacgtctcctgcaaacaagaaggccatccgacaggttcttcgggtggtagatgacattcagaaagctatgggttatgccccatcgagcatctccttggagttcgcacgtgaagatgggccctcagtcagaaccgtgagtagggccaaccgcatgaagtctatatacgagaaatacgctagcgaggtttccgaagaggtgatgaaggacctcgatggcgtcatcaaagacaagaagggactgaatgaccggctatatctgtactttgaacagcaaggcaaagatatgtattcagggcaccctctcgacttcgataaggtgattagcggacaggagtacgacatcgatcatattctgccacaggccgtaatcaaagacgattctcttgacaacagagtgttgacaactaaggcactgaataacgatgttaaatccaagggtgtcccctgtaggatgtttaatggcatgcacagtttctggaagaacttatatgacaaagggtttataagccgacgcaagttcaataacctcaccacaaatccggagaacattgataaatacaagatgaaaggatttgtgaatcggcagctggtggaaactagacaaatcattaaacttgtcgcgaacgttctgaatgacaagtatcagaacgatgacgtggacatcatagaggtgagggctgaattgacccacgatgtacgtaaacatttcaagttttacaaaaatcgcaacgtcaacgactaccaccatgccttcgatgcatatctcacatcttttatcggccactacctgttcaagaaatatcctaatctacggcccctgttcgactacaacgattttatgaaggtgtccgacaatgttttcaaacagctcagaggtaacaattttctgggggagttccttaacaagaccggcgatattatctcaactgacggaaattttgtgttgaacaaggaagagatgattaataaactgaacaaggcctatgctttcaaaaagatcttagtcacgaaagaggtgggccaaaggacaggggccatgtttaatgaaacccgatacccagcacctaacagtcggaaggctgccctcaagtatcgcagaatgcccaaaccagatagcctgatatcggttaaggactacaaaaatactgatatttacggaggttattccggcaagaacgacgcgtacatggtgatcgtagatatggggaaacagtatatggtcgtgggagtgcccgtcaggtacaccgagaaacttgacaagctgcggatcaaacactctgaactatatcgagacgagctcagaaaggttctgagccgcgataaaacattgctggactcaaagggcaatgtgaaaaggttcgatattgtattagaccgtgtgctctacggtcagctgatcgaagatgggaacgagctttttaccctgggcagttccaagtataagcggaatttcagacagttgtttctcgacaaacaatgcattgagatactggattctagcgccactcctcagccaacagacgaggaactaatctgggtctacgatcagattctggacaaggtggataaatacttcgaactttatgacatcaacaggcagcgcgagacgctccgaaagggcagagctgcattctgttccctgccgaacatttcaatgaaaaaggacgatgttaccaaaaagaagatcttgaatgaaatactggtggccttacatgctaacgagagcgagagtaattgcgaaaagatcggaaagaaagtctttgggcggctccaagtgcccggaggcattaagctgtctaaagaggccaaacttatctaccagtcccctactggtctgttcgaaagggttgtgtatttgaaggacctctga

SEQ ID NO: 3172 - RNA, 4128 nt, synthetic construct
  misc_feature 1..4128: note = Cas9 variant
  source 1..4128: mol_type = other RNA
atggagaacaagaaatacagcatcggcctggacattgggacctcctctataggattcgccgtggtcgatgaaaataacagagttatgagggtgaagggtaaaaatgctatcggcgtacggctcttttcagaggggcagcccgcagccgaccgccgaagtttccgtacaactagaaggcggcttagccgcagaaggtggcggctgcgcttgttacgagaaatttttgagccttatatcaacccagtggatgaagcgttctttatgagactgaaggagtccaatctatctccgaaagacgctaacaagcactactcgggagatattctcttcaataaccaaacggaccaggatttttatgagaagtaccccaccatctatcatctgaggcacgcccttatgacagaacatcggaaattcgacgtccgtgagatatacctggcaatccaccatattgtgaagtttcgcggccacttcttgaatgccgcttcagcaagcaactttactgttggtaaactcaatctggaagggaagttcgatgccctgaacgagatctatcagagagtgctcaccgacgatccttttgctttaaggacagacaatctggatcacattaaagagatccttatagacaacaagcggagtcaggccgaccgacaacgcaccttgactggagatgtctaccagtcctctgaagagaaggaaattgagaaaagaaataaggcgatcgcaacagaaattctgaaagccgctgtgggcaacaaggccaaactaaacgtaatcaccaatgttgaggtggacaaggaggcagctaaagattggagcctcacgttcgactccgaaactatcgatgacgagctggccaaggtcgatggccagatgaccgacgatgggagggaaattatagagatccttcggtcactgtacagtggaattacattggcggccatcgtgccagaaaaccatactctcagccagtctatggtggagaagtataattcccacaaagcacatctgaagttactgaaagacctcataaacaatatgaccgatacaaagaaagctaagaaccttcgcgccgcttacgacggttatattgacggcgtcaaggggaaagttctgaccagagatgacttctacaagcaaatccagggaaatttggatgactcagccgaggcacagaaaatccaggatgtgatggaccaagatgaatttatgcccaagcagaggacgaaagccaacggcagcattcctcaccagctacaacagcaggagctggaccagatcgtagaaaatcaaaaggagtattacccatggctcgctgaagagaaccccaatgagactcgtcggggtgtggcgaagtataaactggatgaacttgtcacattccgagtgccttactacgttgggccaatgattaccgcagaggaccaggaaaagcagagtggagcctcttttgcttggatgaaaagaaaggagccgggcaacataactccctggaatttcgatcagaaagtggacaggatggcctccgcaaaccaatttatcaagcgcatgacaaccacggatacctatctgttgggcgaggacgtcctccctgcccagagcctgttataccagcggttcgaagtgctgaatgagctaaacaagattagaatcgacaggaaaccaatctcgattgaactcaagcagcaaatatttaacgatctgttcaaaaagtttaaaaatgtaacaatcaagcaccttcaggagtatttggttgctactgggggatacgacaaacgcccccgaattgatggtctggccgacgaaaagcggttcaactctggcctctccgcatatcatgatctgcacgggatccttggagcggaggtggtcgacgctaatgataagcaggacgatctggagaaaattatcgaatggtcaaccatatttgaggacaagaaaatctaccgtgccaagttggatgaactcacatggctgactgacagtcagaaagagaagttagcaaccaagagatatcaaggctggggtaggctgagcaaaaagctactctccgggctgcgcaactctgatcatcggagcattcttgacatcttgtggattacaaatgaaaacttcatgcagatccaggccgaccctgattttgctgagctggtgaaaaatgccaaccaaggcatgctcggaaagaataactcacaggacgtcataaatgatctgtacaccagtccacagaacaaaaaggcaattagacagatcttactggtggttcacgacattcaaaatgctatgcatggccaggcccccgcgaagatccacgtggagttcgccaggggagaagaacgaaacccgcgccggtccatacagagacagcaccaaatcgaagctgcatacgataaagtaactagcgaccttttggtcgatgccggggtgaggcaggagctcaaggacgctattaatgataaacgtgacttcaaggatcgcctgtttctatatttcatgcagggtggccgggacatctacaacggggaacctattaacatcgacagactgtcttcatatgatatagaccatattctcccccaggcctttgttaaagatgacagtctgaataacagggtgcttacggatgcagagggaaatcgacgcaagagcgacgcggtcccatccgagttgttcggcgccaagatgcggtctacatgggaactgatgagagagcaaggtttaatctcgaaagctaagtacaggaacctcaccatgaatcctgaaaacatcaatgcccacactgagaacgggtttattaatcggcagctggtggagacccgacaggtaatcaaacttgcagtgaacattctggctgatgaatatacagaggacacccaaatagttagcgtcaaggccgatttgtcccatcagatgagagaagacttcgagctcctgaaaaatcgcgatgtgaacgactaccaccacgcatttgatgcctatctagctgcgttcatcggcaattacctgctcgaaaggtaccccaagctgcagtcatattttgtgtacggagacttcaaaaagtttagtcagaaggacactaaaatgcgtcggttcaactttatttatgatcttaagcattctgaccaaatcgccgataaaaatggcaagaaaatttggcacaagacaaacgacttggattacatcagacatctgttcgcatataagaaaatattaatcagccacgaggtctccgagaggcgcggggctctctacaaccagacggtttataaggcctcagacgataaagccagcggacagggttctaagaaactgattccaatcaaggctaataagcccaccgaaatttacggcgggtacactggaaaaacacttgcatatatggccatcgtgaaggtgataaaaggcaagaaaattgcgtacaaggtagtcggtgtgcctacctccgctctggttcagctagccgggatcgagcatggcagtcaagaggagctcaaccgactgtatgacgtgttgaagccacagttcacacagctgaaaaagaataacaaaactggagaaatcagcgagaccgtctctaagtttgagattgtgataccgagagttaaataccagcaattagtggaagatgacgataaactcttcatgatcggctccgacacgtatccctacaatgcacagcagctggtactttcagagggggccctgaaggtcattaacaatgtgtatcggaagggagaaaacagtgataagcaggagagctacaaattggacgacgtgtacgatgaaatcattatcgctatgaagaaatattttcctctctacgacaataggggcttccgcgagaaggtcgcagagggtaaatcgacctttgaaaacctgccaatatccaatgagttcaagaacgggaagctaacaaaaatcggaaagaaagaagttattaatcgtatgctgcaaggccttcacgccaacgcgactatgaccgatctcaagatcctgggtattaaatctccctttggcttcatgcagcagcctacagggatcgctttgagcgagaatgcccaactgatatatcagtcaccaactgacttatttgagagacgggtgcagctcaacaagattaagtga

SEQ ID NO: 3173 - RNA, 4128 nt, synthetic construct
  misc_feature 1..4128: note = Cas9 variant
  source 1..4128: mol_type = other RNA
atgaagaaaatcctgggcctcgaccttgggaccacaagcattggatgggccctggtgtacgagtccgaaaacactgatgagaagtcttcaatagtcagattgggtgttagggtgaatcccttaagtgtagacgaaaaaggcaacttcgagaaggggaaagctatcacgaccaatgcagatcggcagcaaacacacggagcccgcattaacctgcagcgatataagctacgtagagaaaatctcaaggactgcctgcagaaacagggctggatcggtactgaggcgctttgtgaggaagggaagaccagcacatttgagacctacatgctgagggctaaagccgcagaagaggagatttccttgcatgaactctgccgggtgctgttcatgatgaacaagaaacgcggatataagtctaatagaaaggccaacaataaagaggatggcaagctgtttgacggcatgactgtcgctaaaaagctctacgaggaacacttaactcctgcagaatattcgttccaactgctttcaagcgggaaaaagtttaaacaggagtactataggagtgatttgaaggaggaatttgaccggatctggaacgagcagcagaagtactacccagaaatactgaccgatgactttaaacaacagctacagggaaagtccaaaggtaatacgtctaagatcttcctcggcaaatatgggatttacagcgccgatctgaagggacttgaccgcaagctgcagccgttgaaatggcgagtggaggctctcaagcaacaggttgataaagaagtgctggcctttgtcatctccgacttaaacggccagattgcgtcaacaagtggtctgctcggggcaatcagcgacagatctaaggagctttatttcaataaacaaaccgtgggacagtacctgtggacatccttgaaggagactccccatgtatcaataaagaacaaacctttttataggcaggattacctagacgagttcgaaaagatttgggaaacccaggccacatatcacaaagagctgaccccagaactcaagcaagagatccgggatattatcatcttttaccagcgtcccctgaaaagcaagaagggccttattagtgtttgtgagctggaacagcgcaaagtgaaggtcacgatagacggcaaagagaaggaaatctctattgggcctaaagtggctccaaagtccagccccatgttccaggagttcagaatctggcaaaatttgaacaacatactcctgattgataaaggaaataactcgatccatcctttatacgaggaagagaagaatctgctatatgaggaactctctgtgaaggaaaaactgtccaaggccgaggcacttaaagtcttgaacaaaaattcaaaacagtgggacctgaactacaaggagatcgaaggtaataggactcaggctgttctctatgattgctacaaccggattatcgtgatgacaggccacgaggaatataattttaagaaactgaaggccagtgagattcgaagctacgtaaaaaccactttcacagggcttggatttaacaccgacatactggagttcgattcctctttgacgggccacgaactcgagaagcagccaatgtatcaactgtggcatttactgtacagctacgaatcagacaatagtcgcaccggtaacgatgcgctactcagaaaactggagacagcctttgggttcccgaaggaatatgcagctgtgctttccgacgtcgtgtttgaggacagctacggcaatttgtctgttaaggccatgaggaaaatcctgccccacctccaggctggactgaactattcacaggcctgtgaagaggcaggctacaagcatagtcggcgcagcttaactaaaaatgagctggatcagaaggaatataaagagaaacttgaattgctccctaagaactccctgcacaacccagtggtcgagaaaattctaaatcaaatgatcaacgtgatcaatgccgtaattgacgagtacgggaagcccgatgaaataagaatcgagctggctagggaactcaaaattggagcggcagagcgtgaaaacatgacccggtctatcaatcagggtaacgccgagaataagcgaattagagagatcctggaaaaagagttcgctctttcgtatataagcaggaacgacatcattaagtacaaattgtacgaggaactgaagtccaatggctttaagacattatattcagatacttacatcagtaaagacaaactcttctctaaggattttgacattgaacacatcatacctaaggcccgcctgttcgatgacagcctttccaacaaaaccattgaggcacgggatgttaatatcgccaagtcaaacaagacagcttttgacttcattagcgagaaatatgatcagcaagggatcgaagcctacaagaaaaagctggacatattgctccaggacggatctatctccaaagcaaagtataatagactgctaatgaaggaggcggatattccaagtggcttcatcgacagggatctgcgcgacacccagtacattgctaaaaaggcctatgaaatcctcagcgatctggtgcgaaacgtcactcccacgacaggtgcagtgacctctcggcttcgtgaggactggcagttggtcgatgtgatgaaagaactgaattttgagaagtaccaaaaattagggctcgttgaggtgatagaagacagagatggcaggaagattaagcgcatcaaagactggactaagcggaacgatcatagacaccatgccatggacgctctgaccatcgccttcacaaaaccgtcctacattcagtatcttaacaatctgaacgcaaggtcagataagaatagtagcatctacggaattgagaacaaagaactacaccgagaggacaataagctccgctttaacgctcctctgcccataaatgagttccgggccgaagcgagaaggcatttgaagtcgatcctggtatccgtcaaagccaagaacaaagtgatgacccagaatgttaacgtgattaagactaaacacggcgtcatcaagaaagtgcagttaacaccacgtggggagctccacaatgctacgttttatggaaccaagaagcgccctattatcaaaatggtaaaggtgggtgcagccctggacgaagttactataaagaaggtctctagctcattcatccgggaggcacttctggatagattgcatgaatacaacggcgacgccaaaaaggcatttacagggaggaatagtattgataagaaccccatctatattgacgaggagcacaaaaagaccgtgccagcgctcgtgaaaacaatcgaatgggagatgtaccatcccactcgaaagctgatatcccctgatctaaaaattgacaaggtcatcgataagggaatccgggaaattctgaaaacccgccttgccaagttcaatggcgacgctcaaaaagccttttctaacctcgatgagaacccaatatataaggacgaagctaaaaagatcacgctgaagagagttagcttggagggtgtgtcctcagtgattccgctgcacaccttaaaagatagggaggggaagctcgtagtcggcaaagacggaaagcccgtgctgggcgactacgttcagacaagcaataaccaccatatcgctttctacatggatgaaaatgggaaccttcaggacaatgtggtcagtttcttcgaggccgcagaacggaaatctcagggagtgcctgttattgataagaactataatcacgacaaaggctggaactttctgttcactatgaagcaaaatgagtacttcgtgtttccaaacgaagtaaccggtttcaatccctccgaggtcgatttgatggacgaggccaactatagcatcatatcgcctaatctctaccgagtgcagaagatgtcaaaggcttctgggagagattattggtttcgccatcacctggaagcgatgctaaacgacgatccaaagctgaggaatagtatgttcaaacgtatcacatcccttaaggccctcgagggaattgtgaaagtccggatcaactgcattggcaagatcgttgcagtgggtgaatacgactga

SEQ ID NO: 3174 - RNA, 4128 nt, synthetic construct
  misc_feature 1..4128: note = Cas9 variant
  source 1..4128: mol_type = other RNA
atgagcaacaagtcctactctatcggcctggacattgggaccaattcagtgggatgggccgtcataacagatgactataaagttcccagtaagaaaatgaaggtgctcggtaacactgataaacacttcatcaagaagaatcttattggcgctctgttgtttgacgaggggacgaccgcagaagatagaaggttaaaacggacagcccgccgacgttacactagaaggaagaaccggctgcgctatctacaggagatcttcagccaagaaatttccaaagtagactcttcgtttttccatagactcgatgactttttcctggtgcctgaggataagaggggatcaaaatacccaatctttgcgacccttgtcgaagagaaggagtatcacaagaaattcccgacaatataccatctgcggaagcacttggctgacagcaaagaaaagaccgatctccgcctgatctatctggccctcgcacatatgattaaataccgaggccactttttatacgaggaaagtttcgacatcaagaataacgatattcagaaaatcttttccgagttcatatctatttatgacaatacttttgagggtaagagcctgtccgggcagaacgcccaggtggaagctatcttcacagacaagatttcaaaaagtaccaagagagagagggttcttaaattgttccccgatgaaaagagcacgggactgttttctgagttcctaaaactcatcgtgggcaatcaagcagactttaagaagcacttcgatctggaagagaaagcccctcttcagttttccaaggacacttacgatgaggacctggaaaacttgctcggccagatcggggatgacttcgctgatctgtttttagtcgccaaaaagctgtatgacgcgattctcctttcaggaatactgaccgtgaaagatttgagcacaaaggcaccactaagtgcctctatgatcgagcggtacgaaaatcatcagaaggacctggctgccctcaaacaattcattcagaacaatctgcaggagaagtatgacgaagtattttccgatcagagcaaagacggttacgcaggctatatcgatgggaagactacccaagaggctttctacaaatacataaagaaccttctgtcgaagtttgagggagccgactatttcttggataaaattgaacgtgaggactttctcaagaaacagcgcacattcgataatggctctatcccccaccagatccatctgcaagaaatgaacgcgattatcagaaggcagggtgagcactaccctttcttacaggaaaacaaggagaaaattgagaagatactgacctttcggatcccatattacgttgggcccctagcccgaggaaatggcgacttcgcatggctcacgcgcaactccgatcaggctattagaccttggaattttgaagagatcgtggaccaagcctcaagtgctgaagatttcatcaacaaaatgactaattatgacctgtaccttccagaggagaaggtcttgccgaagcacagcctgctctatgaaacatttgccgtgtacaacgagctgaccaaagtgaagttcattgcagaaggccttactaggtaccagtttctggataaaaagcagaaaaaggacatattcgacacatttttcaaggccgagaataaacggaaggtcaccgaaaaagatatcattcattatttgcacaacgttgacgggtacgatggaatcgagctcaagggtattgagaaacagtttaatgcttccctgtctacgtatcatgacttactgaagatcataaaggataaagcgttcatggacgatagcaagaacgaagagatcctagaaaatattatccacaccctcacaatttttgaggaccgcgaaatgatcaaacaaagactggcacagtacgattcacttttcgacgagaaggtgataaaagccttgactaggcgtcattataccggctgggggaagctgagtgctaagctcattaacggaatccgggataaaaagtccggcaaaacaattctggactacttaatcgatgacggtgagataaatcgaaacttcatgcagctgatccacgacgatgggcttagctttaaggaaattatccagaaagcccaagtattcggcaagactaatgacgtgaaacaggtcgtgcaggagttgcccggatctcctgcaattaagaagggcatcctccagtcaataaaaattgttgatgaactggtgaaggtcatggggcacgccccagagagtatcgtgatcgaaatggctagagagaaccaaaccacagccaggggaaagaagaacagccagcagcgctataaacggattgaggactccctaaagaatctggcatctggtctcgattcgaacatcctgaaggaaaatcccaccgacaacattcaacttcagaatgatagattgtttctgtactacttacagaacggcagggacatgtatactgggaaacctctcgagataaatcagctgagcaactacgatatcgaccatattatcccacaagcgttcattaaggatgactcccttgacaatcgcgtactgacgtcaagtaaagataaccgaggaaagtctgacaatgttcccagcttggaagtggtcgagaaaatgaaggctttttggcagcagctcctggattccaagctaatctcagagcggaaattcaacaatctgacaaaggccgaacgtgagagaggcggtctcaacgaactggacaaagtggggtttataaagaggcagcttgtcgagacccgccaaatcactaaacacgtggcacagttcttggatgcccggtttaataaggaagttaccgagaaggacaaaaagaacagaaacgtgaaaattatcacactgaaaagcaatttagtatctaacttcaggaaagagtttggcctctataaggtccgagaaattaatgattaccatcacgctcacgacgcctatctgaacgcagtgcttgctaaggccatcctgaaaaagtacccgaaactagagcctgagttcgtttatggagattaccagaagtacgacctccagcgctatatatccaaaagtcgggaacccaaggaagtggagaaagcgacccaaaagtacttcttttatagcaatctgttgaacttctttaaggaggaagtccattacgccgatggcactattgtgaaaagagagaatatcgaatattctaaggacacaggggagatcgcttggaacaaagaaaaggatttcgcaacggtgaaaaaggtactgtccttaccacaggttaatattgtcaagaaaaccgaggtgcagactggaggtttttcaaaggagagtatactccctaaaggcaacagcgacaagctgatccccaggaaaacaaaggaaattctttgggacaccacaaagtacgggggattcgattcgccagtgatcgcctattccattctgttgatcgctgacatagagaaaggcaaggccaaaaagctcaaaactgtcaagaccctggttggtatcacgattatggaaaaggcaacctttgagaaaaatcccatcacattcctagagaacaaggggtaccacaatgtgcgtaaagaaaacattctgtgccttcctaagtactctctctttgagctggaaagcggccgccggagaatgttggcgtcagccaaagagctgcaaaagggaaatgaaatcgtgttaccagtatatctcactaccctgctttaccatagtaaaaacgtccacaagctggatgagccggagcatttggaatatatacagaagcacaggtacgagttcaaagacctcctgaacctagtgtccgaattttctcagaagtatgttctggctgatgccaatcttgagaaaattaagaacctctacgcagacaatgaacaggctgatatcgagatcctggccaacagcttcattaatttgttaacatttactgcactgggcgcccccgctgcgttcaaattcctcgggaaggacgtggatcgaaagcggtataccacggtctccgagatcctgaacgccacacttatacaccaatcaattaccggactgtacgaaactcgcatcgacttgagcaaactaggcgaggattga

SEQ ID NO: 3175 - RNA, 4128 nt, synthetic construct
  misc_feature 1..4128: note = Cas9 variant
  source 1..4128: mol_type = other RNA
atggagaagaaatacagcatcggcctggacattgggaccaactccgtgggatgggccgtcataacagatgactataaggttccctctaaaaagttcaaagtgctcggtaatactaacagaaagtcaatcaagaaaaatcttatgggcgctctgttgtttgatagtggggaaacggcagaggccaccaggttaaagcggacagcgcgccgacgttacactagaaggaaaaaccggattcgctatctgcaggaaatcttcgctaatgagatggccaagctagacgatagctttttccaaagactcgaagagtcctttctggtagaggaagacaaaaagaacgagaggcaccctattttcggaaatcttgcagatgaagtggcctaccatcggaactatccaaccatctaccatctgcgcaagaaattggctgactctccggagaaggcagatctccgactgatatatctggccctcgctcacatcattaaatttagaggccacttcttaatcgagggtaagctgaatgccgaaaactcggacgtcgcgaaactgttttaccagttgattcagacatacaatcagctgttcgaggaatcacccctagatgagatcgaagtggacgcaaaggggatactcagcgccaggctgagtaaatccaagcggcttgagaagctgattgctgtttttcctaacgagaaaaagaatggattgttcggcaacatcattgccctcgcactgggcttaaccccaaattttaaatctaacttcgatctgactgaagacgctaagctccaacttagcaaagacacatatgatgacgatctggacgagttgctagggcagatcggagatcagtacgccgacctgttctccgcggccaagaacctctcagatgcaatcctgcttagtgacattctgcgtagcaattctgaagtgaccaaggctcccttgtccgcctcaatggtcaaacgctatgatgagcatcaccaggacctcgctctgttaaagacgctggtgagacaacagtttcctgaaaaatacgccgagatattcaaggatgacactaaaaacggttatgcaggctacgtagggatcggaattaagcacaggaagcggaccacaaaactagccactcaggaggaattttataagttcatcaaaccaatactcgagaagatggacggcgctgaggaactgcttgcgaaattgaatcgagatgacctgctccgcaagcagagaacctttgataacggtagcattccccatcaaatccacctgaaggaacttcatgcaatcctgaggcggcaggaggagttctaccctttcttgaaagaaaatcgcgagaagattgagaaaatcctcacattcaggattccatactatgttgggccgctggccagaggaaacagtcgttttgcttggttaacccggaagtctgaagaggccataacgccctggaatttcgaagaggtggtcgacaaaggcgcatccgcccagagctttatcgaacgaatgactaacttcgatgagcaactgcctaataagaaagtgctaccaaagcactcgctcctgtacgaatattttacagtgtacaacgagcttaccaaggtcaaatatgttactgagagaatgaggaagcccgaatttttgtctggcgagcagaaaaaggctattgtggaccttctcttcaaaacaaatcgcaaggtaaccgtgaagcagctgaaagaagattactttaagaaaatcgagtgcttcgactccgtcgaaatcattggggtggaggatcggtttaacgcctcattaggaacgtatcacgacctgcttaagataatcaaagataaggacttcttggataatgaggaaaacgaggacattctcgaagacatcgttctgaccctaacactgtttgaggatagagaaatgattgaggagaggctcaagacttacgcacatctgttcgacgataaagtgatgaagcagcttaaacgccgacactacaccggttggggccggttgagtcgtaagatgatcaatgggataagagacaaacaaagcggaaagacaatcctggactttttaaagtccgatggcttctctaacaggaactttatgcagctcattcatgatgacagcctgactttcaaagaagagatcgaaaaggcgcaggtctcaggtcagggggatagtcttcacgagcaaattgctgacctggccggctcccctgcaatcaaaaagggaatattgcagaccgtgaaaattgtagatgagctcgttaaggtgatgggccataaaccagaaaatatcgtcattgagatggcccgcgaaaaccagacaaccactaaggggctgcagcaaagccgggagagaaagaaaaggatcgaagagggaataaaggagctagaatctcagatcctgaaagagaatcccgtggaaaacacgcagctccagaatgagaagctgtatctttactatttgcaaaacggtcgagacatgtacgtcgatcaggaactggacattaatcgcttatcagactatgatgtggaccacatcgttccgcagagttttattaaagatgacagcatcgataacaaggtgctcacacggtccgtagagaatagaggcaagtctgacaacgtcccttcggaggaagtggttaaaaagatgaaaaattactggaggcaactgcttaacgctaagctgataacccagcgtaaattcgataatctaactaaggccgagcgcgggggactcagcgaagcagacaaggctggctttattaaacggcagctggtggagaccagacagatcacaaagcacgtcgccaggatcttggattcccgaatgaacaccaaacgggacaagaatgataaacccattcgcgaagtgaaggtaatcactctgaagtcaaaattagtgagtgacttcagaaaggacttccaactctataaagttagggatattaacaactaccatcacgcgcatgacgcctacctgaatgctgtcgtgggtacagcacttataaagaaatatccaaagctggagtctgagtttgtgtacggggattataaggtctacgacgttcggaaaatgatcgccaagagcgaacaggagattggcaaagctacggccaagcgattcttttattccaacatcatgaatttctttaaaaccgaagtgaagttggcaaacggagagattagaaaacgccctctcatcgagactaatggcgaaacaggggaggtggtatggaacaaggaaaaggatttcgcgaccgtcaggaaagtgctggccatgccccaggttaatatagtgaagaaaacagaggtccagactggaggtttttcaaaggaaagcatcctatctaaacgtgagtccgctaagctgattccacggaagaaaggctgggacaccagaaagtacgggggattcggcagtcccacggtggcctatagcatccttgttgtggcaaaagtagagaagggtaaagctaagaagctcaaatctgtcaaggtgctggtggggattaccatcatggaaaaaggctcctacgagaaggatcctataggatttttggaagccaaaggctacaaggacattaagaaagagctgatcttcaagttaccaaaatattcactctttgaactggagaacgggaggcgccgaatgcttgcaagtgccacagagctgcaaaaggctaatgaattggtcctcccgcagcacctggttagactactgtactatactcagaacatcagcgcgaccacaggatcgaataaccttggctacattgagcagcaccgggaagagttcaaagaaatattcgagaagatcattgatttttccgagaaatatatcctcaagaataaggtgaactctaatctgaaaagctcattcgacgaacaatttgccgtaagtgattccattttgttatctaacagcttcgtgtccctgctcaagtacacttcatttggtgcaagcgggggattcacctttctggaccttgatgtcaaacagggcaggctgcgctatcagacggtgacagaggttttggacgctaccctaatctaccaaagtataactggtctgtacgaaacacgtaccgacctctctcagctgggcggggattga

SEQ ID NO: 3176 - RNA, 4128 nt, synthetic construct
  misc_feature 1..4128: note = Cas9 variant
  source 1..4128: mol_type = other RNA
atgaagaaaatcctgggcctcgaccttgggaccacaagcattggatgggccctggtgaacgagtccgaaaataaggatgagcagtcttcaatagtcagattgggtgttagggtgatccccttaactgtagacgaaaaaggcaacttcgagaaggggaaagctattacgaccaatgcagatcggcaacaggtgcacgccgcgcgcatcaacctgcagcgatacaagctacgtagagaaaatctcagggactgcctgcagaagcaaggatggattggcagtgagcctatgtgtgaggatggtaaaagctccacatttgaaacttataaacttcgggctaaagccgcagtcgaggaagtgtctctgcatgagttcgcccgcgttttgtttatgctcaacaagaaaagagggtacaagtcgaataggaaggctaacgacaaagaggaaggaaagctgttcgatggcatgaccatcgccaaaaagctgtatgaggaacacctcacaccagccgagtactcattacagctgcttaataccggccggaaatttactccggaatattaccgcagcgacttgatagaggagttcgaaaagatctggaacgagcagcagaaatattaccccgaaattctgacagatgagtttaagcaacagctagaagggaaggctaaaagtaatacctccaaactcttcctgggaaaatacggtatctattctgccgacacgaagggccttgatcgaagactgcagcctttgaaatggagggtggaggcgatgaagcagcaagtcgacaaggatgtgctcgcatttgtaattagcgacctgaaagggcagatcgccaacacttccggattactgggcgctatatcagaccggagtaaggagctctacttcagcaaacagaccattggtcaatatctttgggcctctctgcaggaaaatccacatatctccattaagaaccagcccttttaccgtcaggattatttggacgagttcgaaaagatctgggagacacaagcaacttaccacaaggaactaacctcagagctgaagcaggagatccgcgatattataatcttttatcagagacctctcaaaagcaagaaaaatctgattgctgtttgcgaacttgagcagaggaaggtgaaagtcacagtggacgggaaggaaaaggagatcaccataggaccaaaaattgcccccaagagttctcctatgttccaagagttccggatctggcagaacctgaacaatatcttgctcctggatcatgaaacgaactccaaacgaccattatacgaggaggaacgcaatctgctatacgaggaactcagcgtgaaggagaaactgtcgaagactgaagcgcttaaagtcttgggcaagaagtctaaacagtgggacctgaactataaggagctcgaaggcaatagaacacaggccgttctgtacgattgttataacaggattatcgtgatgtccgggcacgaggaatgcaattttaaaaagctgaaagcatcagacattcggcactacgtaaagatgatattcaagaacctggcttttaataccgatatcttgtgtttcgacagtagcctcaaaggacatgagctggagcgccaaccgatgtgccagttatggcaccttctatattcctacgaaggtgataactctagaactggcaatgacgccctcctgaggaaacttgagacaagttttgggttccccaaggaatatgctgccgtgttggcagacgtcatttttgaggattcatacggaaacctgagtgtgaaggccatgcgtaatatcctccctcatctgcaggctggcaaagactactcccaggcgtgtgaagaggcaggttataagcacagccggcgatctttaaccaaggaggaactgaaccaaaaagtttacaaggagaaacttgaattgctcccaaagaactcactgcacaatcccgtggtcgagaaaatcctaaaccagatggtgaatgtaattaacgccgttatagaggaatatgggaagcctgatgagatcagaattgaactggctagggacctcaagatcggcgccgcagagcgcgaaaatatgacgcggagtattaaccagggaaatgccgagaacaaaagaatcagggagatactggaaaaggagttcgctcttagctacttgtcccgcaatgatatcattaaatataagctgtacgaagagttaaaatctaacggctttaagaccctctattcggacacatacatcagcaaagataagctgttctccaaggactttgatattgaacatatcataccaaaagcccgacttttcgacgattcactgagtaataagactattgaggcacgggacgtgaacatcgcgaaatctaataagaccgcttttgatttcattttggagcgttacggggaacaaggagtcaaaacatataagactaagctcctgagactactggaggacggtgccatcagcaacaaaaagtacaataacctcctgaaaaccgaagcagacataccctccggcttcatcgatagggaccttcgcaatacacagtatattgccaagaaggcttacgagatcttgtcagaactggtgaagattgtcaccccgactacggggagcgtgacaaaccggttaagagaggattggcagctcgttgacgtgatgaaggagctgaactttgaaaaatatcagaaacttggactggccgatgtaatcgaggacagggatggccgaaaggtcaagcgcataaaagactggaccaagcggaatgatcacagacatcacgcaatggacgctctaactattgccttcaccaagccttcttacatccaatatctcaacaatctgaacgcgaggtccgataaaagtagctctatctacggtattgaagtgaaggagttgcatcgtgaggaagggaaatttcgcttcaatgcacccctgccaatcaacgagtttcgggctgaagcaaagagacacttaaaatccgttctcgtgtcaattaaggccaagaaaaaggtcatgacacagaatgtgaacaaaataaagaccaaacacggcatcattaagaaagtacagctgactcctaggggagagcttcataatgctacatactatggcacgaagaagcgacccctggtgcggatggttaaagtcggggccgcattggacgaagcgaccatcaagcgcgtgtgcagtccagccattagagctgccctcctgaaaaggctaaacgcatacaatggagatgctaaggaggccttcactggtcggaacagcatcgacaaaaatcccatatatctggacatcgagcagacaaaacttgtgcctgtcctcgttaagaccattgaatggggcatgtaccacccaatccgaaagagaattacaccggatctgaagatcgacaaagtgatagataaggggattcgcgagaaattgaaggcaaggctggccgaatttaacggagacgctcaaaaggcgttctcgaatttagatgagaaccccatctatatggacgaagccaaacgtatcactctcaagcgggtgtccattgagggcgtactgtctgcaatacctcttcataccctgaaagataaggctggtaaaccagtcatcgggagcgacggcaagcccgtgtttggagattacgttcagacgtcaaacaatcaccacattgccttctatatcgacgataagggcaacttgcaggacaatcctgtgagctttttcgaggccgctgaaagaaaatcccagggggtcccagtgattgacaggcgctacaactgtgataagggatggcattttgttttcaccatgaaacaaaatgagtacttcgtgtttcccaacgaagcaacaggcttcatcccgtctgaggtagacctcctggatgaagccaattattgcataatcagccctaacctataccgagtccagaagctgtccaaagcgtcaggtagagactattggtttcggcaccatcttgagactatgctcaatgatgacctgaggttgaagaacagcaccttcaaacgcattcagagtttaaaggggctggaggatatcgtgaaggtgcgtattaattctatcggaaaaatagtcgctgttggcaagtacgactga

SEQ ID NO: 3177 - RNA, 4128 nt, synthetic construct
  misc_feature 1..4128: note = Cas9 variant
  source 1..4128: mol_type = other RNA
atggagaccaagttcacatactatctgggcctcgacatggggactgatagccttggatgggccgtgacggactcctcttaccacatcctgagagctaaaggtaaggatttgtggggcgtcaggttatttcccgcagccgaaacctcagttgaccggcgcacatatcgagtgaaccgtagaaggcggcagcgcgaggtagcgagaattggggctctgaaagaactattcgccgatgagatagaaaaggtggaccctggatttttcgtcaggctcgatgagagtaaatttcatatggaggaccggagcgaaaataacaagcaaaagtacggcctgttcgcagataaactattttccgacgccgagtattacaagaaatatccaactatcttccatctgcgcaaggaattgctcgagtctgaggaaccgcacgatgtgcgactggtttacctggctctcttaaatatgtttaaacacagaggtcatttcctgaactcgtcacttcagattgagggggaaaatagcaacatcgcagagagttaccagatgtttgtggacaccttgaaggatgaagaactggacttccccgagcaggtctccggagaaaggctacaagagatttttcggtctagcgactcccgtaagaaaaaggtggaaaatctcctggccgagatgaaccttagtaaaaagcagaaacgcgaaatccagttcgtaaatctgatatgcggcttgaagggcaaactctcagagctgttccctgataaggagtatgacgaagaacagaagaaaatcgcttttagcttccaagattctgactacgaagataaggagaacacaattcaggaattactggacgagtccgagatgaatatgatctatgccgttaaagcggtgcacgattcaggggtcctcagcggaattatgaacggtgaaagataccttagtgtggcaagggtggcctcttatgagaagcacaaaaaggacctgcagatcttgaaggatatacttaaaaagtacgacaccaaagaatattttgagatgttccggaatgagtccgaaaagagcgagaactactcggcttacgtcggctctgttaaatatcatgggacttttcgacgcggactgtccggcggtaagcaggaagatctctacaagcacattaaaaaggtgctggggaaattcccacaagacgacgagggagtaacatatgtgcttgaagagatcgagaccgaatcatttctgcccaagcagttgacggccagtaatggcgtcattcctaaccaggtgcatgcaagagagatgctcgctatcctgaaacacgccgaattatacctgccattcctacaagagaaggatgacactggcctcagcgtttccgaaaagatcctgaaactttttatgttccagattccctattacgtggggcctttgggacaggagtataaggataaaaagggttacaacgtctgggcggagaggaaagaaccaggcaagatatacccgtggaattttgaggagaaaatcgacgtgaagaagtctgccgagaaattcattgggcggatggtacgcagatgtacctatctgagcggagaacaggcactccccaagcaatcactgctttacgagaaatttcaggttctgaacgagttgaataacctcaggatccgtggcgaaaagatacctgtgagtctgaaacaggagatttatcacgatttattcggtgacgggaagaaggtctccatgacacggctgactaattacctactccagaacggcgtgatcagctctgaagagaaagattcatgcatcagtggaattgacggcgggttccataatagcctgtcctctgtcggaaagtttaaaggtgtgttcggcgataccgttcacacagacgagcatcgaaagatgatcgaagatattatattttgggggaccgtgttcggagacggcaaaaagttgcttaaggagaaagtagaagaggtctatggtaaccaactgacggaagctcagaagaaaagaatctttgggttcaagttttcgggctggggaaggctcagcaaagccttcctgactatggagggcgcttccaaggataatggggagattaagggattaatccaggccatgtgggacacaaactgtaatctgatggaacttttgtcagagcgctttacctacaaagacaagctcaacgaaatggtgactacagcagagaaaccactgtgcgaatggaagatcgaggatctagacgagatgtatctgagtgcccccgttaaacggatggtgtggcagaccattagagtcgtggatgaagtacaacagataatgggttgtcctccaaagaggatcttcgtggagatgacgcgctctgacggcgaaaaagggaagcgaaccgttagccggcagaagaaactcgtcgatctgtacaaggctcttggaaaagagggcaagatttggtccgaagagttgaataacacacccgagggtcagtttcgtatcaaaaagctgtacttatattacctccaaatggggaagtgcatgtatactggcgaatcaattgagctggaaccgcttatgaatgacaaccacctgtacgatatcgaccatatatatcctagacacttcatcaaagatgacaacattagcaataacttggtgctcgtgaagaaagagaggaatgcgcacaagtctgattcctttcccatcgagccagaaattcgcaacaaaatgatgcctttctggaagagtctgcggaagaaaggattcctaaccgaggaaaagtacaatagactgacaaggatgagcgcatttactgacgaggaaaaagccgctttcatctctcgacagctcgtcgagacctcccagggcacaaaggccataacccaaatttttaaacaggcattcgccgattcagagatcgtttttagtaaggctagcgtggtgtcggccttccgccagaagtttgactgttataaagtacggtgcgtcaacgactaccatcacgcacatgatgcgtacctgaatattgtggctgggaacacttatagagttaagttcacgtccaatccccttaactttatcaaagaagccaagaaaaatccaaactctagggagaatcgttacaacatggacaagacattcgaatgggatgtgacccgcaatggagagactgcatgggtcgcccagagcaacgaaaaccccggcaccatacaattggtgaagaaatatctgaataagaactcacctttaatcacaaaaatggtttacgagaagcacggtgggattacccagaaagctactatctggagtgccaagaaagcagagtccggaaatacagacgcttatattccagtgaagatgaacgatccgcggctcgccgacgtaacgaagtacggcggtgtcaccactatcgcggtggccggctatacactgcttgaatacaaagctgggggaaagaccgtgagatctctggaggcactacccatatacctcggcgggagcaaaaatctgacagaggagcagatggtcgaatatttttccaacattttgcagcaagagaataaggagaaagttgtgtcagatgtaatcatcaggaagaagatgattcctagcggaagtctgatcaaatacaacggcttctattactatttagccggtaagactgggaatcgaattgtgctcatatctgctgtccagctgtgtcttccaatggacaccatgctgtacatcaaaaagattgaaaaagcctgctccacgggaaacttcgaggaaaaggataagaatggcaaacaggtgttgagcaagcagcaaaacgagtttgtttatgagctcatcattgaaaaataccagcagtcgatcttcaagaaaaaggtgggtgcaataggcgacaccatcattgagaagcgggaaaaatttgcggagatctcactggaggaacaatgtaaggtcctaatgcagattttcctgaattttcagtctgggatcggagtggatcttacaagtgttgacggctccaacaaaagcggggtgacttacctcaataagaaaataatgaacgcccaggagctgaagttgattgaccaatctgtcaccggagtattcagccgcgaaatcgatctgttaacaatctga

SEQ ID NO: 3178 - RNA, 4128 nt, synthetic construct
  misc_feature 1..4128: note = Cas9 variant
  source 1..4128: mol_type = other RNA
atgagcaacaagtcctactctatcggcctggacattgggaccaattcagtgggatgggccgtcataacagatgactataaagttcccagtaagaaaatgaaggtgctcggtaacactgataaacacttcatcaagaagaatcttattggcgctctgttgtttgacgaggggacgaccgcagaagatagaaggttaaaacggacagcccgccgacgttacactagaaggaagaaccggctgcgctatctacaggagatcttcagcgaagagatgtccaaagtagactcttcgtttttccatagactcgatgactcatttctggtgcctgaagataagaggggaagcaaatacccaattttcgcgacccttgctgaggagaaggaatatcacaagaaatttccgacaatctaccatctgcggaagcacttggccgacagtaaagagaagaccgatctccgcctgatatatctggcactcgcccatatgatcaaataccgaggccacttcttatacgaagagtcctttgacattaagaataacgatatccaaaagattttctctgagtttatcagcatatatgacaatactttcgaagagtcctcactgattggtcagaacgctcaggtcgaagcaatctttacagacaagattagtaagagcgccaaaagagagagggtgcttaagttgttccccgatcagaaatctaccgggctgttctccgaatttctaaagctcatcctgggaaatcaagctgacttcaaaaagcactttgatcttgaggagaaggcccctctgcagttctcaaaagacacgtacgatgaagacttggagaacctcctgggccagatccgggatgactttgcggatttattcctggttgcaaagaaactctatgacgccattcttctgagcggcatattgactgtgaaggatctaagtaccaaagctccactgtctgcctccatgatcgaacattacgagaatcaccagaaggacctcgcagctctgaagcaatttattcagaacaatcttcaggaaaaatatgacgaggtcttcagcgatcagtcgaaggacgggtacgccggatatatcaacggtaaaacaactcaagaggcgttttacaagtacataaagaatctgttgtctaagttcgaaggcgccgattattttctcgacaagattgagcgtgaagatttcctgcgcaaacagagaacctttgacaacgggtccatcccccatcagatccacttacaagagatgaacgcaattctgcacaggcagggagaacattaccctttcctaaaggagaataaagagaagatcgagaaaattctcatattccggatcccatattacgtgggccccctggctcgaggtaaccgcgattttgcctggcttacaagaaattcagacgaagctattaggccttggaacttcgaagagatcgtagataaggccagtagcgcagaggactttatcaataaaatgaccaactatgatttgtacctgccagaagagaaggttctcccgaagcactccctgctttatgaaacgttcgccgtgtacaatgagctgactaaagtcaagtttattgctgaagggttgacacggtaccagttcctcgacaaaaagcagaaaaaggatatattttataccttctttaaggcggaggacaaacgcaaggtgactgagaaagacatcattcattacctgcacacagtggatggatatgacggcatcgaattagagggcattgaaaagcaattcaacgcatctctgagcacctaccatgatctactcaaaatcataaaggacaaggagtttatggatgacgataaaaatgaagccatcctggagaacattgtccacacgcttaccatcttcgaggacagagaaatgattaagcagaggttggctcagtataattcactgtttgatgagaaagttatcaaggccctcacacgtcggcactacactgggtggggaaaactgagtgcaaagttaataaacggtattcgagacaagaaatccggcaagaccatcctggattatcttattgacgatggggaaatcaatagaaacttcatgcagttgatacatgacgacggactcagcttcaaagagatcattcaaaaggcccaggtgtttggcaaaacaaatgatgtaaaacaggtggtccacgaactgcccggttctcctgctatcaaaaaggggattctacagtcaatcaagatagtggacgagctggttaaagtgatgggccatgccccagagagtattgtcatcgaaatggcaagggagaaccaaactaccgcgcgcggaaagaaaaacagccagcagcggtacaagagaatcgaagattccctcaaaaatctggcttctggccttgactcgaacattttgaaggagaatcccacagataacgtgcagctgcaaaatgacaggttattcctctactatctgcagaacgggcgcgatatgtacaccggaaagcctcttgagatcaatcagctgagcaactatgacattgatcacataatcccacaagcctttattaaagacgattccttggacaatcgagtactcacttcaagtaaggacaaccggggtaaatctgataatgttcccagcctggaagtggtcgagaagatgaaagcattctggcagcagctactggactccaagctcatctcagaacgtaagtttaacaatctgacgaaagccgagagagaaaggggcgggcttaacgagttggataaggtgggattcattaaacgccagctggtcgagacacggcaaatcaccaagcacgtggctcagatattagacactagatttaataaagaagttaccgagaaggataagaaaaacaggaacgtgaagatcattacactcaaaagcaatctggtatctaacttccgaaaggaatttggcctttacaaagtccgcgagatcaatgactatcatcacgcccatgatgcatacctgaacgctgtggttgccaaggcgattctaaagaaatatccgaagctcgaacctgagttcgtgtacggtgagtaccagaaatatgacctgaagcggtacatctccagaagtaaagatcccaaggacatagaaaaagccaccgagaagtactttttctatagcaatttgctgaacttctttaaggaagaggtccagtatgctgatgggactattgcaaaaagggaaaatatcgagtactctaaggacacaggcgagatcgcctggaacaaagaaaaggatttcgctacggtgaaaaaggtattatccctcccacaagtgaatattgttaagaaacgtgaggtccagaccggaggcttttcaaaggaaagtatactgcctaaagggaacagcgacaaacttatcccccgcaaaactaaggacattctgtgggagacaaccaagtatggaggtttcgattcgccagtgatcgcctactccattttgctcatcgcagacatagagaaaggcaagtctaaagaactgaagacagtgaaaactctagtcgggatcaccattatggagaaggcgacgtttgaagagaatcccatcaccttcctggaaaacaagggataccacaatgttcggaaagagaacattctttgcctccctaagtatagcctgtttgagttggaaaatggcagaaggcgactgttagcctcagctaaagagctccagaagggtaacgaaatcgtgctgccagtgtaccttacaactctgttgtatcatagtaaaaacctccacaagctggatgagccggggcacctagaatacatacagaaacatcggaatgagttcaaggacctgcttaacctcgtatccgagttttctcaaaagtatattctggccgatgcaaatttggagaaaatccagaacttatacgctgacaatgaacaggccgatatcgaaattctggcaaacagcttcatcaatctcctgacctttacaactcttggcgcccccgctgcgttcaagtttttcggaaaagacatagatcgcaagagatataccacggtctccgagattctgaacgccacattgatccaccaatcaattaccggcctatacgaaactaggatcgacctgagcaaactcggggaggattga

SEQ ID NO: 3179 - RNA, 4128 nt, synthetic construct
  misc_feature 1..4128: note = Cas9 variant
  source 1..4128: mol_type = other RNA
atggaaaagagctactccatcggcctggacattgggaccaactctgtgggatgggccgtcataacagatgactataaagttcccgctaagaaaatgaaggtgctcggtaatactgataaaaagtacatcaagaaaaaccttctgggcgcattgttattcgactcaggggaaacggccgaggtaaccagactgaagaggacagcgcggcgccgatatactcgtaggaaaaatagactacggtacctccaggaaatttttgctaaggagatgaccaaagtggatgaaagtttctttcaacgcctggaggagagcttccttacagacgatgacaagacctttgattcccaccctatcttcggaaacaaggccgaagaggacgcatatcatcagaaatttccaactatttaccacctgagaaagtatttggccgattctcaggaaaaagctgacctcaggctggtctacctggcactcgcccatatgatcaagtaccggggccacttcttaatagagggtgagctgaatgctgaaaacacagatgtgcagaaactttttaatgttttcgtggagacctatgacaagatcgtcgacgaatcgcatttgtcagagattgaagtggatgccagcagtatcctgacggagaaagtatccaagtctcgccgactagagaacctcattaagcaatacccgactgagaaaaagaataccctgtttgggaaccttatcgcgctggcattgggactccagcccaatttcaaaacaaactttaagctgagcgaggacgccaaattacagttctccaaggatacttatgaagaggacctggaggagctccttggcaaggttggcgatgactacgctgatctgttcatatcagccaaaaatttgtatgacgcaattctactgagtgggatcctcaccgtggatgacaacagcacaaaggctcctctgtctgcctccatgattaaaagatacgtcgagcaccacgaagatcttgagaagctgaaagaatttatcaagatcaataagttgaaactctatcatgacattttcaaggacaaaaccaagaacggatacgcgggttacatagataacggcgtgaaacaggacgagttttataagtacctgaagacgatcttaactaaaattgatgactcagattatttcctggacaagatcgaaagggatgactttctacggaaacaacgtacattcgataatgggagcataccacaccagattcatctccaggagatgcacagtatcctgcgcagacagggagactactatccctttcttaaggagaaccaagccaaaatcgaaaagattttgaccttcaggatcccttactatgtgggcccactggcacggaaagattctcgatttgcttgggccaattaccactccgacgagcccattactccttggaacttcgatgaagtcgttgacaaggaaaagagcgctgagaaatttataacacgcatgaccctcaatgacctgtaccttccagaagagaaggtgctgccgaaacattcgcacgtatatgaaacgttcaccgtgtacaacgagttgacaaagatcaaatatgtcaatgaacagggtgagtcctttttcttcgatgccaacatgaagcaggagatttttgaccatgtgttcaaggaaaatagaaaagttactaaggcaaaactcctgtcttacttaaacaatgagtttgaagagttcaggatcaacgatctgatcgggctagacaaggattcaaaaagttttaatgccagcctcggaacctatcacgacctgaagaagattcttgataaatccttcttggacgataagacaaacggccaaataatcgaagacattgtgctgactctcaccctgtttgaggatcgggacatgatccatgagcgcttacagaaatactctgatttctttacaagccagcagctgaagaaacttgaaagaaggcactataccggctgggggcgtttgtcatacaagctcattaatggaatccggaacaaggagaacaataaaactatactggacttcctaatcgacgatggtcacgctaaccgaaattttatgcaactgattaacgacgaaagtctctccttcaagacgatcattcaggaggcgcaggtcgtgggcgatgtagacgatatcgaagcagttgtgcatgacctgcccgggagccctgccattaaaaaggggatacttcagtctgtcaaaatcgtggatgagttggtcaaggtgatgggcgacaatccagataacattgttatcgagatggctagagaaaatcaaacaaccggttacgggaggaacaaatcaaatcagcgcctgaagcggttacaggacagtctcaaggagtttggcagcgatatactgtccaaaaagaaaccctcttatgtggactcgaaggtagaaaacagccaccttcagaatgacagactgttcttgtactatatccaaaacggaaaagatatgtacactggcgaggagctcgacattgataggctgtccgactatgatatcgaccatattatccctcaggccttcataaaggataattcaattgacaacaaggtcctaaccagttctgccaaaaatcgcggaaagagcgatgacgtgccatccatcgaaatcgttcgaaaccggcgttcatactggtataaactgtacaagagcggactcatttctaaaagaaagtttgataacctgacaaaggcagagaggggtggccttaccgaagctgacaaagccgggttcatcaagcgccagttggtggagactcggcagattacaaaacacgtcgcacaaatactggatgcgagatttaatacgaagagggacgaaaacgacaaagtgatccgagatgtaaaggtgattaccttaaagtccaatctcgttagtcagttccgcaaagagtttaagttctacaaagtccgggagatcaacgactatcaccatgctcacgatgcctacctgaatgcagtggtgggaactgcccttctgaagaaatatcccaagctaacaccggaatttgtctacggcgagtataagaaatacgacgttagaaagctcattgctaaaagctctgatgactattccgaaatgggtaaggccaccgcaaaatacttcttttactcaaacctgatgaatttctttaagacagaggtgaaatatgctgatgggagggtgttcgaacgtcctgacatcgagactaacgccgatggcgaggtagtctggaataagcagaaggacttcgatatagtgcgcaaagttttgagttacccccaagtgaacatcgtcaagaaagtggaagcgcagaccggaggctttagcaaggagtcgattctgtccaaaggggactctgataagttaatcccacggaagacgaaaaaggtttattggaataccaaaaagtacggaggtttcgacagccctacagtggcctattcagtactcgtcgtggctgacattgaaaaaggcaaggcaaagaaactgaagactgtgaaagagcttgtcgggatcagtataatggaaagatcctttttcgaggagaaccccgtttcttttctggaaaagaaaggataccataatgtgcaggaggataagttgattaagctcccaaaatatagcctgttcgaatttgagggcggtaggcgacggctactggcctccgctaccgagcttcagaaggggaacgaagtaatgctccccgcccacctggtggagttgctgtaccatgcacaccgcatcgactcattcaatagcacagaacacttaaaatacgtcagtgagcataagaaagaatttgagaaggtgctctcttgcgttgagaacttctccaacctgtatgtggatgtcgagaaaaatcttagcaaggtgagagcggccgctgaatcgatgactaacttttcactggaagagatctctgccagtttcattaatttgctcaccctgacggcactaggcgctcctgccgactttaacttcctgggagaaaagataccaaggaaacggtacacatccaccaaggagtgtcttagcgcaactctcatccaccaatctgttacaggcctgtatgagacccgaattgatttgagcaaattaggggaagagtga

SEQ ID NO: 3180 - RNA, 4128 nt, synthetic construct
  misc_feature 1..4128: note = Cas9 variant
  source 1..4128: mol_type = other RNA
atgaccaagatcaaagacgattacattgtgggcctggacatagggacagatagctgcggatgggtcgccatgaactccaataacgacatcctcaaacttcagggtaaaactgctattggctctagactgttcgaagggggaaagtcagcagccgaaaggcggttgtttcgcacgacccaccgacgtatcaaaagaaggcggtggcgcttaaagctgctagaggagttctttgatccctatatggcggaggttgacccttacttctttgctagactcaaggaaagtggcctgagcccacttgataaaaggaagacagtgtcctctattgtattcccgacttcggccgaggacaaaaagttttatgatgactaccccaccatctatcatctgcggtacaaattgatgacagaggatgaaaagttcgacctccgcgaggtgtatctggcaatacaccatatcattaagtaccgaggtaattttctgtacaacacctcagtcaaagatttcaaggccagcaaaatcgacgtgaagagttccattgaaaaactcaatgagttatatgagaacctggggcttgacttgaatgttgaatttaacatctctaatactgctgagatagaaaaggtgctgaaagataagcaaattttcaagagagacaaagtcaagaaaatcgcagagctatttgccattaagacagataacaaagaacagagcaagaggatcaaggacatctccaaacaggtggctaatgccgtactcggatacaagacccggttcgatacgattgcgctgaaagagatatcaaaggacgagcttagtgattggaacttcaaactgagcgacatcgatgcagactctaagtttgaagccttgatgggcaatctcgatgagaacgaacaggctattctgttaactatcaaggagctgttcaatgaagttaccctcaacggcatagtggaggacgggaacacactttccgagtcaatgattaataaatataacgaccaccgtgatgacctgaagttgctaaaagaagtcatcgagaatcatatcgatcgcaagaaagccaaggaactggcactcgcttacgacctgtatgtgaacaatagacacggacaacttctgcaggccaagaaaaagttgggtaaaattaagcctaggagcaaagaggatttttacaaggtggtcaacaaaaatctcgacgatagtcgggcgtctaaggaaatcaagaaaaagattgagctggactccttcatgccaaaacagcgaactaacgccaatggcgttataccctatcagttacaacagctggagctagataagatcattgaaaaccagagcaaatactacccttttctcaaggagatcaatccagtgtcgtctcacctgaaggaagcaccctataaacttgacgagttgatccgcttcagagtaccttactatgtggggccactgatttccccgaacgagtcaaccaaggatatacagactaaaaagaatcaaaactttgcttggatgatcaggaaagaagagggacggattaccccctggaatttcgaccagaaggtcgatcgcatcgaaagtgccaacaagtttattaaaagaatgacgactaaggacacatacctcttcggcgaggacgtgctgcctgctaacagccttctgtatcagaaatttaccgttttgaatgaactcaacaatatcaggataaacggtaagcgtatctccgtggatctgaaacaagagatttacgagaatttattcaagaagcatactacagtcaccgtgaaaaagctggaaaactatctaaaagagaatcacaacctcgtaaaggttgaaatcaaagggctggccgacgagaagaaatttaattctggacttacgacctacaaccggttcaagaatttgaacattttcgataatcagatcgacgatctgaagtaccgaaacgactttgaaaagataattgagtggagcacaatcttcgaggataagtcaatttataaagaaaagctcagaagtatcgactggctgaatgagaaacagataaacgcattatccaacatcaggctgcagggctggggccgccttagcaagaagttgctcgcccaactgcatgatcacaatgggcagactattatcgaacagctatgggactctcagaacaattttatgcaaattgtgacccaggctgatttcaaagacgcgatcgcaaaggccaaccagaatctgctcgtcgctacatcagtggaggatatactgaacaatgcctacacaagtccagcaaacaaaaaggccattcggcaggtcatcaaagtggttgacgacatcgtgaaggctgccagcggaaaggtacccaaacaaattgcaatcgaatttaccagagatgcggacgagaatcctaagaggtcccagacacgcggttctaaacttcagaaggtctataaagatttgtcgaccgagctggctagcaagactattgccgaagagttaaacgaagcaataaaggacaaaaagctcgtgcaggataaatactatctgtacttcatgcaacttggccgagacgcctatacgggggagccaatcaatattgatgagatccagaagtacgacattgatcacatcctgccccagtcctttataaaagacgatgctttggacaaccgggttctcgtgtcacgtgccgtcaataacggaaagagtgacaatgtgccggtaaagctgttcggcaacgaaatggcagctaacctaggtatgacaatcagaaaaatgtgggaggaatggaagaatattgggctgatctctaaaaccaagtacaacaatctcctgactgatcctgaccatattaacaaatataagagcgccggctttatcaggcgccaacttgtggagacctcccagataattaaattggtttcaacaatcctgcagagccggtaccccaataccgaaatcattactgtcaaggcgaagtataaccactacttaagagagaaattcgatctctataagtctagggaggtgaatgactaccatcacgccatagatgcttatctgtccgcaatctgtggaaaccttctgtaccagaattacccaaacctacgaccctttttcgtgtatggccaatacaaaaagtttagtagcgaccctgataaagaaaaggccattttcaataagacacgcaaattctcttttatctcccagctcctgaagaacaaatcagagaatagtaaggaaattgctaaaaagttgaagcgggcctatcagttcaaatacatgctggtcagcagagagacggaaaccagggaccaggagatgtttaagatgactgtttatccacgtttctcgcatgatacagtgaaagcaccccgcaacttaatccctaagaaaatggggatgtccccagacatatacggaggttataccaataactctgatgcgtacatggtgatcgtacggattgacaagaagaaaggcacagagtacaagatcctcgggattccgactagagaactggtcaatcttaaaaaggccgagaaagaagatcactataagagctacctgaaagagatcttgacccccaggatactctataacaagaacggaaagcgagacaaaaagattacgtcatttgaaatcgtgaaaagtaagatcccttacaaacaagttattcaggacggcgataagaagttcatgctgggttcctctacctatgtgtacaatgctaaacagctaacactgagcactgagtccatgaaggccatcaccaacaattttgacaaagattcagacgagaacgatgcacttataaaggcttatgacgaaattctcgataaagtcgacaagtacctgccattgttcgatatcaataagtttcgggagaaactgcacagcgggcgcgaaaagttcattaaattaagtctcgaggacaagaaagatacaatcctgaaggtgcttgagggcctgcatgacaacgccgttatgactaagatacccaccattggattgtctacgcctctcggctttatgcagttcccaaatggggtgatcctgtccgaaaacgcaaaactaatctaccaaagccccacaggactgttcaagaaatcggtaaagatttcagatctttga

SEQ ID NO: 3181 - RNA, 4131 nt, synthetic construct
  misc_feature 1..4131: note = Cas9 variant
  source 1..4131: mol_type = other RNA
atgagcaacttcgacaatcacaaggattccatctgcaaacataagggcctgaaaaaggggaactactatattggactcgacataggtaccaattctgtgggctgggccgctacaaacgagcagtacgaacttctgaaatttaagtcacacaagatgtgggggagtagattgttcgcagaggcccaaactgcggtcgatacgaggatgaaacggagcgctcgccgacgtttacagagaaggaagtttcggctgatcctactcgaatccctgttctctaaagagattaatgccgttgacgaaacctttttcatgcgccttcatgagtcgaactatcacgtggaggataagacaaatctggtaaaatacactttgtttatcgacaagaactataccgatgtggactactataaggagttccccacaatttaccatctcagacaccacctgatgaccgaaggaactaaagatatcaggctgctctttttagcaatacatcacatcctgaagtaccggggcaatttcctttatggtaaaaaggaattttcagtcgacggggagatgtacagcgtgttgcgcagtacactggaggaactaggattcggctcctatgttgaggatgaaaacgtgctccagtctattgccaatctggtccttgaccgaggcatcgctagaagcgagaaagtgaagcagattgaacctctgatcgcacaagggaaaaagttgtcctcagtagagaagaacaggctcaaagcctgggcttacctgataatgggattaaaggccaatctggttaacctctttaccgatgaggacgtggaagtcgtgcttccagaggaaaaagagttcaagagtattaatctgcatgaaggtatctatgaggacgtgcgggatgcgtacgaggacgcatggggcgatcgtttcgccattgtcgaccagtgtaaagttttgcacgatatcatcgtgattagctctataatcaagccggggcagtccctatcagaagctaagattgagagctataaccagcacaaagaagacctggtactcctgaagagtgtgcttaaagaggataagaaactgtacgacgatatgtttgtcgtggacatcgataagggaacgaactacgttaagtatataaaacaaggcgtgaatggtaacacttctaccacacaggaagccttctacaagtatgtccgcaaagtggtatccgttttgcccgagactgagaataccagatgcattgtgcagaagctcgaagaggggacatttctgcctttacagaggatcagcaaaaacggagtcgtgccataccaactgcataaggaggagctagtccggatcctcgaaaaggcaaaactgaatttcccctttcttaacgaagtggaggacggcttgaccgttgctgacaagattatctcgattctggagttcaaaataccttattacgtgggcccactcaatcccacgcactctatcgaaaacgggggatttgcctgggtagtccgaaaggaagcgggtcaggtgctgccttggaatttcgagcagaaagttgatgtgcaagcctccgcagtcaagtttattgagaaccttactaataaatgtacatatctgatcgaccaggatgtgttgccaaagtactcactcctgtacgctgagttcagtttactgaacgaactaaataacatccgcgtaaatgacaagccgctccccgccgatgtgaaacaggcttttattagagaccatttcataagcctgcaggattccaagaccgccactaaaaaggttgtcgcaaaatatcttgtggacaacaactacgtgtctcaacctccaatcattacaggcatggatcagcagatcgccaccaagttgacgagccacagggacatgacccggattctgggggaacattttgattatgctatggcggaggacatcatacgctacatcacaattttcggagaatcaaaggatatgctcagacaggtcctgaaaaattattacggcgacaggttaactaccgagcaaatcaagaaactgggtaaacttacatatactgggtggggccgtttgagtaagaagttcctctccgacatttggggaatgaagaaaaacgatgacgatgcagaggccggcaccatcatagaacacatgcgggaggggcaggaaaatctgatgcagctactgtctagctcatacagttttattgacgttgtgcaggagtacgtgacaaacgtactcggagctaaggagaaaaccgccttcgaaatgctggaggatcttagcttgtcccccatggtcaagcgatctgtgtggcaaactctgagaatcttagacgaaattgtttcgatcaggaaagagctccctaagaagatatttgtggaagtcgcacgcacgaataaagccgataagaaacggacacagagcagaaaggctctgcttgaggagctgtatgaacagatcaaagacgaggatgtgcacgttttgcagcaagaactcgagtccaaggaagactcagccctgaacagtaaaaagctatacctgtatttcacccagatgggtaggtgcatgtactctggccgccgaattgatatccatgagctctttactgacacctatgatattgaccacatctacccacggagcctgacaaaggacgattcctggcataatatagtgcttgtagagaaacagttgaacgcagaaaagaccgaccgtttccccattctgtcagcgatccaaagcaaacagaaggggttttggaaattactctgggatagaggattcatctctgagaagaagtatgacaggctggtccgcactacagatcttacggacgaggaactgaatcagtttattaaccggcagatcgtgtccaccaatcaaagtgtgaaagctgtcactacactactccaccagctgtacccggaaaccgaggttgtgttcagcaaggccgagaacatttctgattttagaagggactacggcttcgtaaaagtgcgatccataaatcaccatcaccatgcaaaggatgcctatttgaacatcgtcgtgggtaatgtttaccacgaaaaatttacaaagaacttcctgtcattcgctaagcagaaagggactcatcgcacctataacttaacgaagatgtttgagtacgaaattaaactcaccgaggaaagtaagaaagtgatctgggaccctaatattcacatggatatcgtcaagaagatgatgaaaagcaacgacgtgcgggttacacagagagccgtgccccaaaagggcggactgtcggacgagactatatataaaaagggcatcgcaaaacgtggggtctaccttccactgaagtcctctgatgagagggtacgcgacgtggaaaagtatggaggtcggaccagcattacaatctcagagtacattatcttgaatataagagataccagtgaccaggataggattgaaatcttctccctccctctgtacatcgctggcaaaaaggacattcacaaagccatagaggaggcgtatctatctacttgtaagaaacccgccagcgttgtggatatccagattctgtaccgagggctttatatcggatccaaggtcaacattaatggctttacgtactatatgggtgggaaaacaggctcaaacgtgagcgtagacagtgctgtggatgtcgttatggacatcacctcttccgtgtacataaagctcctggaaaaggtggcaatcaaaaagattgagaatagcaaaactttccggatcgaaaacattaagacatcgtataatcataaagaggtcaccgtgtcaaaggaacagaacatcgccttgtaccaagagctgttaaagaaactcgatactccactgttttctaagatgaaaggaaataaacttgaggagttccgcaccgttggctttgacacattcatagctctgagtttggaagatcaggcctccgtactcctggaagtgctaaacgtcctgacgaattttaagaccaagagagacattactaagatcgggatgacaagctctaggagcacccttggaatcaacatttccaatacagagcagttctcagtgatcactaccagtataacgggcctctacgaacaagagattaaaatcaagtga

SEQ ID NO: 3182 - RNA, 4131 nt, synthetic construct
  misc_feature 1..4131: note = Cas9 variant
  source 1..4131: mol_type = other RNA
atgaccacaaagaacagagagaaaaataacaagttccacaaagccagccccctgtacactctcggccttgacatcgggacgacctccgtgggatttacagctattgatgaagcacagaggcctatgcgggccaagggtaaaactgtcataggcgttcgcctgttccaagaggggcagtctgcggtgggacgaaagaattttcgtaccacaagaaggcggttgaagcgcagaaggcggcgcttaaacctgctaaaacagttcttttcagctccactccgaaagatcgacccgaccttctttaaaagactgaaggccagtagcctttcccccgcagataaaaggcggtatctggcccctggcttgttcccaaatggtggggacattaagttttaccagaagtatcccactatctaccatctccgtctggctctgatgacagaaaaacgccctttcgatctcagagaggtatatttagcaattcaccatatcgtgaagtacaggggaaactttctgaatccacttcccgtctctgccttccggggccgaaaccaacgctttgaagaccagttctcggagttgaatcagctgtataaatcactagagggcgaaagccctttccagtttgatgagaagatattcagtgaactcgacaaacaactgcttgtgaacgatgggagaaagatcgacaggcagaaacagctggctaagcgggtttttattaagaccaatgagaaacgcatcgattcccaccatcagaagattgcctctgcgttcagcaaagcagtgtttggatacaagttcagaccagacgtcttgctcaactccgatccgaatgagtcaatcgacgaatttataaaattcggtgacgaggattttgacgataagctggtgattttaagggaaagtctgaacgccacgcaaaaggagatcctcgctgtaactcagcgtatttacagccagatcatccttaatgaaattgttccctctcgggagaccctgtccgaggccatggtgtcacgatatcaaaaacaccacagcgacttgcagctactgacagaagcatgcaagaaaatgactaaggctaaagccgcgagaatacaggccgcatacaccgattatatcggcaagggggacggacataagctcgtccacgatcagttcgtggctctgattaaaaagaaccttgaccctagtgaggaaggcagggatctggccgagcgcttggctcaagacgattttatgccactccagcggacacccctgaacagagtgatccctcatcagttacagcaagaagaactggacaggataattgagaatcagggtgaatactatccattcctaaaaaccctcaaccccaatcgctctcgagccggggtcgcaaactaccagctggacgagcttgtttcctttcggatcccgtattacgtgggacctttgatcacggccactgatcagctgcacacaagcggcgctaagttcgcgtggatgacccgtagagcagccggcgaaattactccctggaatttcgaccaaaaagtagataggctcgcttcggccaaccagtttatccgccagaatatgccaaaggacaaccatctgcttgaggcagatgtgctgcctgccaattctttgacataccagcggtatctcgtcctggacgaattaaacgctgtgaaggttaatcacaaatccctgaccgtgtcacaaaagcagagaattttcaacgatctatttaaaaggcagcgaacggtcaccgtgctcaatctgcaaaactaccttaagagtatagagaaattgcccacactgccagtaatcactggggttagcgactccgagcgcttcaagaccacactctctacttatctggattttaaaaatattttcggaggtaaggtggacgatagctcacagaaggaaaaatttgagaagatcatcttatacgccaccattttcgaagaccacgcagtctataaagcgaagctggatcagatagactggcttggccagcaacagaaaacagacttgctcagtaagaactaccaggggtggggacagctgtccgagaagctactgctcggcctgaaaaaccaagctggtcagagcatccttgatgagttgtggcagaccaataagcggtttagagaaattatgaacgaggcccatttcgcaaaacagatcatggcctctaatgctgccctgttaaggaagaaagggctcgacgatgtgctgtcaactgcatttcttagtccccaaaacaagaaggctattcgtcagacggtcgaagtggttgacgatatcgtgaaagccataggctgtcctccacagaagatcagcctgcacttctccaaagcgccggccgacgctattcgccatgagcgggataatgcaaacatcattttgagaacatataggaatctccccgccaagatggtagacgatcaactgaaagctgaactacaggccaccgcagagaagcaccaggtcctgtctgacaagctctacctgtactttactcagcttggacgagatttgtataccggcgagatgctgaaaatgtcggaattagagaacgacatgatcgatcacataatgcctcaaacattcgcgtacgacgacagcgtgaataaccgggttctcgtgtcccagaatcattcaagtcagctggggaagacctctggagaaaaatctgatgccaagatgattcgcttctggcaggtccttagagacaacaaactgatctccgagcaaaagtatcagaatctaactctcgattcagaccacctgagcaaatctacaagggaacagttgctgaaccggtacttagtggagaagaatccaattacgcagtgggtagcttccgtgctcaccgagaagtatggtgataacggcactcgagttctgacaatcaaccccagaatggtctaccaaatgcgcaggcagtttaatcttgtgaacctgcctgaagtgaatgactatgatcatgggttggacgcctacctcgcagctttcataggaaactacgtcgatcgtcggtatccaagactgaggagttactttgtttatggcgacttcagcagctccaaagagatcgtgtttcgcctaaatcgattcaactttctgttcgatcttggtcaggccgaacccaatgagctcaccgactgggaaacaggggagatgatttgggacaaggcagccgctaactcagtgctgagagatgtataccagtataaatttatgttgatcagtcaagcggtctacagccggcagggcgccatgttcaatcagactatttatccggcatcgcaagctgccggaaggcagctgatccctgtgaagaaaaaccgcgccaccaagttatacggcgggtactccggaaatgttgacgcttatctcgcaatagtgcgtctgggtggcccaaagtctgatcagtacagagtcgtggggattcccacgcggatggttggaaggcttcagagcgccatgaaacaaggcgcggacacctatgctaacacactgcacaagatcttgcagcctcagtttactaaacgcaagaaaaatcgacagaccggttactatgaggaaacaactgagcccttcgccgtgatcctcgataaggtatactatagacaactgattatcgacgggcagcagaagttcatgctaggctcaagtacctaccagtttaacgcaaaacaactggtcctttcctctcgggccaggcagattctcagcggagaggagcgcctgacggatgagaatggctcccaggacttgatagatgtgtacgacgaaatcttaacaaagattgatagatatttcgagctgtacgaccaaaggcactttcggcagtcactccatgatgggcgtaaacagttcatcagcctgccaattcacaacgtgtatcgcgctaaccgacttatcgaacatggaaagtacgagaccctgagtcagatattgaatggcctacacgcaaacactatgatgacaaatctgagatatctcggtatctcttccccttttgggaaattccaaagccccaacggaattaagctgtcgaaggacgccgtccttgtttaccagtcaccatctggcttatttgaaaggcgggtgcgcctgagagacctctga

SEQ ID NO: 3183 - RNA, 4131 nt, synthetic construct
  misc_feature 1..4131: note = Cas9 variant
  source 1..4131: mol_type = other RNA
atgaacaataagccctacagcatcggcctggacattgggaccaactccgtgggatgggccgtcataacagatgactataaagttccttctaagaaaatgaaggtgctcggtaatactgataaacacttcatcaagaagaaccttctgggcgctttgttatttgacgaggggacgaccgcagaagatagaaggctgaaacggacagcccgccgacgttacactagaaggaagaatcggctacgctatctccaggagattttcaccgaagagatgtcaaaagtagacatcagctttttccatagactggatgacagttttcttgtgccagaagataagaggggatccaaatacccgattttcgcgacactggaggaggaaaaggagtatcacaagaactttcccaccatctaccatttgcggaaacacctcgctgactctaaggaaaaagccgatttccgcctgatatatctggcactcgcccatatcattaagtaccgaggccactttttatacgaggagtcgttcgacatcaaaaataacgatattcaaaagatctttaatgagttcatatcaatttatgacaacacttttgaaggtagcagtctgaatgggcagaacgctcaggtcgaagcaatcttcacagacaaaatttccaagtctgccaagagagagagggtgcttaaattgttccctgatgaaaagagcaccggactgttttccgagttcctaaaactcatcgttggcaatcaggctgactttaagaaacacttcgatctggaggaaaaggccccacttcaattttcaaaggacacgtacgatgaggacctggaaaacttgctcgtgcagatcggcgatgacttcgcggatctgtttttagtcgctaaaaagctgtatgacgccattctccttagtgggatactgactgtgaccgatcccagcacaaaagctcctttgtctgcctccatgatcgaccggtacgagaatcatcagaaggacctagcagctctgaaacagttcattaagactaacctcccagaaaagtatgatgaggtattttcagaccaaagcaaagatggatacgccggttatatcgacggcaagaccacacaggaggcgttctacaaatacataaagaacctgcttagtaaactggaaggggccgattactttttggacaagattgagcgtgaagatttcctccgcaagcagagaacctttgacaatggatctatcccccaccagatccatctgcaagagatgaacgcaattatcaggcggcagggcgaacactatcctttcttacaggagaataaagagaagattgaaaagatactgacgttccgaatcccatattacgttggtccgctagctcgcgggaacagagattttgcctggctcactaggaactccgaccaagctattcggccctggaatttcgaggaaatcgtggataaggcccgcagcgcagaggactttatcaataaaatgacaaactatgatctgtaccttcctgaggaaaaggtcttgccaaaacactcgctgctctatgagaccttcgccgtgtacaatgaactgactaaggtgaagtttattgctgagggacttagagactaccagttcctggactctggccagaaacagcaaatagtcacacagttgtttaaggagaaaaggaaggttaccgaaaaagatatcattcagtatctccataacgtggactcctacgatggcatcgagctgaaggggattgaaaagcagttcaatgcgtcattaagtacgtatcacgacctgctaaaaatcataaaggataaagagtttatggacgatagcaagaacgaagcaatcctcgagaatattgtacataccctgacaatcttcgaagaccgtgagatgattaaacaacggcttgcccactacgcttccatctttgatgagaaggtgataaaggccttgactcgaagacattataccggatggggtaaactgtctgcaaagctcattaacggcatctacgacaaacagagcaagaaaacaattctggattatttaatcgacgatggggaaataaataggaacttcatgcagctgatcaacgacgacggactttcatttaaggagattatccagaaggcccaagtcgtgggcaaaactaatgatgttaaacaggtggtccaggaattgcccggtagtcctgctattaaaaaggggatcctccagtccataaaactggtggacgagctagtaaaggttatgggccacgccccagaaagcattgtgatcgagatggcacgcgagaaccaaaccacagcgcggggaaagaaaaattctcagcagagatacaagaggatcgaagatgctctgaaaaacctcgcccacggcctggactcaaatattcttaaggagcatcccaccgataacatccaattgcagaatgaccgcctgttcttatactatctccagaacgggaaagatatgtacactggaaagagtctggacattaatcagcttagctcctgcgatatagaccacatcattccgcaagcattcatcaaagatgactctctggacaaccgagtcttgacgtcgagcaaggataatcggggtaagtccgacaacgtgccttcactcgaaattgtccagaaacgtaaggccttttggcagcagctgctagatagtaaactgatctctgagagaaagttcaataacctcacaaaagctgagaggggcgggctggacgaacgcgataaggtgggatttataaagcggcaacttgttgagaccagacagatcactaaacatgtggcccagattttggacgcaaggttcaataccgaagtaacagagaaggataaaaaggaccgaagcgtcaaaatcattaccctgaagtccaacttagtgtcaaactttcgcaaggagttccggctctataaagttagagaaatcaatgattaccaccacgctcatgacccctatctgaacgccgtggtcgcgaaggccatacttaaaaagtacccaaaactggagcctgaatttgtgtatggcgattaccagaagtacgacctaaagaggtatattagccgtactaaagatcccaaggaggtagaaaaagctacagagaagtacttcttttattctaatctcctgaacttctttaaagaagaggtgcactacgcagacggtacgatcgttaagcgcgagaatatcgaatattccaaagacaccggggagattgcctggaacaaggaaaaggatttcgctactatcaaaaaggtcttgagtctgccacaagtgaatatagtgaaaaagacagaggaacagaccgtcggccagaacggaggcttattcgacaataacattgttagcaaaaagaaggtggtggatgcctctaaactcacacccatcaagtccgggctgtcacctgagaaatacggaggttatgcacggccaactattgcgtacagtgtacttgtcatcgccgacatagagaagggcaaagctaagaagctgaaaagaatcaaggaaatggtggggattaccgttcaagataaaaagaaatttgaggccaatccgatcgcatacttggaagagtgtggatataagaacattaatcccaacctcatcataaagctgcctaaatacagcctattcgagtttaataacggccagaggcgactgcttgcttcgtccattgaactccagaagggtaacgagctgatcgtgccatatcatttcacggccttgctgtaccacgcacagcggatcaataaaatttctgaacccatccataagcaatatgtcgagacccaccagagcgaatttaaagagttactcacagccataatttcactgagtaagaaatacatccagaagcctaacgtggagtcccttctgcagcaagcattcgaccagtctgataaggacatttatcagttgagcgaatcctttatctcactcctgaaactaattagcttcggggcgccaggcacttttaagttcctgggagttgagataagtcagtctaatgtgcgctaccaatccgtaagctcgtgctttaacgccacccttatccaccagtcaatcacaggcctctacgaaactagaattgatctgtctaaattgggggaggactga

SEQ ID NO: 3184 - RNA, 4131 nt, synthetic construct
  misc_feature 1..4131: note = Cas9 variant
  source 1..4131: mol_type = other RNA
atggacaagaaatacggcatcgggctggatattggaaccagctccataggttggacagtggtcgacaagtatggccacatcattagagttaaagggcagactggaatcggcgtgaggctctttcgggagggtcaaacggccgctgaacgccgaacctttcgtacaactagaaggcggctttctcgcagaaggtggcggctgcgcttgttacgagagattttcgatgaacccatctcagcaatagacgagaactttttcgccagacagaaggcgagtagcctggctcctggggatgccaggtaccagcaggcatttcaactattcaatgaccggaccgatcaggccttttattgcaaatacccaacaatctatcatctccgtcaggctctgatgaccgaatcccgccagttcgacattagagagatctaccttgcactgcaccaaattatcaagtataggggacattttcttctcggcggcgccgctaaggatttccagtctgacaaactggatctggaggcctactttactacaataaacgcgcagctcgcagggatttactcggacggatcagtacagttaccgaccctggattggaatcaagcctgtcaggaacttacggacactagccggacccagagtgaccgaaagaactggttggtgaaagagctgaagtcctatggtgattctcaactaaaacccatctacacacagattgctaatgccatcctcggcttcaagactgacctggcaaagatcatggggattaacgatcctgaaaaagctcttagctttaatctggacgccttggatgaccaccgcgatgacgtcgcggagctcctgaccgatgagcagataccattagtgaacctgctcgccaagttgcatacagcactggaattggctgccatcctacccgacggacagaccctgtccggcaaaatggttgagatttatgaaacgcacagaaagcaactcaaaacttacaaggctttcatcaggcagctgcctgatcggcagcagcgccttgccctgaaacaagcatatgaccactacatagaccagggtttgaatagagaggccttctattcagaagtgaaggctattctcgagaagcagaaaccactgacagcgaccgggcaggcaatgaagaaagccatggatcaaaacgctttcttactgaagcagaggactaaaacaaatatcgccatcccctaccaggtccagcaacaggagatggaccagattatcgcaaaccaaagtaagtactatccttggctagccaccccaaatccggtaaagagccgtcgggtgattgctccctacaaactcgatgaactggtttgcttccgagtgaactattacgtcggacctcttgtgcagtctaagccaggcgaggccacgaaagaagcaaagtttgcgtggatgaccagaaaagacccccagtccacagtggctataactccttggaatttcgatcagcaagtcgacaggcaggcctcagcaaacgcctttatccagcgcatgaagaccacagatacttatttgctgggcgaggacgttattccaaagaacagcctcctgtaccagaaatatgaagtgcttaatgagctgaacaatgtacgggtgaacggggattggttggacccccaaagaaagcagtacctcttcaaaaagctgtttatggatcagccgcagagtgtcgtgaccgttaaggctttacaaaagacactggtggtcatcggagcctgtcctaccctacccactgtggagggtctcgcaaatccaaagaggttcctgtctcagcttacgacataccatgacttttgcaaattgctgcctgatgacatccagcgcgctgaccgacaagccgatattgaaaagataatcaactggtccaccattttcgaggacactgcgatctttaaagaaaagctccgggatattaaatggctgagcgccgaccagatccgtagattatcgtctaggccccgctatcggggctgggggagattctccgctaagctgctttgtggattgcacgataggcagggcaataccgtaatggacgagctctggcagacatcacgaaactttatgcaaataatccgccagagtgatttccagaccgcaattgccgctgttaatcagcaagacctgggtcggcaggatctacagagagtgatcgacgatctgtacactagcccacagaacaaaaaggccattaggcaagtcctcgcagtggtcacagacatccagaaggcgatgcatgggaaagccccctcctggctgttcgtggaagttgctaagggcgcccagaaaaatcctcagcgtacgcaatctcgccagagcaaacttgcagaggcttatcgggagtcagccagagaattggtggatgaggcagtaaaagaacagctgttaaccctcccagacgacaggcaaacttttagtgatcgactggtcctttacttccagcagaacggacgggacatatatacaggcgagccgctggattttgagcgcttgtccaattaccacattgaccacatcattccccaggccgtggttaaggatgacagcctcgataacagagtgctgacctctaatcaagctaacctagaaaagggggcgcatgtccctacaatcttcagggacaaacaggagccagtgtggcaggaactgtatcgggtaggactcatatcacaccgaaagctgagaaaccttttgactacccccgatgacctggatgaccgcggtagggccacgggctttatcgcacgtcagttagtggagacccggcaagttattaaactcgtcatggaagtgctgagtcagtactacgacacaactgagaccgagcttatcagcattaaggctgggctgtcccatcagttcagacaggaactaaatctccctaaactgagggccttgaacgattatcaccatgcccaagacgcttacctggcagcccgcatcggaacatatttactccagcgatacccaaatctgaagagatttttcgtgtatggcgattttaagaaaactcacttcgaccttcagcggaggtttaacttcataggtgggatgatttctcgcgagaagcaaccctacaatctgatcaaaaacccggtcacccaccaggttatctgggatgaagagatggaaattggcgactgccagaagaaaaatcctgagcagccaaagcatgatgcgacggtgaagatgatgaacttgacaaaaatcatgaatctcaagcacattctggtgacccatgaggtatatgaaaaccacggagctctatttaatcaaactatataccccgcctcgcaggcacacaaaaagaaactgatccctcagaagacagagaaacccattgaactttacggcgggcatagctccgagcaggccggatatatggctatcattcgtctcctgggtaagagaccaggctacaaggtcatgcgggtgcctgttaggtatgtgtcacaattgcagcaccaggacgtcgcagaacagaaaaagctgttatacaaaatcttcgtgagtgagctcacctctcgcaacaaggttaaacccttcgaggtggtagtcccacatgtgtgtctgaatcaaccggtggaagatatgataaaggggcagtggcaccgatttgcccttagaactaacggatattaccagaatcagcaacagctgatcttgagcctcgtcgcgcagcggaccctggctggctataagcctaaagacgatgagctaatggccgtttaccatgaaatttgcaagcaagtgaaatactatttccccctgtacaagatgaacaaatttcagtccaggcttttcgcagccgaggagctcctgcagaagcgctcaacagtaaacagcttttctatcacgattggtaagaatgggaaagaaaacaagaccttgaatttaggcaaaagagagctgctcctgaggcttctgggaggcttgcacgctaacgccactcgggtggacctaaaggatatcgggtgtacaggacagttcggccaactgcaggtcaaaaatggtataaagctcaccgaacaggcagtgctgattcacgagtccccaacagggctttttcatcgtcgcgttcgattaaacgacctgtga

SEQ ID NO: 3185 - RNA, 4134 nt, synthetic construct
  misc_feature 1..4134: note = Cas9 variant
  source 1..4134: mol_type = other RNA
atgaccaagaaaaactacagcatcggcctggacattgggacaaattccgtgggatgggccgtcataactgatgactataaggttcccgctaaaaagatgaaagtgctcggtaacacggataagaagtacatcaaaaagaatcttctgggcgcattgttattcgactctggggagaccgccgaagcgacaagactgaaaaggactgctcggcgccgatatacccgtagaaagaacaggctacggtacctccaggagatttttgccgaagagatgacaaaagtagatgaatcattcttttatcgcctggacgagagtttccttaccactgatgagaaggactttgaaagacaccctatcttcggaaataaggcagatgagattaaataccatcaagaatttccaacaatctatcacctgaggaagcatttggccgacagctccgagaaagctgatctccggctggtgtacctggcactcgcccacatgataaagttccgcggccactttttaatcgagggtgaactgaacgctgagaataccgacgtccagaaaattttcgccgattttgtgggggtttacgaccgaacgttcgacgattctcacctttcggaaatcactgtggacgcggcatcaattttgaccgagaagatcagcaaaagtagaaggctggaaaacctaataaagtattacccgacagagaagaaaaatactctctttggaaacctgattgcccttgctctgggcttgcagcccaatttcaagatgaacttcaaactctccgaggatgccaagctgcagttttctaaagacagctataatgaagatttagaggaactgctcggcaagatcggggacgattacgcagaccttttcacctccgctaagaacctgtatgatgccattttgctatcaggaatcctgacagtcgacgataatagtaccaaagcgcctctcagcgcctctatgatcaagcggtacgcagagcaccatgaagacctggagaaacttaaggagtttattaaagctaacaagtccgaactgtatcacgacatattcaaggatgagacgaaaaacggttacgccggctacatcgaaaatggggtgaagcaagacgagttttataaatacttgaagaacactctctcaaaaattgctggaagcgattatttcctggacaagatcgaacgtgaggactttttacgcaagcagagaacattcgataatggcagtataccacatcagattcatctgcaggagatgcacgccatcctaaggcggcaaggtgattactatccctttctcaaagaaaaccaggaccgaatcgagaagattctgaccttccgcatcccttactatgtagggccacttgcaagaaaagattctaggttttcctgggccgaataccatagcgacgagaagattactccctggaatttcgataaagttatagacaaggagaaatcggctgaaaagtttatcacacggatgaccttgaacgatctgtacctccctgaggaaaaggtgctgccaaaacactctcatgtctatgagacgtacgcggtgtataatgaacttaccaagattaaatacgtgaacgagcagggaaaggactccttcttcgactcaaatatgaaacaggagatctttgatcacgtcttcaaggaaaaccgcaaggttacaaaagagaagctgttgaattatctcaacaaagaatttccggagtacagaatcaaggacctgattggcttagataaagaaaataagagtttcaacgcaagcctgggcacttatcatgacctaaagaaaatactcgataaggcctttctggacgataaagtgaatgaggaggtaatcgaagacattatcaagacccttacattgttcgaggataaagacatgattcacgaaaggctgcaaaagtactccgatatctttactgctgaccagctcaagaaactggagcgtcggcactacaccgggtggggacgattatcttataagctgataaacggtatcagaaacaaagaaaataacaagacaattcttgattacttgatcgacgacggcagcgccaataggaacttcatgcagctcattaatgatgacaccctgccctttaaacaaatcatacagaagtcacaggtggtcggggatgtggacgatattgaggcagttgtgcatgacctacctggaagtccagccatcaaaaagggcattctgcagtccgtcaagatcgtggatgagctcgtaaaagttatgggtgacaaccccgataatatagtgatcgaaatggctcgcgagaaccaaactacgaatcgggggagaagccagtctcagcagaggctgaagaaacttcaaaactcattgaaggaactgggcagtaatattttaaacgaggagaaacctagctatatcgaagacaaggtcgaaaattcccacctccagaacgatcagctgttcctttactatattcagaatggaaaggacatgtacacaggcgacgaactggatatcgaccatttgtctgattatgacatagatcacattatcccacaagcctttatcaaagacgattcgattgacaaccgcgtgctcaccagctccgcaaagaaccgagggaaatcagatgacgtccccagtctggatatcgtgcgggcgcgtaaggctgagtgggttagactatacaaatctggactgattagcaagaggaagttcgacaatctcactaaagccgaacgcggtggcctgaccgaggcagataaggccgggtttataaaacggcagcttgtggagacaagacagatcaccaagcacgtagctcagattttggacgccaggttcaacactgaatccgacgagaatgataaagtcatccgagacgtgaaggttattacactgaagtcaaacttagtgagccaattccgcaaagattttgagttctacaaggtccgggagatcaatgactatcatcacgcacatgatgcttacctcaacgccgtggtaggaacggcgctgcttaaaaagtatccgaaactggcctctgaatttgtgtacggcgagtataagaagtacgacgttcacaaactaatagctaagtccagtgatgaccatagcgagatgggtaaagcaaccgccaagtatttcttttactctaatctcatgaacttctttaaaagagtcatcaggtactccaatgggaaggtgattgtgcgtcctgtcgttgaatattcaaaagatactgaggacatcgcttgggataagaagagtaacttccgcacaatttgcaaagtgctgagctacccccaggtgaatatcgtaaagaaagtcgaaacccagacaggcggattttcgaaggagtccatattgccaaaaggcgactctgataagctgattcctcggaagactaaaaaggcctattgggacaccaaaaagtacgggggattcgacagccccacggtggcatattcagtttttgtggtcgcggatgtggaaaaaggtaaggccaagaaattaaagaccgttaaagagctcgtgggcatcagtatcatggagagatccttcttcgaagagaacccagtagaatttctggagaataaggggtaccacaacattagggaggacaaacttataaagctgcccaagtattctttgttcgaatttgagggaggcaaacgacggctcctggctagcgcctccgaactacaaaagggtaatgagatggtcatccctgggcacctggtgaaacttctctaccatgcacagcgcattaactcattcaacagcacaaagtacctggattatgtgagtgctcacaaaaaggaatttgagaaagtcttgtcttgtgttgaggacttcgccaatctgtacgtggatgtagaaaagaacttatccaagatcagagcagtggccgacagcatggataatttttcgattgaggaaatctcaaactctttcataaatctcctgactcttaccgctctgggcgcgccagccgactttaacttcttgggagagaaaatcccgaggaagcggtatacaagtactaaagaatgcctcaatgcaaccctgattcatcagtccatcacgggcctatacgagacacgaattgatctgagcaagatcggggaggaatga

SEQ ID NO: 3186 - RNA, 4134 nt, synthetic construct
  misc_feature 1..4134: note = Cas9 variant
  source 1..4134: mol_type = other RNA
atgaagaaaccctacagcatcggcctggacattgggaccaactccgtgggatgggccgtcataacagatgactataaggttccttctaaaaagatgaaagtgctcggtaatactgataagcacttcatcaagaaaaaccttattggcgctctgttgtttgacgaggggacgaccgcagaagatagaaggttaaagcggacatcacgccgacgttacactagaaggaaaaatcggctgcgctatctacaggagatcttcagtgaagagattagcaagctcgactcctctttcttccatagactggatgactcgtttcttgtaccagaagataaaaggggatcaaagtacccgatcttcgccaccctggaggaggaaaaggagtatcacaaaaagtttcccacaatataccatttgcggaaacacctcgcggacagcaaggaaaagaccgatctgcgcctgatctatctcgctttagcccatatgattaagtaccgaggccacttcctgtacgaggagagttttgacatcaaaaacaatgatattcaaaagatcttcaacgaatttatatccatttatgacaatactttcgagggttctagcctttccgggcagaacgcacaggtggaagccatctttacagacaagatttcaaaaagtaccaagagagagagggtcttgaaactgttcagcgatgaaaagtctacgggactattctccgagtttctcaaactgatcgtgggcaatcaggctgacttcaagaagcactttgatcttgaggaaaaagcacctctgcaattctcaaaggacacttacgatgaggacttggaaaacctcctgggccagatcggggatggatttgccgacttattcctggttgctaaaaagctctatgatgccattcttctgagcggtatattgaccgtgacagacccaagtactaaagcgcccctatctgcatccatgatcgagcggtacgaaaatcatcaggaggatctggccgctctcaagcagtttattaagaacaatctgagcgagaaatatgccgaagtcttctcggaccaatctaaggacggctacgcagggtttatcgatggaaaaaccacacaggaggctttctataagtacattaaaaaccttctgtccaagttggaaggcgccgactactttctcaataagatagagcgtgaagatttcctgcgcaaacagagaacctttgacaacggttcaatccctcaccagatccatttacaagagatgaacgcgattctgaggcggcagggggagcactatctattcctcaaggaaaatcgagagaaaatcgaaaagattctggccttccgcataccatactatgtgggaccccttgcaagaggcaacagggattttgcttggttgacgcggaatagtgaccaggccatccgcccttggaacttcgaggaggtagttgataaagctagctccgccgaagactttattaataagatgactaactacgatctgtatctcccagaggaaaaagtgctgccgaagcactctcttctgtacgagacattcgcagtctataatgaattgaccaaggtgaaatttatcgccgagggcctcagagactaccaattcctggatagcgggcagaagaaacagatcgtgaaccagttatttaaggacaaaaggaaggtcactgagaaggatattatacattacctgcacaatgttgacggatatgacggtatcgaactaaaaggcattgagaagcaattcaacgcttcactcagtacataccatgatctgcttaaaatcattaaggacaaagaatttatggataatcccaagaacggggagatcttggaaaatataatccacaccctgacgattttcgaggaccgtgagatgatcaagcagcggctcgcgcagtatgataccctgtttgacgaaaaagtgattaaggcattaacacgaagacattacactggatggggcaaactgtccgccaaacttatcaacggtataagggataaacagaccgggaagacaattttggagtatctcatcgacgatggcgactgcaatcgcaacttcatgcaactgattaacgatgacggactgagctttaaggaaatcatacagaaagctcaggtagtgggcaagactgatgacgtcaaacaggtggttcaagagatccctgggtctccagccattaagaaaggaatcctgcagtcaattaagatcgtggacgaactcgtcaaagtgatgggtcacaatcccgagagtatagtaattgagatggcacgggaaaaccagaccacagccaagggcaagaaaaatagccagcaaagatacaagaggatcgaggatgctctgaaaaaccttgcccctgggttggactccaatatcctgaaggaaaacccaaccgataatattcagttacagaacgaccgcctcttcctgtattaccttcaaaatggaaaagatatgtacactggcaaggcaatcgacattaaccagctgtctaattatgatatagaccacatcattccccaggcgttcatcaaggatgactcgttggataaccgagttctcacgagctccaaagacaatcggggtaagtcagacaacgtgccgagtattgaggtcgtgcagaaacgtaaggctttttggcaacagctgctagattctaaactgatcagcgagagaaagttcaataacctcacaaaggccaaacgcgggggcctggacgaaagggataaggtcggatttataaaacggcagcttgtggagaccagacagatcactaagcatgttgcacaattgctggacaccaggttcaacacagaagtgaatgaggaaaaccagaaaattcgaaccgtaaagatcattactttaaagtccaatctcgtctcaaactttcgcaaagagttcggcctgtacaaggtgcgggagatcaatgattatcaccatgcccacgacgcttaccttaacgccgttgtggcaaaagctatactgaagaaatatcctaagctagaacccgagtttgtctacggggattatcagaagtacgacctcaaaagatacattctaaagagcaaagcctctaatacaatcgataaggcgacggaaaaatatttcttttactccaacttgctgaatttctttaaggagaaagtgaggtatgccgacggaaccatcaagaagcgtgaaaacattgagtacagtaatgatactggtgagatagcttggaacaaagaaaaggacttcgcaacaatcaaaaaggtattaagcctcccacaggtgaatattgttaaaaagaccgaggaacaaacagtcggccagaacgggggactgttcgataataacatcgtgtctaagaaaaaggtggtcgacgcctccaaacttattcctatcaagtcaagtctgagccccgagaaatatggcggttacgctcgcccaactatagcctattcggttttggtgatcgcagacattgaaaaggggaagggcaaagcgaagaaactcaagcggatcaaagagattgtgggaatcaccatacaggataagaagaaatttgagtccaaccccgtaacgtacctggaagagtgtggctacaagaatattaactctaatctaatcatcaaactgcctaagtatagccttttcgaatttaacgacgggcaaagaaggctcctggcctcaagtattgagttgcagaaaggaaatgagctgatcttaccataccacctcaccgctctgctttatcatgcccagcgaataaacaagatttccgaaccgatccacaaacagtacgtcgaggcacatcaaaatgaatttaaggagctgttgacaactattatctctctcagcaagaaatatatacagaagcccaacgtggaactgctactgcagcaggcttttgatcaagccgacaaagatatttaccagctttccgagtcattcatcagcctcctgaagttgaccagttttggcgcacctggtgccttcaaatttttaggggttgagatctctcagtccagcgtgcggtataagccaaattcgcagttcctggacacaactctcattcaccaatcaatcaccggactgtacgaaacgcgcattgatctttctaagctgggcgaggactga

SEQ ID NO: 3187 - RNA, 4134 nt, synthetic construct
  misc_feature 1..4134: note = Cas9 variant
  source 1..4134: mol_type = other RNA
atgaacaataagccctacagcatcggcctggacattgggaccaactccgtgggatggtctgtcataacagatgactataaagttccttcaaagaaaatgaaggtgctcggtaatactgataaaagattcatcaagaagaaccttattggcgccctgttgtttgacgaggggacgaccgctgaagcaaggcggttaaaacgcacagcccgacgtagatacactaggcggaagaatcgcctgagatatctacaggagatcttcgcggaagagatgagtaaagtagatagctcctttttccacaggctcgacgattcttttctgattccagaagacaagcggggatcgaaatacccgatcttcgctacccttgtggaggagaaggaatatcataagcaatttcccacaatataccatctgcgcaaacagttggccgattcaaaggagaaagcagacctccgactgatctatctggtcctcgcccacatgattaagtacagaggccacttcttatacgaagaggcttttgatatcaaaaacaatgacattcagaagatcttcaacgagtttataagcatttatgataataccttcgaaggtagttccctgtctgggcagaacgcacaagtggagactatctttacagacaaaattagcaagtccgccaagagggaacgggttcttaaattgttccctgacgagaagtcaaccggactgttcagtgaatttctaaaactcatcgtgggcaatcaggctgatttcaagaaacattttgacctggaggagaaggccccacttcagttcagcaaggatacgtacgacgaagatctggagaacttgctcgaacagatcggcgacgattttgcggacctgttcgtcgcagccaaaaagttatatgatgctattctgctctctgggatacttactgtgaccgacccctccacaaaagcccctctgtcagcaagcatgatcgagcgttacgaaaatcaccaaaaggatttggctgtactaaaacagtttattaagactaacctgccagagaagtatgttgaggtgttcagtgaccagtctaaagacggatacgccggttatatcgatggcaagaccacacaggaagcgttttacaaatacataaagaatctcctgtccaaattcgacggggccgattattttcttgacaagattgagcgcgaagtcttcctgagaaagcaaaggacctttgataacggaagcatcccccaccagatccatttgcaggagatgaacacgattctccggcgacaaggcgaacactaccctttcctgaaagagaataaggagaaaatcgaaaagattttaactttccgcataccatatcatgtgggtccgctggcaagagggaacagggactttgcttggctaacacgcaattcggatcaggccatccggccctggaacttcgaggaaattgtggacaaggcttcttccgccgaggattttatcaataagatgaccaactacgacctctatctgcctgaggaaaaagtccttccaaagcactcattgctgtacgagactttcgcagtttataatgaactcacaaaggtgaaatttatcgccgagggaatgagagattaccagttcctggacagtggccagaagaaaaagattataaaccaactttttaaaaagaagaggaaagtaaccgaagatgacatcattgactgcctgcagaagatcgataattacgacggcattgagttgaaagggatcgagaagcagttcaacgctagcctctccacgtatcacgatatactgaaaatcattcgtgacaaggaatttatggatgaccccaagaatggagatatcttagagaacgtgattcataccctgacaatcttcgaagaccgggagatgataaaacagcgactagcgcaatacaattctatttttgatgaaaaggtcatcaaagcactcagcagaaagcactatactggttggggcaaactgtcagccaaacttattgacgggatcagggataagcagaccggaaaaacaatattggactacctgatggatgacggcaagagtaaccgcaatttcatgcagctcatcaaagacgatgagctgtcctttactgagattatccagaaggctcaagtggttggtgacaccgataacttaagacaggtggtccagaacctgcctgggagcccagccattaaaaagggcatccttcagtctataaaaattgtggacgaattggtaaaggttatgggacatgcacccgagtcaatcgtgatcgaaatggcccgggagaatcaaacaaccgctaggggcaagaaaaacagtcagcagcgctataagcgaattgaagatagcctcaaaaatctggcctccgggctagactctaacatcctgaaggagaatccgactgataacattcaactccagaatgaccggctgttcctttactatttgcagaacggaaaagatatgtacacgggtgaggcactgaatataaaccagttatcgagctacgacatcgatcacattatccctcaagcgttcattaaggacgactccctcgataatcgtgtcctgacatcaagtaaggacaacagaggcaaatctgataatgtgcccagccttgaagtcgtggagaagatgaaggctttttggcagcagctgttggactccaagctcatctcagaaaggaaatataacaatctgaccaaggccgagcgcgagagagggggactaaacgaactggataaggttggcttcataaaacggcagctcgtggagactaggcaaatcaccaagcatgtagcacagattctggacgcccgatttaacaaagaagtcacagagaagaataaaaagaaccgcaatgtgaagatcattacccttaaaagcaacatggtttctaatttccggaaggaatttggtttgtacaaagtgagagagatcaacgattatcaccacgctcatgacgcctacctgaatgcagtcgtggctaaggccatactcaaaaagtatccaaagttagagcctgagttcgtatacggggattatcagaaatacgacctgaagaggtacatttcccgtagtaaagatcccaaggaagtggaaaaagcgactgagaagtactttttctatagcaaccttctgaactttttcaaagaagaggttcactatgccgacggcacaatcgtcaagcgcgagaatatcgaatactctaaggatacgggagagattgcttggaataaagaaaaggactttgcaaccatcaaaaaggtgctatccctcccacaggtgaacatagtcaaaaagactgaggaacaaacagttggccagaatgggggactgttcgacaacaatattgtgtcaaagaaaaaggtggtagatgccagtaaattgatccccattaagagcggtctgtcgcctgagaaatatggcgggtacgctcggccaaccatcgcctattccgtcttagtgacatacaagcagaacaacaagatcaaaaatactatggttggaataccggtgctcaccaagctggagttcgaaagagaccccaacctttacctgaggaatttgggcattaacaatgtctctcatgtgatcaaactcgttaagtatacggtgctggagtttaaacacaagtacggtacctatcgacggttcattgtaagcaaccaagaactaaagcgcgcaaatcagatctttgtcacaactaaacagatgaagctgatatcacagtacaccacacttgataaaaacgagcacgacagtctcctgaagaataaccaacagttgattcagtccatctggaatcagttcctggagtttatgttagcgactgatctcgtgaacaaaaagcaatatgacgaactgatccttaccaataaccagacgattgaggaatgtagaaatatcatgaacagggtgataacaaccctgtctttcactaatattaacgccgggcagaaaaagatcatttttgatgacacattgagcctccctatcaagcggtggcagttcaccgattccgacaaaatggtcaagaaaataattgagtcaactctgatccatcaaagcatcaccggcctatacgaaacacgaattgatctgagtaaacttggagaggactga

SEQ ID NO: 3188 - RNA, 4134 nt, synthetic construct
  misc_feature 1..4134: note = Cas9 variant
  source 1..4134: mol_type = other RNA
atggagagcaaccacgacggcgaacaggtgaagtacaccctggggctcgatatcggaacatcctctattggttatgccgctatagacaaacatcaaaagcccatcagagcaaaaggcaagcacgtcattggggttaggcttttccaggagggacagactgccgcggatcggcgcgcttttcgaacgacccgtagaaggctgaaacggcgcaagtggagattgaatttactgaacaggctattcgacccttacctctcagaagtggatccaaattttctgccgcggcttcgccagagtaacctgagccccaaggacgataataaacatttcaacggctccacattgtttcctgacaagactgatgccgcattctatcgacaatacccaaccatgtatcacctcagatacgccctgatgacagagaaaaggaagtttgacatccgggaagtatatctggctattcatcacatcgtgaaataccgtggtaatttcctcaactctgcaaccgtcgattcgtttaagacttcaaatatagacttcacaagccagtttgatcgcttaaacgagctgtacagacaggtgatccttgacgagcccttccagattaatatggaccaagttgatgaaatgaccaacaagttgctggacaatgatgccctaaaactcgacacgcagaaacaggtggctaaactgcttcctgtcatctataacgataagccaattgacaaacagtacactaggatcgccaccgagtttagtaaggcgatactggggtataaaacaaagttggatgtgattctcaatctggacactcaaaacgcaaaggattgggtaatccggttagacgatgaagacattgacgataaactgcccgccctcgttgagaaccttgacgagtcccgacaggaaatcgtgaccatcattcgcgatctgtacgctcagataacattgaatgccatcgtccctaagggaaaatctctaagcgagtccatggtggacaagtataacgatcacaaagaccatctggatctcctgatgggccttattcacgaactgggcgacgattcagcaaaggggatcaagttgagagaggcttacacccaatatgtgggaaaaagtgacgataagacgctcaatcaggacgatttctacgccgcgataaagaagaacctggacgaagacagcaaaaggtctccaaagattcagcggttaatcgagcaggcctccttcatgccgaagcaacgcacttcagcaaatggtgtcatcccccatcagctgcaccagctagagctcgatagaattatcgaaaaccagggcaggtactatccttttctgaaaaagccaaatcccaacacacacaaacctaatgggggaaagtacaaacttgacgagttggttgctttccgtattccatattacgtgggccccctgataaccaagcgggatcaagaaaagactagcggtgccgactttgcttggatgatccgaaaaccggggcaggagggagaaattacaccttggaacttcgatcagaaggtagacagaatggccagtgcaaataggtttatccgccggatgaccacgaaagattcttatctcgtggccgaggacgtcctgcccgatgcttcccttatctacgagaagttcaaagcgctgaacgaattgaatatgctcaaggtgaacgacagcagactgtcgccatctcagaaacaagatttatttaataacctgttcaagaagcagaaaaccattaggacaaagaaactacagacttatatacgcaccaactgggagctcccttccgttatgatctcaggcctggcagaccccgataagtttaatagtagcctttccacatacattgacttccgagacatctttggcgaaaaagtggatgacccaaaccggcaggccgattacgaggaaattatcgagtggtctactgtcttcgaggaccgtaagatatatcaagctaagttgaatcagctggattggctcaccgaaccccagagaaaagccctgttaacaaagaggtacaccgggtggggacgcctgagcaaaaagttattgactggtctcaaagaccaaaacggcgattcaatcctggaccagctatggaagacgaatgataactttatgcagattcagagtcgggacgagttcgcaaagcaaatccatgatgaaaatgccaaacagttccacgaggctaacaatgtggacgacattctggatgacgcctttacatcccctcagaacaagaaagcaatcagacaggtagataaggttgtgcaagacgtcgtgaaagcggtcgggtatgctccagataagatagccattgagttcaccaggagcctcgaaaataacccgcagcgaactgtgtctcgccagcggcagctgcaagcagcctacaagaatatccccagagagattatgaaatcaggacttatggctgaattgggcagtgttgccgacagcaagaaagtgctgtccgataagttatatctctactttacccagatgggtaaagacatgtatgaggataagacaatcaacatagacaatctgcctaactacgatatcgaccatattcttccacaggcattcatcaaagatgactctattgacaacagggtactgatctcgaaggaagagaatgctcgtaagagcaaccgcgtccccttgaaatttttcggggccaagcggatgggcttttggaaagatctcctgaataacggactaatatccaatagaaagttccaaaacctgaccactgaccctgagaaaatttcaaagtacagtgcgaagggctttatccacaggcagctcgtggaaacatctcaggttatccgactggtggccaatattcttgggaacgagtatagccaggctggaacgaccatcattgaagtctccgcaaaaatgaatcggcaattgcgcgaggatttccatctgataaagaacagaaatgtgaacgactaccaccacgccatggatgcttatttaactgcctacgtaggtgactatctctacctgaggtatccaaaacttcggccctactttgtgtacggcgatttcaagaaagcagaagaccaggatctgaatatccgaaactttaatttcctacatgacctcaaggataacgagtcactggacaagattgttgatagcgagacaggggaaatcgtctgggagaaacacggatctgtgaagcagttgaaaaaggtgtatcattacaaattcatgctggtctcccaggaagtttataccagacaagacgcgttatttaaccagacaatttacccggccagtgacgctgataagcgcaagctcatccctataaagaatagcaagccagtggacgtgtatggcggttactctgggaacatcgatgcctatatggcaattgtaagggtccacggcaaaaaggaggacaattacaaagtggttggaatccccatgcgtgctgtgactaagctgaagaaagccgaaaaggagggccacgattcctaccttaacgcagtccatgaggtgctgaaacctcagttcaccaagaaaaagaaaaatcggaagacgggggaaattaccgagacagttgacgaatttgatgtgttgctcggaaaggtatattacagacagctgatcgtcgacggtaacaaaaagttcatgctaggctcaagtagctatcaatacaatgccaaacagctggtgctttcggataaggctatgcaagtgctctccaaaaacgggaaggtcaagtctcaggacgagaatcagaacctgatagatgtttatgacgagattttggaaaaagtggaccagtactttgagctgtatgatcagaggcactaccgcgaaagccttcataagggacgaggcatcttcgtaaatctccccctgtcaaaccaatacgacggtagtaaacttacttcctatgggaagtacgagaccatcgatgcgattctgaatggcttgcacgccaacgcaacaatgtctaatctcagatatctgggaataagctccccatttggcaaaatgcaggcttcaaacgggctaactatcgaccctgatagcattatctgctaccagagtcccaccggactgttcgaacggcagattaaactttctgacctctga

SEQ ID NO: 3189 - RNA, 4134 nt, synthetic construct
  misc_feature 1..4134: note = Cas9 variant
  source 1..4134: mol_type = other RNA
atgaacaagccctacagcatcggcctggacattgggaccaattccgtgggatggtctataatcacagatgactataaagtccctgccaagaaaatgagagttctcggtaacactgataaggagtacattaaaaagaatcttatcggcgctctgttgttcgacgggggaaacacggcagccgataggcggttaaagcgcaccgcgcgacgtagatatacaaggcggcgcaataggattctgtacctacaggaaatctttgctgaggaaatgtcaaaagtggacgatagtttctttcacagactcgaggacagcttcctggtagaagaggataagcggggctccaaatatccaatatttgccactatgcaagaggaaaagtactatcatgagaaattcccgaccatctaccaccttcgcaaggaactggcagacaagaaagagaaggccgatttgcgactcgtgtacctggctctggcacatattatcaaatttagaggtcacttcctcattgaggacgataggtttgacgtccggaacacagacatccagaagcagtatcaggccttcttagaaatatttgataccactttcgagaataaccatctgctttctcaaaatgtggacgttgaagctattttgacagataaaatctcgaagtcagccaaaaaggaccgtattctggcgcagtaccccaaccaaaagagcaccgggatctttgcagagttcctaaaactcatcgtgggaaatcaggccgatttcaagaaacactttaacctggaagacaagacgcctcttcaattcgctaaagatagttatgacgaggatctggagaatttgctcggccagattggcgacgaatttgccgatctgttctccgtcgcaaagaagttatacgactctgtgctgctcagcgggatacttactgtaaccgacctgtccacaaaagctccattgtcagccagtatgatccagcgctatgatgagcaccatgaagacctaaagcacctgaaacagtttgttaaggcgagcctccccgagaactacagagaagtgttcgccgattcttccaaagacggatatgcaggttacattgagggcaagactaatcaagaggctttttacaagtatctgcttaaactgttgaccaagcaggaagggtcagagtacttcctcgaaaagatcaagaacgaggattttctgaggaaacagcggacattcgacaacggaagcatacctcatcaagtccacttaaccgaactgcgagccattatccgcagacagagtgagtattacccatttctaaaggagaatcaggataggatcgaaaagattctcacgttccggatcccctattacgtgggccctctggctcgcgagaaatctgactttgcctggatgactagaaagacagatgactccattaggccatggaacttcgaagatcttgtggacaaagaaaagagcgcagaggccttcatacaccgtatgaccaataacgatttgtatctgccggaagagaaagtcctccccaagcattcgctgatctacgaaaaatttactgtttacaatgagcttacaaaggtgcggttcctggctgaaggttttaaggacttccagtttttgaaccgaaaacaaaaggagaccattttcaattctctctttaaagagaagagaaaagtaacggaaaaggacatcatctccttcctgaacaaggtggatgggtatgagggaattgcgataaaaggcatcgaaaagcagtttaatgcatcattaagtacctaccacgacctgaaaaagattctaggcaaagatttcctcgacaacacagataatgagctgatccttgaagacattgtccagactttgaccctgtttgaggatagggagatgatcaagaagtgcctcgacatatataaagatttctttacagaaagccagctgaagaaattataccgccggcattatactgggtggggaagactgtccgccaaacttatcaacggtattaggaataaagagaaccaaaagaccatcttggactacctcattgatgacggctctgctaatcgcaacttcatgcagctgatcaacgatgacgacctgagcttcaagcctataattgataaagcccgaacagggtcacacagtgacaatctaaaggaagtggttggagagctcgcaggctccccagccatcaaaaagggtattctgcagagccttaaaatcgtggatgaattggtcaaggtgatggggtatgagcccgagcagatagtagttgaaatggctcgggagaaccaaaccactgccaaaggcctgtctcgttcaagacagaggttaacgacactccgcgaaagtctggcaaatcttaagagcaacatcctggaggagaagaaacctaagtacgtgaaagaccaggtcgaaaatcatcacttgtccgatgaccggctctttctgtactatctacagaacggaagagatatgtacaccaagaaagcgctggacattgataatctctctcaatatgacatcgatcacattatcccacaggctttcataaaggacgactcgattgataacagggtgctggtcagctccgccaagaatcgaggcaaatcagacgatgtgcccagtatcgagatcgttaaggcacgcaaaatgttttggaagaaccttttggacgccaaactgatgtctcagcggaagtacgataatttaactaaggctgaaagagggggactcaccagcgacgataaagccaggttcattcaacgtcagctggtggagacacgccagatcaccaagcatgtagcacggattcttgacgaaagatttaacaatgaggtcgataacggtaaaaagatatgtaaagtgaagatcgttactctgaagtccaatctagtgtcaaacttcaggaaagagtttggcttctataagattcgagaagtcaacgactaccaccatgctcacgatgcctatctcaatgcggtggtagccaaagctatcctgacaaagtacccgcagttggagcctgaatttgtgtacgggatgtatcggcagaaaaagctgagcaagattgttcacgaggacaaagaagagaagtactctgaggcaacgcgcaaaatgttcttttattccaacttaatgaatatgttcaagagagtcgtgaggctcgccgatggaagtatcgtggtccggcccgttatagaaaccggccgatacatgagaaaaactgcttgggacaagaaaaagcatttcgccacagtgcgcaaggtgctgagctatccacagaacaatatcgtcaaaaagaccgagattcagacaggtgggttttctaaagaatccatccttgcacacggcaactcagacaagctgattcctaggaaaactaaggatatctacttggaccccaagaaatatggaggcttcgatagtccaatagtagcgtacagcgtgctcgttgtggccgacattaagaaagggaaggctcagaaactgaagaccgtcacggagctactgggaatcaccatcatggaacgttcgcggtttgagaagaatccctccgccttccttgagtctaaaggttacctcaacattagagatgacaagctgatgatattgcctaaatatagcctgtttgaattagagaatggcaggcgccgactcctggcatcagctggggaacttcaaaagggaaacgagctggccttgccaacacagttcatgaaatttctctacctggcaagtagatataatgagtccaagggcaagccggaagagatcgagaaaaagcaggagttcgtgaaccagcatgtttcttactttgatgacattctacaactgatcaatgatttcagcaaacgggtgattcttgccgacgctaacctcgaaaagatcaataaactgtatcaggataacaaggagaacatacccgtagacgagttggcgaataacatcattaatttatttactttcacctccctgggtgcccctgcagcttttaaattcttcgataagatcgtcgacaggaagcgctacacatcaactaaagaagtgctcaacagcaccctgattcaccagagtatcacggggctttatgagacacgtatagacctgggcaagttgggagaagattga

SEQ ID NO: 3190 - RNA, 4134 nt, synthetic construct
  misc_feature 1..4134: note = Cas9 variant
  source 1..4134: mol_type = other RNA
atggagaagacctacagcatcggcctggacattgggacaaactccgtgggatgggccgtcataactgatgactataaagttcccgctaagaaaatgaaggtgctcggtaatacggataaaaagtacatcaagaaaaaccttctgggcgcattgttattcgactctggggaaaccgccgaggcgacaagactgaagagggctgcccggcgccgatatactcgtaggaaaaataggctacggtacctccaggaaatttttgcaaaggagatggccaaagtagatgaatcattctttcaacgcctggaggagagtttccttaccgacgatgacaagacatttgatagccaccctatcttcggaaacaaggctgaagaggacacctatcatcaggaatttccaactatttaccacctgagaaaacatttggcagattccccggagaaggtggacctcaggctggtctatctggccctcgctcacatgatcaaattccggggccactttttaatagagggtcagctgaatgccgaaaacacagatgtgcagaagatcttcgcggactttgttggggtgtacgaccgcaccttcgatgactctcacctttcggagattacggtcgatgcagcctcaatcttgactgaaaagattagcaagagtcgaagactggagaatctaatcaaacaataccccaccgaaaagaagaacacactctttggaaatctggtggctcttgccctgggcttgcagcctaacttcaaaactaatttcaagctctccgaggacgcaaaactgcagttttctaaggatacctatgacgaggatttagaggagctgctcggcaaaataggggacgattacgctgaccttttcacagccgcgaagaacctgtatgatgccattttgctaagcggaatcctgaccgtagacgacaattccacgaaggcaccactctcagctagtatgattaaaaggtacgaggagcaccatgaagatctggagaaacttaaaacttttatcaaggttaacaatttcgacaaatatcacgagatctttaaggataagagcaaaaacggttacgccggctatattgaaaacggggtgaagcaggacatattctacaaacatctgaagtctatcatttccgagaaaaatggaggccaatactttttggataagatcgaacgggaggacttcctccgtaagcagcgcacatttgataacggttcaataccctatcagattcatctgcaggaaatgagaaccatcttaaggcggcaaggggagtactatcctttcctgaaagagaatcaggctaagatcgagaaaattctaacttttcgaatcccatactatgtcggacccctcgcccgcaagaacagcagattcgcatgggccaaataccacagtgacgaacctattacaccatggaattttgatgaagtggtggacaaggagaaatctgctgagaagttcataaccaggatgacgctgaacgatctttatttgccggaagagaaggtcctgcccaaacattcctacgtttacgaaaccttcgcggtgtataatgagctcacaaagatcaaatacgtaaacgaacagggcaagagctttttctttgacgcaaatatgaaacaagagattttcgatcacgtgtttaaggagaaccggaaggtcactaaagccaagctgctttcgtatctgaataacgagttcgaagaatttcgcatcaatgacttgatcggcctcgacaaagattctaagtccttcaacgcttcactggggacctaccatgacctgaaaaagattttagataagagttttctagacgataaaacaaatgagcagataatcgaagacattgtgctcactctgacccttttcgaggatagagacatgatccacgagaggttgcagaagtatagcgatatttttacatcccagcaactgaaaaagctcgaacgtcggcattacaccggatggggtcgactgtcttataaattaatcaacggcataagaaacaaggagaataacaagactatcctggacttccttattgatgacggggatgccaataggaactttatgcagttgatcaatgacgacagcctctcattcaaaacgacaattcaggaagcacaggttgtgggagatgtcgacgatatcgaggccgtggtacacgacctgcctggcagtccagctataaagaaaggtattctacaatccgttaagatcgtggatgaactggtcaaagtgatggggcacaacccccagaatattgtcatcgagatggcccgcgagaaccagataaccggctacggacggaatagaagcaaccagaggctcaagcgcctgcaagactctcttaaagagttcggctcagatatcttgagtaagaagaaacctagctacgtggactccaaggttgaaaattctcatctgcagaacgatcgattatttctctattacattcagaatgggaaagacatgtatactggagaggaactggatatcgaccacctttcggactacgatattgaccatatcataccacaggcattcattaaggataacagcatcgacaatcgggtgctgacctcctcagcgaaaaaccgtggtaagagtgatgacgtaccctctatcgaaattgtcagaaacagaaagagctattggtacaaattgtataagtccggcctcatctcaaaacgcaagtttgataatctgacaaaagctgaaagagggggactaaccgagactgacaaggccggcttcattaagcggcaactggtggaaacaaggcagataacgaaacacgttgcacagatcctcgatgcccgatttaacaccaagtgcgacgagaatgataaagtgattcgcgacgtcaaggtgatcactctgaaaagctctcttgtatcccaattccggaaggaatttaagttctacaaagtgagagagattaacgattaccaccatgctcacgacgcctatttgaatgcagttgtcggtacagctctgttaaagaaatacccgaagctcgcccctgagtttgtgtatggggaatacaaaaagtatgacgtgaggaagctggtcgcgaaaagtagcgataaccattctgagcttggcaaggccaccgctaaatacttcttttattccaatctgatgaacttcttcaagacagaagttaaatacgcagacggacgtgtgtttgagcgccccgatatcgaaactaatgccgacggcgaggtggtatggaacaagcagcgggatttcaatatagtcagaaaagtgctatcatacccacaggttaacatcgtgaagaaggtcgaggtgcagaccgggggatttagtaaagaaagcattctccctaagggtgactcggataaactgatccccaggaagacgaaaaagttgcaatgggagacccagaagtatggcgggttcgactccccaacagttgcttactctgtgctggtagtcgccgatgtggaaaaaggaaagactcgaaaattaaagaccgtgaaagagctcgtcggcattagcatcatggaacggtcaagttttgaggagaatcccgtttccttcctggaaaagaagggttatcacaacgtgcaggaggacaaacttataaagctgcctaaatactctttgtttgagttcgaagggggccgcagaaggctcctggcaagcgcgacagaactacagaagggaaatgaagtagtgctgccacaatatatggtcaaccttctctaccattcccagcacgtgaacaattcacacaaaccggagcatctgaactatgttaagcagcacaaggatgaatttaaagacattttcaatttgatcatcagcattgcccggataaacatcctgaagcccaaagtggtcgataatttaattaacgagtttactgaatacggccaggaggacatcagttctctctccgagagcttcattaatctgcttaagtttatctcgttcggggctcctggagccttcaaatttctgaagttggacgtgaaacaatcaaacctccgatacaagtctaccacggaagcactgagtgctacactaatacatcagtccgttaccggcctgtatgagactagaatcgatcttagcaagctcggtgaagagtga

SEQ ID NO: 3191 - RNA, 4137 nt, synthetic construct
  misc_feature 1..4137: note = Cas9 variant
  source 1..4137: mol_type = other RNA
atgaagaccttcgccgaggaatacgtgatggacaaaagcaagccctatggcatcgggctggatattggaacaaactccgtcggttttgttgctactgacgcagagggccacctcataagacttaaagggaagacggtgatcggagcctacctgttcaatgcgggcatttctgctgccgaaaggcggggttttcgcaccacacgacgtagattgtcaagggtaaaatggcggttagggctgctacgcgagatcttcgaaactcattttcaggagagtatgggagagaacgaagataatgacttctttctcagattcaagtatagcaacatttcccctaaggatccacaattttctaccgcaaaaggcctgttcaatgacaggacagataaggagttttacgaccagtatccgaccatctaccaccttcggcgcgccctgatgactgaagatcatcagttcgacatacgagagatctatattgctatgcaccatatcgtgaaatacagaggccactttttgaaggaggggagggcaaaagatttcaaggtcggagacctccggctgctggataacttcaagatgatgaatgaacagattgaggaaatcaaccccctctggcaattaaaactgcctacagacgacgcctcgataaagtcaattaccgctatccttttggataatacgcagagccagaacgaccgtcagaaagccgtgactaaggttattctggcgaccctagtgaaagcaagtgataaggacatcaatgccgctcgcaaaagatttgtcggtgagctctccaaggccatggtgggcctgaagacaaaactttgggtactggcagatgtttctcaaaacggggactgggaaatcaagtacgagaattatgctgatttcgccgagactattggaagcggcgaatccgacaccatacagtcattgtttaacgagatcaatgatctctacggtgtgattacactggcggggatcataccaaaagaagccgagagtttcagcgacggaatggtcaggaagtatgaacaccatcggaaaaacttagagctgctcaaggtgtactgcgcagagcagtctgatggcaagcgaggccgccagattagacaaacctatgacaaatacatcgacggggtggattccaagcagtttacgcaggaagacttctataaagctctttcaaagtttactgccaaagatgaggctacaagcgaaaacgccaagctgatcgcacaagagattgccgtcggaaccttcatgcccaagttgaggactaaagctaatggtacaatccctcaccagctacatcagaaggaactggacgcgattatagagaaccagaaaaagtactacccatggctcggcgaggttaatcccgtggaaagtcaccggcgcgcactgccttataaacttgatgagctggtatcttttagaatcccatactatgtggggccgatggtcacccccacgaagggagaccctgaaaagtccaaattcgcctggatggtgaggaaggagccaggcaccattacaccctggaactttgatcaaaaagttgaccgtagcgcttcgggtgaggccttcatccagcggatgaagactaccgatacatttttgatcggggaagacgtgctccctcagcagtctctgttataccaaaaattcgaggtcctgaatgaactaaacaagattatgataaatggcaaaccaatctgtcgagagcagaagcagagactcttcaagcagctgtttatgcaatataaaactgtgaccgtaaagaaagttcagcagaaccttattgcaaatggagaagagtccgagaacgtgcccatcacaggcttgtcagatccgctgaggttcaatagtagcttttccacctacattgactataaggatatcctcgggactgccgctgtcaacgacaatgccaaacagtctgacatagaacaaatcattgcatggagcacgatcttcgaggatgcggctatttttcgcgaaaagctgaacgacatcacatggcttaatgatgaccagcggaacaagctgtcacacaaaagatacaggggatggggtcgccatagtcgaaagttgctcgccggcctgcgggatggggagggacagaccataattgaacgtttatggaacactaatgacaacttcatgcaaatccagaatgattccgagattgcaagacagatcaccgaggccaacagctctaaaatggctacagccgaaggcaccgacgagataatcgatggtttttacacttcacctgaaaataagaaagcactgagggaggtgatgaaggtcgtgaaggacattcagcgcgctcaccatgggcaagcccccgcgtgggtttatatcgaaagtccacgggagacacctagacccggccagaggacggtgagccgagagcagcagctaaccgatctctacgaaggagccgctaaagagattgtagacgatgcagtcctgaacgaacttaaggacaaagtgaagtccaaagagaatttcactgacaagttggttctgtattttctccaaaacggccacgatatctacgccaatgactctataaacattgataatctgaacgcttatgacatcgatcatgtgttaccacagtcgctgatcaaggacgatagccttgacaatcgcgtcttgacaacccacgagcggaacctcaaaaagtccaatagattcgccacagaactgtttgcagatcagaggaaaaagtgggagaaatggcaccgtctagggctgatttcaagtcgcaagctcaaacatctgactatgcagcccaactctgtggaaaagttcgcgcacggatttatcgcccggcaacttaccgagacgagacagattatacatttgaccgctaacgtactgagcaatttataccaggaaaacgacacaaagatcgtgatgattaaagccggtctcaattccgagttcaggcgaactttcgattttcctaagaaccggtcagttaatgactatcaccacgcattcgacgcttttctgaccgccaaaatcggccgctaccttctggcaagatacccaaagttggagccgttctttgtctatgggaacttcgtgaaaaatcccaaggccatgaagaggctcagctcttttgatttcattgctcaactggcggccaaaacagacgatacttcccatatcgaccagcggagtctaaaacaggtgcctgtcgttaacgaagagaccggagaaatagtgtgggataaggacatcgagctggcagaactcgataagacgtacaattataaaacaatgctggtgaagcgagctcagaccgagaacaatgcccaaatgtttaagcagactgtattcaaagccagagacaaccagaataagacacttattccagtcaaaaacggcttgagcaccgatgtgtacggtgggcactctcagcaagctatctcctatctgtgcattgtttgggtgggccagaagaaaaagtaccgcgtcttaggaatctcaactgcacatgccggcatactcaataactttgagaagaactatgggaggttcgaagcgaaaaagaaactgcaggagattgtgagtaatacccttgacaacgctgatcgtaatgacttcaagatcgttgcccccaaagtgctgtttgaacaggtagtcgaggatgacaacatgaagttcggactaggcagcgcatcggactaccggaatgtgcaacagctctttctgtccagaaagaaccagttgctgttagccaatatgatgacagatcagatccacgaccaagatctcgtgcatctgttcgacgaaattgtcggtcagatgaacgctcactttcctatattcgatcgcgggggatacaggtctagccttacgcagtcacgagacaaatttctgaagttgccattcaaaaagaatgaggatctcatcaccaaacaagaggttattagacggatcctggacggcctacacgcaaacgccaataggaaggatctgaaaattatcggtagtaagggcgactttgggcgccttggaactaagaaaatatatctctccaaggatgcgaaactgatctacacatctcccacctgtttgttcacacgtactgtgccgctgagctccttatga

SEQ ID NO: 3192 - RNA, 4137 nt, synthetic construct
  misc_feature 1..4137: note = Cas9 variant
  source 1..4137: mol_type = other RNA
atgaccaacgagaagtacagcatcggcctggacattgggacatcctctataggattcgccgtggtcaatgataacaatagagttatcagggtgaaaggtaagaacgctattggcgtacggctctttgacgaagggaaagcagccgcggatcgccgatcattccgtactacgagaaggcggcttagtcgcagaaggtggcggctgaagttgttacgcgagatctttgacgcttatattacccccgtggatgaagccttctttatccgactgaaagagagcaatctatcccctaaggactctaagaaacagtactcgggagatatactcttcaacgacagatcagataaggacttttatgaaaaatacccaacaatctatcacctgaggaatgcacttatgactgagcatcggaagttcgatgtccgtgagatttacctggccatccaccatattatgaaatttcgcggccacttcttgaacgctaccccggcaaataactttaaggtgggtagactcaatctggaagagaagttcgaagaactgaacgacatctatcaaagggtttttcccgatgagagcatagagttccggacagacaatctcgagcagattaaagaagtgttactggacaacaagcgaagtcgcgccgatagacagaggacccttgtctccgacatctaccagtctagcgaggataaagacattgaaaagcggaataaagctgtggccactgagatcttgaaggcgtccctggggaacaaagcaaagctaaacgtaatcacaaatgttgaggtggataaggaagccgctaaagagtggtcaattaccttcgacagtgaaagcatagatgacgatctcgccaagatcgagggacaaatgacggacgatggccatgaaattatcgaggtcctgcgctctctttactccggcataactctgtcagcaattgtgcctgagaaccacaccttgagccagagtatggtggctaaatatgacctccacaaggaccatctgaaattatttaagaagctgatcaatgggatgacagatactaaaaaggccaaaaacctcagagcggcctacgacggatatatcgatggtgtcaagggcaaagttcttccacaggaagacttctacaaacaggtgcaagtaaatctggatgactctgcagaggctaacgaaattcagacctatatcgatcaggacatttttatgcccaagcagaggacaaaagccaatgggtccatacctcaccaattgcagcagcaagagctagatcagatcattgaaaaccagaaggcttactatccatggctggccgagctcaatcccaaccctgacaaaaagcgtcagcaactggcaaaatacaaacttgatgagctggtgaccttccgggtcccatactatgtgggaccgatgatcacggccaaggaccagaaaaatcagagcggcgctgaatttgcgtggatgatccgaaaggagcccggtaacattactccttggaatttcgatcagaaagttgacagaatggcaacagccaaccaatttataaagaggatgaccactacagacacctacttgctcggggaagatgtgctgccagctcagtcgttactgtatcagaaattcgaggtcctaaatgagctcaacaagatccgcattgaccataaacccatctctattgaacagaagcaacagatctttaacgatctgttcaagcagtttaaaaatgtgacgataaagcaccttcaggactacttggtatcccaaggacagtattcaaaacggcctctgatcgagggcctcgccgatgaaaagagattcaacagtagcctgtccacctactctgacctttgcggcatttttggggcaaaactggttgaggaaaatgataggcaggaggacttggagaagatcattgaatggagcacaatcttcgaggataagaaaatatatcgcgccaagctcaacgacctgacttggttaaccgatgaccaaaaagaaaagctggctacaaaacgataccagggatggggtcggctatcacgtaagctcctggtgggccttaagaatagtgagcacagaaacattatggatatcttgtggattactaatgaaaacttcatgcagatccaggccgagccagactttgcaaaactggtcaccgacgcgaataaggggatgctcgagaaaacagattcccaagacgtgataaacgatctgtacaccagcccccagaataagaaagctatcaggcagattttactggtcgtgcatgacatccagaacgccatgcacggacaagcaccggccaagattcatgttgagttcgctcgcggcgaagaacggaatcctagaaggtctgtgcagcgacagcgccaggtagaggccgcatatgaaaaggtctcaaacgagcttgtgagtgctaaagttcggcaagagtttaaggaagccatcaataacaaaagagatttcaaggacaggttgctcctgtactttatgcagggtgggatagatatttatactggcaaacagctaaacatcgaccaactgagctcctaccagatcgatcacattctcccccaggcgttcgtgaaggacgattctctgacgaatcgtgtccttacaaacgagaatcaggtgaaagccgactcggtaccaatcgacatttttggaaagaagatgttgagcgtgtggggccgcatgaaagatcaagggctgatatccaagggaaaatatcggaacttaaccatgaatcctgaaaacatctcagctcatactgagaatggtttcattaacagacagctcgttgagaccaggcaggtcatcaagctggcagtgaatattcttgccgacgaatacggcgatagtacacagatcatatctgtgaaagctgacctgagccaccaaatgcgagaggattttgaattgctcaagaaccgggacgtcaatgattatcaccatgccttcgacgcatacctggcggcctttatcgggaactacctactgaagcgctatcccaaactcgagtcctacttcgtttatggagattttaagaaattcacccagaaggaaactaaaatgagaaggttcaattttatttacgacctgaagcactgtgatcaggtggtgaacaaggagacaggcgagatcctttggacgaaagacgaagatattaagtatatccggcatttgttcgcttacaaaaagatactggtatcacacgaggtccgagaaaagagaggtgccttatataatcagaccatttacaaggcaaaggacgacaaagggagcggccaaggatctaagaaactcatccgcatcaaggatgacaaagagactaagatttacggcgggtattccggaaagagtctggcttacatgacaatagtgcagatcaccaaaaagaacaaagttagctatagggtgattggtatcccaacacttgccctggcacgtctaaacaagctcgaaaatgattctactgagaacaatggcgagctgtacaaaattatcaagccccagtttacccactataaagtcgacaagaagaacggggaaataatcgagacgaccgatgacttcaaaattgtggtttccaaggtgcggtttcagcaattgatcgatgacgccggacagttctttatgctggcttcagatacatacaaaaataacgcgcagcaattagtaattagtaataacgccctcaaggcaatcaataacactaatataaccgactgccctagagatgacctggaaaggcttgataacctgcgcttggacagcgctttcgacgagattgtcaaaaagatggataagtatttttcggcctacgacgccaataacttccgagaaaagatcagaaattccaacctcatcttttaccagctgccagtggaggatcagtgggagaataacaagattacagaactaggcaaacggactgtgctgaccaggatccttcagggtctccatgctaacgcaacgacaaccgacatgtctatattcaagattaaaactccgttcgggcaactgcgccagcgtagcggcatctcattgagtgagaatgcccagctgatttatcagtcccccacaggattatttgaaagacgggtccaactcaacaagatcaagtga

SEQ ID NO: 3193 - RNA, 4137 nt, synthetic construct
  misc_feature 1..4137: note = Cas9 variant
  source 1..4137: mol_type = other RNA
atgaagaacaaagactacagcatcggcctggatattgggacctcctctataggattcgccgtggtcgacgagaataaccacgttatgagagtgaagggtaaaaatgctatcggcgtaaggctctttgatgaagggaagcccgcagccgaccggcgcgcgttccgaacaactcgtagaaggctttcacggcgcagatggaggctgaaattgttacgggagatttttgatagttatatcacgcctgtggacgaggctttctttattcgcctgaaggaaagcaacctatccccaaaggattctaaaaagcagtactcgggagacatcctcttcaatgatcgatcagacaaagatttttataccaagtacccgacaatatatcatctgagaaacgcccttatgactgaacaccaaaggttcgacatccgggagatttacctggcaatccatcacattgtcaaatttcgtggccatttcttgaatgccacccccgctaacaattttcaggtgggtaagctcgatctggaccagaagttcgaggacctgaacgatatctatcagcgcgtttttcctgacgatagcatagagttcagaattgacaatctcgaacaaatcaaagcagtgttactggatagtaagaggtcccggtctgaccgacagcgcagccttgtcgatgacgtgtaccagacatccgaagataaagaggtagagaagcagaacaaagccgttgctaccgaagtgttgaaggccattctggggaataaagcgaagctaaacatcatcgcaaatgtcgaggtggacaaggaagccgctaaagagtggactattacattcgattcagaaagtatagacgacgatctcgccaagatcgacggacaaatgaccgatgacggcagagcaattgtggagatcctgaggagcctttactctggcataacgctgtccgctattgtcccagagaaccacactttgtcacaggccatggttgcgaaatatgatctccacaagaaacatctgaccttactgaagaagctcatcaacagcatgacagacactaaaaaggccaaaaatcttcgggcagcttacgatgggtatgtggacggagtaaagggtaaagtgctgacccaggatgaattttacaagcagatccaaagtaacttggacgagtctgtcgaagcctccgagattcagacatatatcgatcaggacattttcatgcccaagcaacgcaccaaagctaatggcagcatacctcaccagctacagcagcaagaactggatcagatcattgagaaccagaaggagtactatccatggctcgccgaactgaatcccaaccctgacaaaaagagacagcaacttgcaaaatacaagctggacgagttggtgacgtttagggttccatactatgtggggccgatgatcactgccgaagctcagaagaaacagtcgggagcggagttcgcatggatgatccgtaaggaatctggcaatattacaccctggaactttgatcagaaagtcgaccggatggccaccgctaatcaattcataaagcgaatgactacaaccgatacgtacctcctgggtgaggacgtgttaccttcccagtcactgctatatcagagatttgaggtactcaacgaactgaataaaatcaggattgatcgcaagccaatcagtgttgagcttaaacagcaaattttcaacgacttgtttaagaagttcaaaaatgtgaccatcaagcatctgcaggattacctcgtcgcccaggggcaatatagcaaacggcccctgatagaaggacttgcagacgagaagagatttaactccggcctgtctacatacaatgatttctgcggcatctttggggccaaattggtggacgagaacgataggcaggctgacctcgaaaagattatcgagtggagcactattttcgaagataagaaaatctatcgcgccaagctgaacgacttagcatggctgaccgacgagcagaaagataagctagcgacaaaacgataccagggatggggtcggctctcaagtaagctgcttataggcttgcaaaattccgaacaccgtaacattatggacctgctctggatcgggaatgagaacttcatgcagattcaggctgatagcgactttgccaagctgatcaaagatgcaaatcagaacgccttacaaaataacgactctcaggatgtcataaatgacctgtacacttcacctcagaacaagaaagctatcagacagattcttttggtggttcacgatatccaaaatgccatgcatggacaggcaccaaccaagattcacgtggagttcgctaaaggcgaagagaggaacccccgccggagtgtacagagacaaaggcaggtcgaagccgcgtatgagaaggccagcaatgaactcgtgggtgctaacgttcgagaggagctgaaggacgcaatcacaaataaacgcgattttaaggaccggctattcctgtactttatgcaagggggcgtggacatgtattccggagaaccgataaacattgataacctctctagatacgacatcgatcatatcctgcctcaggccttcgtcaaagacgattcgcttaataacagggtgttgaccgacgctgagaagaatcgtcgcaaaagcgatgccgtacccaacgaactgtttggcgcaaagatgcgggtgacttgggagagaatgaaagaacaggggttaatttccaagggaaagtataggaatctcacgatgaacccagagaatatcaacaaatacacagagaatggtttcattaaccgacagctggttgaaacccggcaggtcataaaacttgcggtgaatatcctggccgacgagtataaggaaaacactcagattatctcagtgaaggctgatttgagtcaccaaatgcgcgaggactttgagctcctgaaaaatagagatgtcaacgactaccatcacgccttcgatgcatacctagctgcctttatgggcaattatctgctcaagaggtaccctaagctgcggtcttatttcgtttacggggactttaaaaagttcacccagaaagaaattaaacttcgaagattcaactttatctatgacttgaagcacgaggatcaggtgatagacaaggaaacaggagagatcctgtggaacaagaatgaagatattgcatacatccgccatttattcgcctataaaaagattctcatcagccacgaggtgtccgagaggcgtggcgctctgtacaaccagaccgtatacaaagcgtcagacgataaggccagcggtcaagggtctaaaaagctgatacccattaagtccgacaaaccaactgaaatctatggcggatacacaggccggacgcttgcatatatgaccatcgtcaaggtgactaaagggaagaaaattagttacaaggttgtgggagtccccacagctgtgctagccaagatggccggtgttagacagggcagccaggaggaacaggataaactctatggggtgctgaagcctcaatttacccatcagaaagagaataagaaaacaggagaaataactgagaccgtagacaagttcgatatcattgtcccaaaagtgaagtaccagcaattggtgaacgacaatggccagctgtttatgatcggttctgatacgttaccgtataacgctgagcagctcgtcctgtccaaggaatcagttcagaccattaataaccccgggatcaaagacgagggcagtgatgaagagagcgaaaataagaaacttgacaacgtgtacgacgagatagtactgtgtatgaataagtacttccctttgtatgataacaggggatttcgcaattcgatcacaaacggcaaaaataagttcctcaagctgccaattaaaaacatctacaagaatgggaaactaattaacgtgggaaagcgagaggtcatcaacagaatactgcaaggccttcacgcaaatgcctccgtgactgacctctctaacctgggtattaaaagcccctttgggttcttgcagaagggagcgggcctgtcattaagtggtgaagctcagctcatccaccagtccgccaccggcctgtttgagcatcgggttcaacttaataagatcaaatga

SEQ ID NO: 3194 - RNA, 4137 nt, synthetic construct
  misc_feature 1..4137: note = Cas9 variant
  source 1..4137: mol_type = other RNA
atgagcaacaagccctactccatcggcctggacattgggaccaattctgtgggatgggccgtcataacagatgactataaagttccttcaaagaaaatgaaggtgctcggtaacactgataaacacttcatcaagaagaatcttattggcgctctgttgtttgacgaggggacgaccgcagaaggaagaaggttaaaacggacagcccgccgacgttacactagaaggaagaaccggctgcgctatctacaggagatcttcagtgaagagattagcaaagtagattcctcgtttttccatagactcgacgattcttttctggtgccagaagacaagaggggctcaaaatacccgatcttcgcgacccttgctgaggagaaggaatatcacaagaattttcccacaatataccatctgcggaaacaattggccgatagcaaggagaaagcagacctccgcctgatctatctggccctcgctcacatgatgaagtaccgaggtcatttcttatacgaagagagttttgatattaaaaacaatgacatccagaagattttcaacgagtttatctccatatatgataataccttcgaagggtctagcctgtccgagcagaacgtccaggtggaagcaatttttactgacaaaatctcaaagagtgccaagagagagagggttcttaaattgttccctgacgaaaagagcacaggactgttctctgagtttctaaaactcattgtgggcaatcaagctgagttcaagaaacactttgatctggaagagaaggccccacttcagttctccaaggacacctacgatgaagacctggagaacttgctcggccagatcggggatggatttgcggacctgttcttagtcgccaaaaagctgtatgatgcaatcctcctttcaggtattctgacggtgactgaccccagcaccaaagctcctttgagtgcctctatgatagaacggtacgagaatcaccagaaggatctagcatccctgaaacaatttatcaagaacaatctcccagctgagaagtgcgtagaagttttcagcgaccagtcgaaagatggctatgccgggtacattgacggaaagacaactcaggaggcgttttataaatacatcaagaacctgctttctaaactggaaggcgcctactatttcttggacaagatagagcgtgaagattttctccgcaagcagagaaccttcgacaacggttccattccccatcaaatccatctgcaggagatgaatgcaatcttaaggcggcagggggagcactacccttttctgaaagaaaaccgagagaagattgagaaaatcctaacattccgcattccatatcacgtgggaccgctcgctagaggcaatagggatttcgcctggctgacccggaactcagacgaagctatacgcccctggaattttgaggaaatcgtcgatcaagccagtagcgcagaggacttcattaacaagatgacgaattacgatctttatttgcctgaagagaaagtgctgccaaagcactccctcctgtacgaaacttttgccgtgtataacgagcttacaaaagtcaagttcatcgctgagggcctgaccagataccagtttttggacaagaaacagaagaaagatatcttctacacatttttcaaggcggaagacaaaaggaaggttactgagaaggatattatacattatctccacaatgtggacgggtacgatggaatcgaactgaaaggtattgagaagcagtttaacgcatctttaagcacctatcatgacctgctaaaaatcattaaggacaaagagttcatggatgaccccaagaatgaagagatcctcgaaaacatagtacacacgctgaccatctttgaggatcgtgaaatgattaagcaacggcttgcccagtacgactcattgttcgatgagaaagtgatcaaggctctgacacgaagacattatactggctgggggaaactcagtgccaagctgattaatggaatctgtgacaaacagaccggcaagacaatattagattacctgattgacgatggtaagatcaacaggaattttatgcagcttattaacgacgatgggttgtccttcaaagaaatcatacaaaaggcacaggtcgtgggcaaaacttatgacgttaaacaggtggtccaggagctccctggaagcccagccatcaaaaagggcattctgcaatctgtgaagctagtagatgagctggttaaggtgatggggcacgctcccgaatcaatcgtcattgagatggcccgcgaaaaccagaccacagcaaagggtaaaaagaatagtcagcagcggtacaaaagaatcgaggacgcgataaagaacctcgctccgggactggacagcaccattcttaaagagcaccctactgataatatccaattgcagaacgacaggctgttcttatactatctccagaatggccgcgatatgtacacggggaagcccctggaaatcaaccaactttccaattatgacattgatcatatcattccacaggcctttataaaggacgattctctggacaaccgagtgttgacatcgagcaaagagaatcggggaaagtccgataacgtcccttcactcgaagtggttgagaaaatgaaggcattctggcagcagctgctagacagtaaactgatctctgaacgtaagtttaataacctcaccaaggccgagagaggcggtctggatgagcttgacaaagtggggttcattaagaggcaattggtagaaactcgccagatcaccaaacacgtcgctcagattctggacgcccggtttaataaggaggtgacagagaaaaacaagaagaatagaaacgttaaaatcataaccttaaagagcaacatggtgtccaatttcaggaaagaatttggcctctacaaggtccgagaaatcaacgattatcatcacgcacacgacgcttacctgaatgccgtggtagcgaaagccattcttaagaagtatcccaaactggagccagagttcgtgtacggagattaccagaagtatgacctaaaacgctacatctcaaagagcaaagatcccaaggaagttgagaaagctactgaaaagtactttttctattctaacctcctgaactttttcaaggaggaagtccattatgcagacggcacaattgtgaaacgggagaatatcgagtactccaaggatacgggggaaatagcctggaataaagagaaggacttcgctaccattaaaaaggtgttgagttttcctcaagtcaacatcgttaagaaaactgaggaacagacagtgggacagaatggtggcctgttcgataacaatatcgtgagcaaggagaaagtagtcgacgcctctaagttaattccaataaaatccgggctctcaccggaaaagtatggaggctacgcaagacccaccatcgcgtacagtgtgctggttacatataagcagaacaataaaattaagaacactatggtgggtatccctgtccttaccaaactggagtttgaaagggatccaaatttgtacctccgtaacctggggattaacaatgtgagccacgttatcaagctagtgaaacatacggtactggagttcaagcacaagtatggcacctaccgccggtttatagtctcgaaccaagaacttaaaagagccaatcagatcttcgtgacaactaagcagatgaaactcatttcccaatataccacactggacaagaacgagcatgattctttgctgaaaaataaccagcagttaatccagagcatttggaatcaatttctcgagttcatgctggctactgaccttgtgaacaagaaacagtacgacgaactgatcttgaccaataaccagacgatagaggaatgcaggaatattatgaaccgagtcatcacaaccctctcatttactaatatcaacgccggacagaagaagattatcttcgatgacacactgagtctacccataaaacggtggcaatttaccgattccgacaagatggttaaaaagattatcgagtctactctgattcaccagagcatcaccggcctttatgaaacacgcatagatctcaataaactgggggaggactga

SEQ ID NO: 3195 - RNA, 4137 nt, synthetic construct
  misc_feature 1..4137: note = Cas9 variant
  source 1..4137: mol_type = other RNA
atgaacaagccctacagcatcggcctggacattgggaccaattccgtgggatggtctataatcacagatgactataaagtccctgccaagaaaatgagagttctcggtaacactgataaggagtacattaaaaagaatcttatcggcgctctgttgttcgacgggggaaacacggcagccgataggcggttaaagcgcaccgcgcgacgtagatatacaaggcggcgcaataggattctgtacctacaggaaatctttgctgaggaaatgtcaaaagtggacgatagtttctttcacagactcgaggacagcttcctggtagaagaggataagcggggctccaaatatccaatatttgccactatgcaagaggaaaagtactatcatgagaaattcccgaccatctaccaccttcgcaaggaactggcagacaagaaagagaaggccgatttgcgactcatttacctggctctggcacatatcattaaatttagaggtcacttcctcatcgaggacgataggtttgacgtgcggaacacagacatacagaagcagtatcaggccttcttagaaatttttgataccactttcgagaataacgacctgctttctcaaaatgtcgatgtggaagctatcttgacagacaaaatttcgaagtcagccaaaaaggatcgtatcctggcgcgctaccccaaccaaaagagcaccgggatctttgcagagttcctaaaactcattgttggaaatcaggccgacttcaagaaacattttaacctggaagataagacgcctcttcagttcgctaaagacagttatgatgaggacctggagaatttgctcggccagataggcgatgaatttgccgacctgttctccgcagctaagaagttatacgactctgtgctgctcagcgggatccttactgtcattgatctgtccaccaaagccccattgtcagcgagtatgatccagagatatgacgagcaccacgaagatctaaagcatctgaaacagtttgtgaaggccagcctccccgagaactacagggaagtattcgcagactcttccaaagatggatatgctggttacatagagggcaagacatcacaggaggccttttacaagtatctgcttaaactgttgactaagcaagaagggagcgagtacctcctggaaaagattaagaatgaggacttcttacggaaacagcgaacctttgataacggaagtatccctcaccaggttcatctgacagaactacgcgctatcattagaaggcaatctgagtattacccattcctcaaggagaacctggaccggatcgaaaagattcttacctttcgcataccctattacgtgggccctttggccagagagaaatccgatttcgcatggatgacgaggaagactgacgatagcatccgtccatggaattttgaagacctggtcgataaagagaagtcggccgaggctttcattcaccggatgacaaacaatgacctctatctgccggaagagaaagtgcttcccaagcactctctgatctacgaaaaattcaccgtgtacaacgagttgactaaggtccgatttctcgcggaaggtttcaaggactttcagttcctgaatagaaaacagaaggagacaatctttaactccttattcaaagagaagaggaaagttaccgaaaaggatattatatcatttctgaataaggtggacgggtatgagggaatcgcaattaaaggcatcgaaaagcagttcaacgccagtctaagcacgtaccatgatctcaaaaagattctgggcaaagactttcttgataataccgacaacgagttgatcctggaagatataatccaaacactcactctgttcgaggaccgcgagatgattaagaagcggttagatatctataaagactttttcaccgaatcccagctgaagaaactttacagaaggcactatacagggtggggacgcttgtctgctaagctcattaatggtatccgaaacaaagagaatcagaagactatactggattacctaattgacgatggcagcgccaaccggaattttatgcagctgatcaaggacgcagggctctcattcaaacctattatcgacaaggcccgtaccggaagtcattccgataacctgaaagaagtagtgggcgagcttgctggtagcccagccataaagaaagggatcttgcaatctctgaagattgtcgacgaattagtgaaagttatgggctatgagcccgagcagatcgtggtcgaaatggcaagagagaaccagacaaccgcgaagggactctcaaggagtcgccagcggctgactacgcttagagaaagcctgggcaatttgaagtccaacattctcgaggagaaaaagcctaaatacgtgaaggatcaagtagaaaatcaccatctgtctgacgataggctattcctgtactatctccagaacgggaaagacatgtacacagatgacgagctggatatcgacaatctttcgcagtatgatatagaccacattatcccacaggcttttatcaaggacgatagcattgacaaccgagttttggtgtcctcagccaagaatcgcggaaaaagtgatgacgtcccctctatcgaaattgtgaaggcacggaaaatgttctggaagaacctgttagatgccaaactcatgagccaaagaaagtacgacaatctgaccaaggctgagaggggtggccttacttccgatgacaaagcccgttttatacagcgccagctggtcgaaacccggcaaatcacaaagcacgtggcaagaattttggatgagaggttcaacaatgagctcgactcaaaagggcgacggatccgcaaggttaaaattgtgaccctgaaaagcaacttggtatctaattttagaaaggagttcggattttataaaatcagggaagtcaacaattaccatcacgctcatgatgcctatctgaacgcggtggttgccaaggctatattaactaaatacccgcagctcgaacctgagttcgtgtacggcctgtatcggcgaaagaaactttccaagatcgtcagagaagacaaggaggagaaatacagtgaagcaacacgcaagatgtttttctatagcaacctgatgaatatgtttaaaagggtggtacgtttggccgatggttctattgtggttcggcccgtcatcgagacggggagatacatgggcaagaccgcttgggacaaaaagaaacacttcgccactgtgaggaaggtgctctcctatccacagaacaatattgtcaagaaaacagaaatccagaccggaggcttctcaaaggagagtatactggcacacgggaacagcgacaaactaattcctcgcaagacaaaagatatctacctggaccccaagaagtatggaggttttgattcgccaatcgttgcgtactccgtgcttgtggtagccgacattaaaaagggcaaagctcaaaagctcaaaactgtcaccgaactgttggggataacgatcatggagcgatctagattcgagaagaataccagcgcctttctggaatcaaagggatacttaaacattcgggatgacaaactcatgatcctgcccaagtatagtcttttcgagctggaaaatggcaggcgccgtttgctcgcatccgctggtgagctgcagaaagggaacgagctagccctgcctacacagtttatgaagttcctttacctcgcatctagatataatgaaagcaaaggcaagccagaggaaattgagaagaaacaggaatttgtgaaccaacatgtttcctacttcgatgacatcctgcagttgataaatgatttttcaaaccgggtgatcttagccgacgctaatctggagaagattaacaaactctatcaggataataaggagaacatcccggtcgacgaactggcgaacaatattatcaaccttttcacttttaccagcctgggagcccccgcagctttcaaatttttcgataagatagtggacaggaaacgctacacaagtactaaggaggttctaaattctaccctaattcaccagtccatcacgggcctgtatgaaacacgaatcgacctcgggaagctgggagagggctga

SEQ ID NO: 3196 - RNA, 4137 nt, synthetic construct
  misc_feature 1..4137: note = Cas9 variant
  source 1..4137: mol_type = other RNA
atgaccaacgagaagtacagcatcggcctggacattgggacatcctctataggattcgccgtggtcaatgataacaatagagttatcagggtgaaaggtaagaacgctattggcgtacggctctttgacgaagggaaagcagccgcggatcgccgatcattccgtactacgagaaggcggcttagtcgcagaaggtggcggctgaagttgttacgcgagatctttgacgcttatattacccccgtggatgaagccttctttatccgactgaaagagagcaatctatcccctaaggactctaagaaacagtactcgggagatatactcttcaacgacagatcagataaggacttttatgaaaaatacccaacaatctatcacctgaggaatgcacttatgactgagcatcggaagttcgatgtccgtgagatttacctggccatccaccatattatgaaatttcgcggccacttcttgaacgctaccccggcaaataactttaaggtgggtagactcaatctggaagagaagttcgaagaactgaacgacatctatcaaagggtttttcccgatgagagcatagagttccggacagacaatctcgagcagattaaagaagtgttactggacaacaagcgaagtcgcgccgatagacagaggacccttgtctccgacatctaccagtctagcgaggataaagacattgaaaagcggaataaagctgtggccactgagatcttgaaggcgtccctggggaacaaagcaaagctaaacgtaatcacaaatgttgaggtggataaggaagccgctaaagagtggtcaattaccttcgacagtgaaagcatagatgacgatctcgccaagatcgagggacaaatgacggacgatggccatgaaattatcgaggtcctgcgctctctttactccggcataactctgtcagcaattgtgcctgagaaccacaccttgagccagagtatggtggctaaatatgacctccacaaggaccatctgaaattatttaagaagctgatcaatgggatgacagatactaaaaaggccaaaaacctcagagcggcctacgacggatatatcgatggtgtcaagggcaaagttcttccacaggaagacttctacaaacaggtgcaagtaaatctggatgactctgcagaggctaacgaaattcagacctatatcgatcaggacatttttatgcccaagcagaggacaaaagccaatgggtccatacctcaccaattgcagcagcaagagctagatcagatcattgaaaaccagaaggcttactatccatggctggccgagctcaatcccaaccctgacaaaaagcgtcagcaactggcaaaatacaaacttgatgagctggtgaccttccgggtcccatactatgtgggaccgatgatcacggccaaggaccagaaaaatcagagcggcgctgaatttgcgtggatgatccgaaaggagcccggtaacattactccttggaatttcgatcagaaagttgacagaatggcaacagccaaccaatttataaagaggatgaccactacagacacctacttgctcggggaagatgtgctgccagctcagtcgttactgtatcagaaattcgaggtcctaaatgagctcaacaagatccgcattgaccataaacccatctctattgaacagaagcaacagatctttaacgatctgttcaagcagtttaaaaatgtgacgataaagcaccttcaggactacttggtatcccaaggacagtattcaaaacggcctctgatcgagggcctcgccgatgaaaagagattcaacagtagcctgtccacctactctgacctttgcggcatttttggggcaaaactggttgaggaaaatgataggcaggaggacttggagaagatcattgaatggagcacaatcttcgaggataagaaaatatatcgcgccaagctcaacgacctgacttggttaaccgatgaccaaaaagaaaagctggctacaaaacgataccagggatggggtcggctatcacgtaagctcctggtgggccttaagaatagtgagcacagaaacattatggatatcttgtggattactaatgaaaacttcatgcagatccaggccgagccagactttgcaaaactggtcaccgacgcgaataaggggatgctcgagaaaacagattcccaagacgtgataaacgatctgtacaccagcccccagaataagaaagctatcaggcagattttactggtcgtgcatgacatccagaacgccatgcacggacaagcaccggccaagattcatgttgagttcgctcgcggcgaagaacggaatcctagaaggtctgtgcagcgacagcgccaggtagaggccgcatatgaaaaggtctcaaacgagcttgtgagtgctaaagttcggcaagagtttaaggaagccatcaataacaaaagagatttcaaggacaggttgtttctctacttcatgcagggtgggatagatatttatactggcaaacagctgaacatcgaccaactaagctcctaccagatcgatcacattctgccccaggcgtttgtgaaggacgattctctcacgaatcgtgtcctgacaaacgagaatcaggtgaaagccgactcggtaccaatcgacattttcggaaagaagatgcttagcgtgtggggccgcatgaaagatcaagggttgatatccaagggaaaatatcggaacctgaccatgaatcctgaaaacatctcagctcatactgagaatggttttattaacagacagttagttgagaccaggcaggtcatcaagctcgcagtgaatattctggccgacgaatacggcgatagtacacagatcatatctgtgaaagctgaccttagccaccaaatgcgagaggatttcgaactgttgaagaaccgggacgtcaatgattatcaccatgcctttgacgcatacctcgcggccttcatcgggaactacctgctaaagcgctatcccaaactggagtcctactttgtttatggagatttcaagaaattcacccagaaggaaactaaaatgagaaggtttaatttcatttacgacctcaagcactgtgatcaggtggtgaacaaggagacaggcgagatcctgtggacgaaagacgaagatattaagtatatccggcattcatttgcttacaaaaagatacttgtaagccacgaggtccgagaaaagagaggtgccttgtataatcagaccatttacaaggcaaaggacgacaaagggtctggccaaggatccaagaaactgatccgcatcaaggatgacaaagagactaagatttacggcgggtatagtggaaagagcttagcttacatgacaatagtgcagatcaccaaaaagaacaaagtttcttatagggtgattggtatcccaacactcgccctggcacgtcttaacaagctggaaaatgattccactgagaacaatggcgagctatacaaaattatcaagccccagttcacccactataaagtcgacaagaagaacggggaaataatcgagacgaccgatgactttaaaattgtggtttcaaaggtgcggttccagcaactcatcgatgacgccggacagtttttcatgctggctagtgatacatacaaaaataacgcgcagcaattggtaattagcaataacgccctgaaggcaatcaataacactaatataaccgactgccctagagatgacttagaaaggctcgataacctgcgccttgactcggcttttgacgagattgtcaaaaagatggataagtatttctccgcctacgacgccaataactttcgagaaaagatcagaaattctaacctgatcttctaccagttgccagtggaggatcagtgggagaataacaagattacagaactcggcaaacggactgtgctgaccaggatcctacagggtctgcatgctaacgcaacgacaaccgacatgagcatattcaagattaaaactccgtttgggcaacttcgccagcgttcaggcatcagtctctccgagaatgcccagctgatttatcagtctcccacaggattgttcgaaagacgggtccaactgaacaagatcaagtga

SEQ ID NO: 3197 - RNA, 4137 nt, synthetic construct
  misc_feature 1..4137: note = Cas9 variant
  source 1..4137: mol_type = other RNA
atgaccaacgagaagtacagcatcggcctggacattgggacatcctctataggattcgccgtggtcaatgataacaatagagttatcagggtgaaaggtaagaacgctattggcgtacggctctttgacgaagggaaagcagccgcggatcgccgatcattccgtactacgagaaggcggcttagtcgcagaaggtggcggctgaagttgttacgcgagatctttgacgcttatattacccccgtggatgaagccttctttatccgactgaaagagagcaatctatcccctaaggactctaagaaacagtactcgggagatatactcttcaacgacagatcagataaggacttttatgaaaaatacccaacaatctatcacctgaggaatgcacttatgactgagcatcggaagttcgatgtccgtgagatttacctggccatccaccatattatgaaatttcgcggccacttcttgaacgctaccccggcaaataactttaaggtgggtagactcaatctggaagagaagttcgaagaactgaacgacatctatcaaagggtttttcccgatgagagcatagagttccggacagacaatctcgagcagattaaagaagtgttactggacaacaagcgaagtcgcgccgatagacagaggacccttgtctccgacatctaccagtctagcgaggataaagacattgaaaagcggaataaagctgtggccactgagatcttgaaggcgtccctggggaacaaagcaaagctaaacgtaatcacaaatgttgaggtggataaggaagccgctaaagagtggtcaattaccttcgacagtgaaagcatagatgacgatctcgccaagatcgagggacaaatgacggacgatggccatgaaattatcgaggtcctgcgctctctttactccggcataactctgtcagcaattgtgcctgagaaccacaccttgagccagagtatggtggctaaatatgacctccacaaggaccatctgaaattatttaagaagctgatcaatgggatgacagatactaaaaaggccaaaaacctcagagcggcctacgacggatatatcgatggtgtcaagggcaaagttcttccacaggaagacttctacaaacaggtgcaagtaaatctggatgactctgcagaggctaacgaaattcagacctatatcgatcaggacatttttatgcccaagcagaggacaaaagccaatgggtccatacctcaccaattgcagcagcaagagctagatcagatcattgaaaaccagaaggcttactatccatggctggccgagctcaatcccaaccctgacaaaaagcgtcagcaactggcaaaatacaaacttgatgagctggtgaccttccgggtcccatactatgtgggaccgatgatcacggccaaggaccagaaaaatcagagcggcgctgaatttgcgtggatgatccgaaaggagcccggtaacattactccttggaatttcgatcagaaagttgacagaatggcaacagccaaccaatttataaagaggatgaccactacagacacctacttgctcggggaagatgtgctgccagctcagtcgttactgtatcagaaattcgaggtcctaaatgagctcaacaagatccgcattgaccataaacccatctctattgaacagaagcaacagatctttaacgatctgttcaagcagtttaaaaatgtgacgataaagcaccttcaggactacttggtatcccaaggacagtattcaaaacggcctctgatcgagggcctcgccgatgaaaagagattcaacagtagcctgtccacctactctgacctttgcggcatttttggggcaaaactggttgaggaaaatgataggcaggaggacttggagaagatcattgaatggagcacaatcttcgaggataagaaaatatatcgcgccaagctcaacgacctgacttggttaaccgatgaccaaaaagaaaagctggctacaaaacgataccagggatggggtcggctatcacgtaagctcctggtgggccttaagaatagtgagcacagaaacattatggatatcttgtggattactaatgaaaacttcatgcagatccaggccgagccagactttgcaaaactggtcaccgacgcgaataaggggatgctcgagaaaacagattcccaagacgtgataaacgatctgtacaccagcccccagaataagaaagctatcaggcagattttactggtcgtgcatgacatccagaacgccatgcacggacaagcaccggccaagattcatgttgagttcgctcgcggcgaagaacggaatcctagaaggtctgtgcagcgacagcgccaggtagaggccgcatatgaaaaggtctcaaacgagcttgtgagtgctaaagttcggcaagagtttaaggaagccatcaataacaaaagagatttcaaggacaggttgtttctctacttcatgcagggtgggatagatatttatactggcaaacagctgaacatcgaccaactaagctcctaccagatcgatcacattctgccccaggcgtttgtgaaggacgattctctcacgaatcgtgtcctgacaaacgagaatcaggtgaaagccgactcggtaccaatcgacattttcggaaagaagatgcttagcgtgtggggccgcatgaaagatcaagggttgatatccaagggaaaatatcggaacctgaccatgaatcctgaaaacatctcagctcatactgagaatggttttattaacagacagttagttgagaccaggcaggtcatcaagctcgcagtgaatattctggccgacgaatacggcgatagtacacagatcatatctgtgaaagctgaccttagccaccaaatgcgagaggatttcgaactgttgaagaaccgggacgtcaatgattatcaccatgcctttgacgcatacctcgcggccttcatcgggaactacctgctaaagcgctatcccaaactggagtcctactttgtttatggagatttcaagaaattcacccagaaggaaactaaaatgagaaggtttaatttcatttacgacctcaagcactgtgatcaggtggtgaacaaggagacaggcgagatcctgtggacgaaagacgaagatattaagtatatccggcatctttttgcttacaaaaagatattggtatcacacgaggtccgagaaaagagaggtgccctgtataatcagaccatttacaaggcaaaggacgacaaagggagcggccaaggatctaagaaattaatccgcatcaaggatgacaaagagactaagatttacggcgggtattccggaaagagtctcgcttacatgacaatagtgcagatcaccaaaaagaacaaagttagctatagggtgattggtatcccaacactggcccttgcacgtctgaacaagctagaaaatgattctactgagaacaatggcgagctctacaaaattatcaagccccagttcacccactataaagtcgacaagaagaacggggaaataatcgagacgaccgatgactttaaaattgtggtttccaaggtgcggttccagcaactgatcgatgacgccggacagtttttcatgttggcttcagatacatacaaaaataacgcgcagcaactggtaattagtaataacgccttaaaggcaatcaataacactaatataaccgactgccctagagatgacctcgaaaggctggataaccttcgcctggacagcgcttttgacgagattgtcaaaaagatggataagtatttctcggcctacgacgccaataactttcgagaaaagatcagaaattccaacttgatcttctaccagctcccagtggaggatcagtgggagaataacaagattacagaactgggcaaacggactgtgctaaccaggatcctgcagggtcttcatgctaacgcaacgacaaccgacatgtctatattcaagattaaaactccgtttgggcaactccgccagcgtagcggcatctcactgagtgagaatgcccagttgatttatcagtcccccacaggactgttcgaaagacgggtccaattaaacaagatcaagtga

SEQ ID NO: 3198 - RNA, 4140 nt, synthetic construct
  misc_feature 1..4140: note = Cas9 variant
  source 1..4140: mol_type = other RNA
atgaagcagatcctgggcctcgaccttgggaccacaagcattggatgggccctggtgagagaggctgaaaacaaagatgagcaatcctctatagtcaggatcggtgttcgggtgaatcccttgacttcagacgaacagaagaacttcgagcagggcaaaagtattacgaccaatgcagatcgcacattaaagcgaagcatgcgtagaaacctgcagaggtacaaactacggcgcgaccacctcaaggattgcctgcaaaagaatgggatcattactgacaaagccgtactttccgaaaacggaaattataccacatttcagacctactatctgagagcgaaggctgtgaacgagaaaatctctttggaggaatttgccagggtcctcctgatgctgaataagaaacggggctacaagtcgtcacgcaagatgaaaagcgcagatgagggtcagctcatagacgggatgagtgtggccaagcgattatataacgataatatcactcctggacagtacgttctgtcccttttggaagagggcagaaaatatattccagacttttacaggtctgatctgctagacgagctcgataagatctggacattccaacagtgtttttacccggaaattctgacccccgagtgccggaaacttatcgctggcaaggggaaacaggcaacggccaagatattcctgggaaagtataaaatttacactgctgacaacaagagcaaagacaagcgtttgcaggcctatcaatggcgcgtggaagcgctctccggtcagctgcctatcgaggtcgtggcatttgtagtttgtgaaattaatggcgccatccaggcttcaagtgggtacttaggagccatcagcgatagatctaaagagctgtatttcgagggcctcaccgtgggtcaataccttgtcaagcagctggaaaagaacccagacacatccttgaaaaataaggtgttttataggcaggattacctaaacgagttcgagaaaatttgggagaagcaggcagaataccatactgagctgactccccaactcaaaaaggaggtgcgggacataatcattttctatcagcgaacactgaagtcacagaaagggcttgtcggattctgcgaatttgagagccgccagatcgaagttatgatagatggcaagctgaaaaagaaaaccgtgggctgtagagtatgccctaagagttctccattgttccaagagtacaagatttggcacaacctcaataacctgaaaatcgtggaaaaggagttagggaaatccaggttcctgaatcaggacgagaaggaaagcctatttcaggagctcaacatcaaagaaaagctgtcgaaaacggatattcttaagttgctgtgtctcaaggctaaagagttcgacctgaattttgagaaggtcgaaggaaaccggactcaggccgagcttttccgcgcgtatcaagccatcattgaaatgtctggtaatggcgattacgacttttccaaaatgacatcaagtgagatacaggataccgtgactggggttttcagaggactgggctataacacagacatcttgagctttgacgcagaaaaggaggagaaaaccttcgataagcagcccatgtacctcctgtggcatttactgtattcctacgaaggtgactctagcgatacggggaataaggctctaattaccaaaatcaagaaactctgcggctttgagtcagaagagtacgccaggatcctgacagacgtgactttccagagtgaatatggaaacctttccaccaaggctattcgtcggatattgccttttatgaaaaagggcagcgagtactctgaggcctgtcgacacgcagggtatagacattcagaaaggagtctgacaaaggaggaactcgataaaaaggtctacaaagaccacctggagttactgccacgcaatagccttcggaacccggtggtagaaaagatcttgaatcaaatgattcacgttgtgaacactgtcgtggatacctatggaaaacccgacgagatcagaattgagctcgccagggaactgaagaagtccgctaaagagcgcgatgaaatgacagcgtctatcaataagaccgcagccgagcataaaaagtactgcgaggtcctacagaaagagttcggttttactcacgtgtcgcgaaacgacataatccggtataagctgtacctcgaactggaaaacaatggctacaaaacgctttatagcgatacatacattcctcgtgagaagttgttctccaaggagttcgacatcgaacatattatcccacagtcaaaactgtttgatgacagtttctctaacaagaccttagagtgtagaagcgttaatatagaaaaatccaacgacactgcttatgattacgtgctcaataagtatggggagcaaggcattctggactacaaaaacaggatcgaaaatctttataaggattcaaagattagccgcaccaaataccagaagctgatgatgaaaaactctgacatctccggaaattttatagagcgggaattgagagatagtcagtacatcgccaagaaagcaagggagattctcgaggaactggtaaagttcgtcgtgcccacaaccggtagcgttactgcccgactacgcgaggactggcagctggtggatgtcatgcaagaactcaactggaagaaatatgacaagctggggcttacagatgtgcggtacgacaaagatggcagagagatcaggtatattaaggactggtctaaacgtaatgatcaccgccaccatgctatggacgccttgacgatcgcatttaccaagcggtccataattcagtacctgaacaatttaaacgcgaagtcagacaaaagtggaagcatctatgctatcgaacagaaggaactcttcagagataaaaggggcaagctgaaatttattcctccaatgccctgcaatatcttccgagccgaggcaaagcggcaccttgaaaacgtactggtgtcggttaaggccaaaaacaaggtcgtgactccgaatattaaccgctccaaagggaagaatggaataaacaaaaagatccagctaacacctagaggtcaactccataatgagaccatttacggctctatgaaaaggtatgaaacaaagtgggagaagatcgggagcggatttgacgagcggcagattgctaaagtggccaacaagaaattccgagaagcactgttgtcaagactggctgagtttggcaatgatccccagaaggccttcactggtaaaaacagtttagaaaagaatccactctacgtcgacgagctgcacacccagaaggttcctgaaaaagtgaagatcgtgacgcttgagaacctgtacaccatacgcaaagagatcacacccgatttgaagattgacaaagtagtcgatgcgggggtgaggcgtgttctccaagaacggctggacgagtttgatgacgattccaagaaggccttctctaatctagacgaaaacccaatctggctgaatggcaaaaagatgaaaagagtgactattatgggagtcagcaacgctgtgccccttcatgacaagaaagattataagggcaatctcgttttcgactccaaggggaggaaacagcctgtggattttgtaaacaccggatcaaaccaccacgtcgcaatctaccgcgacgagagcggcgaactgcaggatatagtggtgagtttctatgaggccacaactcgatctaccttgggtattccagtcatcgacaaggagtacaaaaaggctgaagggtggaattttctgttctccatgaaacaaaacgagtattttgttttcccgaatgaagagacgggatttaaccccaaggaaatcgatttaatgaatcctgacaactacacaaccattagcccaaatctctatagagtgcagaaattctcgaagtgcatgtacggcaactcatctgtacgggagtacgtgtttaggcatcacctggagaccagtgtcaatgattccaagggtcttaaaaacatagcctataagaatgtgaaaagcctggtttacttggaaggcatcgtgaaggtccgcattaaccatatcgggcagattgtgtctgttggagagtattga

SEQ ID NO: 3199 - RNA, 4140 nt, synthetic construct
  misc_feature 1..4140: note = Cas9 variant
  source 1..4140: mol_type = other RNA
atgagaatcgacaacggcctggaggaactcaaggtgaataacaggatttacaatatagggcttgatatcggaaccagctccgtcggtttcgccgttacagacgctcaggataaactggtgcgggtaaagggcaaaactgcaattggggtgcgcttgtttgaggaaggacacacggccgcggagcgacgtggcttcagaaccacaaggcggcgcttatctagaaggaagtggcggatcaacctgctaaatcaaatttttgaaccctatatctcagagatagaccctactttctttgctcgcctcaaaaacagtagcctggccggtaaggataagaaattcgaggggtcccttctgtttccagaccgaaccgattaccagttctataaggacaatccgacaatgtaccatttgagaaaacacctcatggaaaaggataggcagtttgacctgcgggagatctatctggcaatgcatcacattatcaaataccgtggaaacttcctcaataccactcccatgaaccattttaagaatgaagagattgatttctctgccttattttcgcgcctgaacgagctttatcaggaaatcgacgatgagaatatattcgaattgaacattgagaatgtcgacgaaatcaagaaaattctgctaaaccacgacctcttcaagatggagaaacaaaaacaggtggctaaactgcttaacgttgatacagacgataagcagctgaaaaaggagaataccgcattggcctcaaactttagcaaggctatcctcggctacaaattcaatctggccttagtgacgaagatccctgaccaggataaaaaggaatggactattagtctgggcgacgaggattttgacgatagactcgacaacgtcccagtggcgcttaccgaatcccaactggaggtagttgaagtgttgcactctatattcaatagcatctccctaaacgagattgtcgagaatggggaaacactgtcaagtgcaatggtgaggaaatacaacgatcataagcacgacctcaagctgcttaaaaatgtgatgactaccctggaggaccggaagaaagccaagaaaatccagggaatatataacgtctttgttggtaaggatacagacttgattagcgataaggacaaaaataagtacaaagataaggacgagttctataaagaaatccagaagaacctcgataattcttccgacgctgaagagatcattaagcgaatcaaacaggatcaatttctgcccaagcagcgcacctcaaagaacggcgtgattcctcatcagttacaccaaagagagctggacctaataatcgaaaatcaggccaagtactatccattcctcaaagaggcaaaccccaacaagaaaaggctgaagcaggctaagtacaaacttgatgaattgattgcctttaagatcccttattacatcgggccaacgagcggagcggagaatagtgacttctcttggctgaaacggaagaaagatggccagattactccgtggaactttgacgagaaggtagaccgcatagaatccgccaatagattcatcaggcgtatgacaaccaaggatacttacctcctggcagaggacgtgcttcccctggaatcattgatttatgagaaatactcggtcctcaacgaactgaataacgtgcggatcaatcgacaaaagttatctgttaacgataaacaggacatttataatgagctgtttaagaactccaaaacagtgaccctaaagcagctccagaagtacttcgaggtcacgaaaaagctgaaaaccgtggtagttgaaggtcttgctgatcctaagaaattcttgtcaaatctggggacatatcacgactttaagctcatcttcggagatatagtggacgatccagagtaccaaactgacctggaaaacatcattgagtggagtaccatctttgaagatagaggcattttcaatagcaagttaaacgagatcacatggctgactgacgagcagaggaaaaaggtcctttccaaacgctatcagggctgggggcggttttctaagaaattgctcgtgggactgaagaatagccagggtaactcaatactagatgaactgtggaacaccaatctcaacttcatgcaactgcagagtcaggacgactttgccgagcttattcatgctgaaaatgccaaacagttcaaggcaaacgatcccgacaatccttggaacggcatcgatgccattttgaatgacgcttacacatccccacaaaacaagaaagcgatcagacaggtcgtgaaggttgtgcaggatatagagaaagcaatggggaataagccccagaaaatcgccattgaatttaccaggagcgctgacaagaacccgcgccgaactgattctcggatcaagcgtctgtcagacatttacaaagaggccgcagagaaggtagtcggagaaagtttaaaactcgagctgaatgaatatcttacgagcaagaaaaagatgacagataagatgtacctgtatttcacccaattgggcactgacatctacaccggtaaaaagatagatattgaccagctcaacaattatgacatcgatcacgtgctgcctcagtcctttctaaaagacgattctctggacaacagagttctcacaaataggtcggataacagcgagaagtccgacaccgtgcccctgcataaattcggggccaagatgggcaacttttggcgccaacttgctgatgagggattgatcactaagcggaaatacaagaatctgacaacggacccagccaccattgataaatatactatccagggcttcattagaaggcagttagtcgaaacatcacaggtgataaagctcaccgcaaacatccttgggggactgtaccctgaggaaacagagattctggaaatccccgcgaaactaaatcaccaattccgagacatgtttgatctcgtaaaggtgcgcgaggttaacgactaccatcacgctttcgatgcctatattactgtctttgtgggtaatttcctgtaccggagatatccaaagttgaggagttactttgtgtatggcgacttcaaaaagctgaacaaaaccgacgatgacatccgtaagtttaatttcttaaacctctttaataaagataaggtcgaggacaacgaaacggatgagatactgtggtctaaagcagaaagcatccgcgacattaagaatatctacaactataagttcatgcttgtttcccgggaggtgtacaccagacacggggccatgtttaatcagacaatttaccccgctagcaaaaacgatagcaagaaactgatccctataaagaaaggaaaggacactgccatttatggcggttactctgggaataccgatgcatatatggctatcgtggccgtagaagacaagaaaggcgagaagttcaaagtcgtgggagttccaacaagggcggtgtcccgattggagcagctcgccgctgatgaccatgatcagtacctgactgcactacacgacgtcctgaagccgaacttcaccaaaatcaagacgaatcggaagacaaaagccaaggaagaggtgaccactccctttcgcattcttgttggcaaagtggggtatagacaactcatacaggacggacaggtaaagatgatgctgggtagtagcgcttacaaatataacgccaagcaattggtcctgtctgaaaagtccttaaaagtgatcaagaacaataaaaagtacaaccctgatgacgagaatcaggatctcattgacgtgtacgatgaaatcctgggcgtcgttaacagggcattcaatctttatgacacaaacgggtttcggaaaaagctgaatgataaccgagtgaaattcgtagagttgccaattaataacatctttgacggaaccaagctcgtgcagatgggcaagagagcggtcctgactcagatactaaatggtctgcatgccaacgctgcccttggggatctcaaagcactgggcatctcaacccccttcggaaagatgcaaagtaaaagcggcattcctttgtcgatggacgcttccttagtgtaccagtctccaacagggctgtttgagcgcaagctcaatctgagcgatctttga

SEQ ID NO: 3200 - RNA, 4140 nt, synthetic construct
  misc_feature 1..4140: note = Cas9 variant
  source 1..4140: mol_type = other RNA
atgaccaagaaaaactacagcatcggcctggacattgggacaaattccgtgggatgggccgtcataactgatgactataaggttcccgctaaaaagatgaaagtgctcggtaacacggataagaagtacatcaaaaagaatcttctgggcgcattgttattcgactctggggagaccgccgaagcgacaagactgaaaaggactgctcggcgccgatatacccgtagaaagaacaggctacggtacctccaggagatttttgccgatgaaatggcaaaagtagacgagtcattctttcaacgcctggatgaaagtttccttagatgggacgatgacaataagaagctgggaaggtatcctatctttggcaacaaagccgatgtggtcaagtaccaccaggagttcccaacaatttatcatttgcggaaacacctcgctgacagctccgagaaggcagatctgcgcctggtgtacctcgccttagctcatatgatcaaatttcgaggtcacttcctgatagaaggggagcttaatgccgaaaacaccgacgttcagaagatcttttctgacttcgtgagagtctacgataggacttttgacgattcgcatttgtcagagattacagtggacgcggcaagcatcctgaccgagaaaattagtaagtcccggcgtctagaaaatctcatcaagtattacccgacggagaaaaagaacactctgttcggaaatcttatagccctggctttgggcctccagcccaactttaaaatgaatttcaagctgtctgaagatgccaaattacaattcagcaaggactcctataacgaggatctggaggaactccttggcaagattggggacgattacgcagacctgtttacctcagctaaaaatttgtatgatgccatcctactgagtggaattttaacagtagacgacaacagcactaaggcgcctctgtctgcctccatgatcaaacgctacgcagagcaccacgaagatcttgagaagctgaaagagttcatcaaggctaacaagtcagaattgtatcatgacatttttaaagatgaaaccaagaatggttacgccggctacatagagaacggggttaaacaggacgagttctataagtacctcaaaaatacactgagcaagatcgctggaagtgattattttctcgacaagattgaaagagaggatttcctgaggaaacagcggacctttgacaacggctctatcccacaccagatacatctacaagaaatgcacgccattctccgacgccagggtgattactatcccttcctgaaggagaatcaggacagaatcgagaaaatccttacgtttaggattccttactatgtggggccattggcacggaaggattcccgcttcagctgggccgaataccactcggacgagaaaatcactccctggaactttgataaggtcattgacaaagaaaagtctgctgagaagttcataacaagaatgaccctgaatgacctctacctgcctgaagagaaagtgcttccaaagcattcccacgtgtatgagacttacgcggtctataacgaactgacaaaaatcaagtacgttaatgagcagggaaaagattcatttttcgacagtaacatgaagcaagaaattttcgatcatgtgtttaaggagaataggaaagtaaccaaggaaaaattgctcaactatctgaataaggagttcccggagtaccgtatcaaagacttaatcggcctggataaggaaaacaagagctttaatgcatccctaggcacgtatcacgacctcaaaaagattctggataaagccttccttgacgataaggtgaacgaggaagtcatagaggacatcattaaaaccttgacactgtttgaagataaggacatgatccatgagcggctccagaagtactctgatattttcactgctgaccagctgaaaaagttagagcgaagacactacaccgggtggggaaggctgagctataaacttatcaacggtatacgcaataaggaaaacaataaaacaatcttggactacctcattgatgacggctcagccaaccggaattttatgcaactgatcaacgatgacactctacccttcaagcagattatccagaaaagtcaggtggttggggatgtggacgatatagaggcagtcgtgcacgacctgcctggatccccagccattaagaagggcatcctccaaagcgtaaaaattgttgatgaactggtgaaggtcatgggtgacaatcccgataacatcgtgatagagatggctagagaaaatcagaccacaaacagggggcgctctcagtcacagcaacgacttaaaaagttgcagaatagtctgaaagagttaggcagcaacatcctcaatgaggaaaagccttcctatattgaggacaaggtcgaaaactctcatctgcagaatgaccagctttttctgtactatatccaaaacggaaaagatatgtacaccggcgacgagttggatattgaccacctctcggattatgacatcgatcatataattccacaggccttcatcaaggacgatagcatcgacaaccgggtgctgacttcctcagcgaaaaatcgtgggaagagtgatgacgttccctctctagatattgtgagagcaaggaaagctgagtgggtacgcctgtacaagagcggactcatctccaagcggaaatttgacaacctgacgaaggccgaaagaggtggccttacagaggcagacaaagccgggttcattaagaggcagttggtcgaaacccgacagataactaaacacgtggctcaaatcctggatgcccgctttaataccgagtcagacgaaaacgataaggttattcgggacgtgaaggtcatcacattaaaaagcaatctcgtgtctcagttcagaaaggatttcgagttttacaaagtaagggagattaacgactatcaccatgcacacgatgcttacctgaatgccgtggttggaaccgcgcttctgaagaaatatccgaagctagcctccgagttcgtctacggcgaatataagaaatacgacgtgcataagctcatcgctaaaagtagcgatgaccactctgaaatgggtaaggcaactgccaaatactttttctattccaacctgatgaactttttcaagcgtgtgatacgctactcaaatgggaaagtcatcgttcggcctgtggtggagtatagtaaggatacagaagacattgcttgggataagaaaagcaattttagaacgatctgcaaggtattgtcgtacccccaggtcaacattgtgaaaaaggttgagacccaaactggcggattctccaaagagtctatcctgccaaagggcgacagcgacaagttaatacctaggaaaacaaagaaagcctattgggataccaagaaatacgggggatttgactcacccacagtggcatatagtgtcttcgtggttgcggatgtggaaaagggtaaggccaaaaagctcaaaactgtaaaggagctggtcggcatttccatcatggaacgatctttctttgaggaaaatccagtggagttccttgagaacaaagggtaccataatatccgggaagacaagctgattaagttgcccaaatatagcctctttgagttcgaaggaggcaagcgcagactgctagcttccgcctcagagctgcagaaaggtaacgagatggtgatacctgggcaccttgtcaagctcctgtaccacgcacagaggatcaacagctttaatagtaccaaatacttggattatgtttctgctcataagaaagagttcgaaaaggtgctgtcctgtgtagaagactttgccaacttatacgtggatgtcgagaagaatctcagcaaaattcgggcagtggccgactcgatggataacttctcaatcgaagagatttctaatagttttatcaacctgcttacgctgaccgctttgggcgcgccagccgacttcaattttctcggagagaagataccgcgaaaaagatatacatccactaaggaatgcctgaacgcaaccctaatccaccagagcattacaggcctgtacgagactcgcatcgatctttctaaaattggggaagagtga

SEQ ID NO: 3201 - RNA, 4143 nt, synthetic construct
  misc_feature 1..4143: note = Cas9 variant
  source 1..4143: mol_type = other RNA
atgggcaagtacaacctggggctcgacatcggaaccaatagcgtgggttgggccgtcgttgatgagaacaatcagattgtgaaaaagggcgggaaagctctttggggagtaagaatgttcgacgaagcacaatccgccaaggagacaaggatatatcggaactctcgccgacgtatcgtgagaaggaatcagcggctgttgttactgcagaaagaattttacgatgagattatcaaggtcgaccagactttctttcaacgcctaaaggattcattctttaaaaaggaagacaaactcaacaagaataactatacgttctttgatgacgatattaccgacagagagtacttcaaaaagtttcccacaatctatcacctgaggagtcatcttctgtacaatgatgagaagatagacatccggatgttgtatctcgcgctgcaccatattgtgaaataccgcggccacttcctggatagcggtgaagttaacgagtccaatttttctaagatcaaagacgtgctcgacactttcaacaataagatgtcggaaatgtcattagagtttgaggataacgaagactacttctgcaaaattgagttcgatgaaaattttgagaacaagctgaaagacatcatgcttagccagttgagtaagaaggaaaaacgacaggagctgatagatctattcaaggtcgacaaaaagtccctcgtgaacgagctgcttattgaactgttggtaaataaaaaggttaagctcaactctctgagcatcaccaatgggaaaaagtatgaggtgtgtgaaattgattttgagaaagaagagttattcgagaagctggaagacgctaaaaagatcatcacagagctctttgatattcttgacgaaatagtcaacatcaagaaaattgtggattactattacgtgctgaagatcataggagacaatgagtatttgtccgaagccatggtcaaaaagtacgacaaacatgataaggacctaagagagctgaagtcattcattaaaacctattgccctaacaagtactacgagtgttttaggaaaacaagtaatccaaacctctgcaattatccgaagtacgttggcatcaacagcgtgaataaaaagatcgaacggttcgcacactgtaaaaaggaggaattttataagtacctgaaatctcttttcaacactattaaggatgagaatgccaaactgaagatcgacttgtttcagaaagatatggagaacgacgatttcctcaatcgtcaaaactccaaccacaattcaagcattcccatgcagctgaacttttgcgaattaaagaagatactggagaatcagagtaaatattaccctttcctaatgctcaagaactctgacggctattccaccagcgatcgcatcattgctatcttcaaatacaagatcccatactatgtagggcccctgaataaaaactcgaagtactcttggcttgtgaagaaatccaatgaaaacattacgccttggaattatgagaaggtcatagacttggatgcatcagccaaagaatttatccagagaatgcaaaacaagtgtacttacctgaaaggagagaatgactattgcctcccaaagaagagtattctgttcagcgagtacaactgtcttcagtatctgaataggttgatcattaacggtgctctcatcgaaaataaactgaagaacgagatatacgaaaacatctttttatgctacaaaaagcccaccaaaaagtccattgtggagtatctgaaaacaaattacaactatgatgaaactaccctaaagtctaatatcctcgaggttaactgtgacatgagctcatacattcagttcaaggagatctatggcgaagactttgagcaaaatctgaacatagtggaagatattatcaaagacattacaatcttcgaggataagaaaatacttgaaaagcggttgcgagagatctaccatctgagtgaggacaaagtccagaagattaaggggctcaattataaaggatacgccaccctgtccaagcactttttaaacaatttctacagcgtgaacgaagagacgggcgaaatctatggtcctattatccagataatgcgcgatactaattacaacctgcagcaagtaatttataatgacagatacaactttatgaaagcgatcgataagtataataaaaagaaccttgacacagagaagaaattgaacgtttctgatttcatcgacgagtacatttatgtgtcaccaatcatgaagaggagtctcattcagagctacaatataatccaggaactggagaaaattctaggggaatccatctctaagtactatattgagtgcgcacgggtccgctcgaacagcaaagatgtgatcaattccagatacaggcagctgtcagaactctataaggactgcgagcatcaagtcagtgatatatctaagaactacatcaatattaacaaactgaagaaacagcttgaggacaataagaacgaattgcgtgccgacaaactgtatttatactttacccagttcggaaagtgtatgtatactctcaaggatatcgacctggatgacgtgtttcttggcaaatacgatattgaccacatctacccgcagagcctgataaaggatgactccttgaataaccgggttctcgcttcaaaagagaagaatggcaaaaaggataaccaattcattttcaatatccccgaatttctgcctaaaaacgccgagctattctataagaagctgctcgaatgcaaactgatcacaaaggagaaataccgaagacttaccatgaagaaaattgacgatgacgagttggacatatttgtgaataggcagctggtagcaacgaaccagagcgtcaaggggttagtggatgttctcaagatctataaaggagtgaagccaaccaatattgtctactctaaagctgtgaacatctccgacttccgcaacaattataacctgtacaagagtcggacagccaataactatcaccatgcgcacgatgcctaccttaatgtagtgattggtaaagcactggacgtttactatcagtgtaactactttcaaaattataaggatgtcatcaagctaaaagacagaaacataactatcaatcccgaaattatcctcagcaagaacaggtacgtgaatcgcaacggcgagaaaaaggtgatttgggatctggacaataccttgaaactgatcaagaacaatttatataaccgattcgatataacagaaactattatgacccggaagtctaacaaaatgttttccaagtcaagtatcagccctgctaaaaattcgaagaacctcatcccaattaaaacatccgacccccgttgcaatgtcctgaagtacgggggaatcaaatctaacagctataatttctactgtatagttgagctttacgataagaagggcaaaaagtcatatattctggaagccatcccgaaaacccatagtgacaagttggaggagtacattaaaaactccatcgatgaaaagaatgtgtctaactttaagataattaataaaaacatcaagagcaatatcattatcgagtataaaaagctcagatacgtgattactggtaaatccgggaagtattacctgataaagaacttcaaagacaggaatttttcatataacgctatcaagacgattaaatacatcgaaaagtacaattatcagaaaaagtacgagatccctttcgaggaaacaaaggagaaaattatactagcccccaagaaaaaggacaccaaagaaatcagcctgactcttgataactgccaggcactcctggacgagattatcagtttgttcaagaaagatatttataactacgacatcatatataagatcacctctaagctggaagagaataaacaaaacttaacactcaccaatctgattaaggtacttactgagatcctgattttgctcaaaacaaacgaacgcggcacggccgatctgaccctaatcgacatgtccaaggatactggaacactgtgtataagcaaaacccttaagccaggcatgaagtttatttcggagtcacctacagggtactatcggaaaatcattttcgaagtccccaatggaatctga

SEQ ID NO: 3202 - RNA, 4143 nt, synthetic construct
  misc_feature 1..4143: note = Cas9 variant
  source 1..4143: mol_type = other RNA
atgaagagaatcctgggcctcgaccttgggaccacaagcattggatgggccctggtgaacgaggctgaaaataacaatgaggcatcctctatagtcaggttgggtgttcgggtgaaccccttaactgtagatgaaaaatcaaatttcgagaagggcaaagccatcacgaccaacgcggaccgccagctgcgacacggggctcgtattaatctacaaagatacaagctcaggcggcagaacctgcatgattgccttcagaaacagggatggctgggcacagaagccatgtatgaggagggtaaggcaagtacttttgaaacctacaagttgcgcgccaaagctgcagaggaagagatcagcctccacgagttcgccagagtgctgtttatgctgaataagaaaagggggtataagtccaaccggaaagctaataacaaggaagacggacaactcttcgatggcatgacaattgccaagaaattatacgaggaacatctgacccctgcggagtattctcttcagttgctgaataagggcaaaaagtttactcaggggtactatcgctcggacctaaacgcagaactcgagcgaatctgggatgagcagaaaaagtactacccagaaatactgacagacgagttcaaacaacagcttgaaggaaagaccaagacgaatacttcaaaaatctttctggccaagtatggtatttacagcgctgatttgaaaggcctcgacagaaagttccagccgctgaaatggagggtcgaggccttacagcaacaggtggataaggaagttctggcatttgtgatcagtgacctcaaggggcagattgctaacacctccggacttctgggcgccatctctgatcggagcaaagagttgtatttcaacaagcaaacagtcggtcagtacctatgggcgtccctggaggaaaatccccacatatcaattaaaaacaagcctttttatcgtcaggactacctcgacgagttcgagaaaatctgggagactcaggccgcatttcataagcaactgaccccagaacttaagcaggagattcgcgatatcatcattttctatcagagacccctgaaaagtaagaaatctttgataagcgtgtgtgagctcgaacagaggaaggtaaaagctacaatcgacgggaaggagaaggaaattaccatcggacctaaagttgccccaaagtcctcacccgtgttccaagagtttcggatatggcagaatctgaacaatgtcttactgattgataacgacacgaatgagaaacgacctctagatgaagtggagcgcaacctcctgtacaaggaacttagcatcaaagctaagttgagtaaaactgaggccctgaagatcctcaataagaaaggcaagcagtgggacctgaactacagagaacttgagggcaataggacacaggcaattctgttcgattgctataaccggatcattaccttgactgggcacgaggaatgtgactttaaaaagataaaagcctctgagatccgccactacgtgtccacaattttcaagaatctcggatttagcaccgaaatcctggatttcgacccatcgttaaagaaacatgagctggaaaagcaaccgatgtatcagctatggcacctcctgtactcttatgagtccgataactcaagaacgggtaatgagagtcttttgaggaaactggaaaccacatttggcttccccgaggaatacgctactgtcctctgcgacgttgtgtttgaggaagactatgggaacctgagcgtaaaggcgatgcgtgagatcttaccttacctgcaggcaggaaacgattactcccaggcctgtgcttatgccggctacaatcattctcggcacagccttaccaaagaggaattggaccaaaaggtgtataaggagcgactcgaactgctaccaaagaactcactgagaaatcccgtcgtggagaagattctcaaccagatgataaatgttatcaacgcaattatcgatgagtacggtaaacctgacgaaattaggatcgagatggcccgcgaactgaagagttccgctgccgatcggaaaaagacaactcacgcaataagccaggggaatgcggagaaccaaagaatcagggaaattcttgagaaggagttctctttgtcatatatcagtcgcaatgacattatcaaatacaagctgtatgaagagttagaaccaaactactacaaaaccctctatagcgatacatacataaccaaggacaaactgttttccaaggatttcgacattgagcatatcattcccaaagctcgactttttgatgactctttctcgaataagactctggaagcccggaacatcaatttggaaaagagcaacaaaacggcattcgattttataaaggagaaatatggcgaagacggagccgaggcttacaagaaaaagctcgacatgctgctagaaaatgatgccatctcccgtccgaagtataacaacctgctcagagcagaggctgacattccttcagatttcatcaatagggacctgcgcaacacacagtacattgccaaaaaggcgtgcgaaatccttggcgagttggtgaaaaccgtcactcccaccacagggaagataaccaatcggctgagagaggattggcagttagtggacgtaatgaaagaactcaactttgagaagtatgaaaagctgggacttactgagattgttgaggatagggacggtcgaaaaatcaagcgcatcaaagattggacaaagcggaatgaccacagacatcacgccatggatgctctggcaattgccttcacgaaaccaagttttatccagtacctaaacaatctcaacgctaggtctaataagggcgacagcatttacgccatagaaaacaaggagctgcattatgaagaggggaaattgcgtttcaatgcacctatccccgtgaacgaatttcgcgcggaggccaagcggcacctgtccgctattttagtctcaatcaaagccaagaataaagtgatgacccaaaacgtcaataagattaagactaaacacggaatcataaagaaaatccagctcacaccaagaggccccctgcataacgagaccatttacggtacaaagatgaggcctatcattaaaatggtgaaggttggggcagctcttgatgaagccactatcaacaaagtgagctctccagcaatacgagaggccctgttgaagcggctcaatgaatattccggcaacgctaagaaagcgttcaccggaaagaatacgctggagaaaaacccgatttacctaaatgccggccgcaccaagacagtacccagtctggtcaaaactgtggaatgggagagctttcaccctaccagaaaacttatcgacaaggacctcaacgttgataaagtggtcgacaaggggatcagggagattctgaaagcacggttggaagagttcaatggagatgctaagaaagccttttctaacctggaagagaatccaatatatttagacgaagccaagaagatcgctctcaaacgagtgtccattgagggtgtactgtcagcaatcccccttcatacactgaagaaccaggccggcaaacctattactgggaaggatggaaaaccagtgttgggcaattacgttcagaccagtaacaatcaccacatcgcgttctattacgacgaggatggtaacctccaagacaatgctgtcagctttttcgaagccgcagagagaaagtcgcaggggatacccgtgatcgataaggactacaaccgcgataaaggctggaggttcctgtttacgatgaagcagaatgaatatttcgtgtttccgaacgaggccacaggattcattccttccgaggtcgacctaaccgacgaagctaactacggcatcatttctccaaatctgtatcgtgttcagaaagtgagccggatcgataaggggacttcagcaagtagagactactggtttaggcatcaccttgagacaatactcaacgatgacgccaaactgaagaatttggcgttcaaacgcattcgaggattactggaactcaaggatatcatcaaggtgagaattaactccaccggcaaaatcgtagctgtcggtgagtatgactga

SEQ ID NO: 3203 - RNA, 4143 nt, synthetic construct
  misc_feature 1..4143: note = Cas9 variant
  source 1..4143: mol_type = other RNA
atgaagaaaatcctgggcctcgaccttgggaccacaagcattggatgggccctggtgaacgaggctgaaactgagtccgaaaagtcttcaataatcagattgggtgtcagggttaatcccttaacgattgatgagaaaggcaacttcgaaaaggggaaagcaatcaccacaaatagtgaccggcagcaacgccacagcgcccgaattaacctgcagcgttacaagctaagaaggcagaatctctgcgattgtctgcagatcggaggccttctgggttccgagtctatgtatgaggaagggaaggagtcgacttttgaaacctacaaattgcgggcgaaggctgccacagagaaagtggcactccatgagttcgcccgcatactgtttatgctgaacaagaaaagaggatataagtcaaataggaaggctaacagcaaagaagacggccaagcattcgatggcatgaccatcgccaagaaactctacgaggaaaatttaactcctgctgagtatagtctgcagcttttgaacaaggggaaaaagttttccccatcttactatcggagcgacctggaatccgagctaaatcgcatttgggaggaacagaaaaagtactacccggagatcctcacagatgacttctatcagcaactggaaggaaagaccaaagtaaacacgactaagatttttcttgccaaatacggtatctataccgcggatctgaagggcttggacaaaaagatgcagcccctcaagtggcgaatagaggcactgaataaacaggtggataaggaagtcttaacattcgtggtttcagacctgaaagggcagattgagaagacaagtggactccttggcgagatcagcgatagatctaaagaactgtactttaacaagcaaaccgtgggtcagtatgtctgggcctccttgaaggagaatcctcacgtgtcaattaaaaacaagccattctacaggcaggactatctagacgaatttgagaaaatctgggaaacacaagctgccttccataaggagctgacccccgagctcaaaaaggaaatccgggatattataatcttttaccagcgtcctctaaagagcaaaaaggggcttattagtatctgcgagctggaacagaaaaaggagaaagtaataattgagggaaaggaaaaagagatcttgatcggctctaaggttgcaccaaagtccagccccatgtaccaggagttccgcatttggcaaaacctcaataacgtgctgttaatcgacacggaaattaatgaatcgagacctctggatgaggaggaaaaagctctactctataacgagctgtctgtcagggccaaactttccgaaactgaggcgttgaaaacaataaataagaaaggcaagcactgggacctgaacttcaaggaactcgaggggaatcggacccaggccgtgctgtttgagtgttacaaccgaatcattactcagacaggacatgaagagtgcaatttcaaaaagatctcagcagaagatatccgccactatgtggctaccatttttaaaaaccttggtttcaatacggacatactggattttaacccaagtttggagaagcacgaactcgagaaacagccgatgtaccaactgtggcatttactgtatagctacgagtccgacaagtctagaaccggcaatgaaagcctactcaacaagctggaggccaatttcgggtttccccaggaatatgcttcagtccttgccgatgcaacattcgaggacgattacggaaacatcagtgttaaagccattaggaagatcttgcctcatctgcacgacggctacgactattccgaggcttgtgaacgggcgggttacaaccacagcgtgcgctctctcactaaagaggaactggcacagaaggtatataaagatagattagacctgcttccaaagaactcattgaggaatcccgtggtcgagaagattctcaatcagatgatcaacgtgataaatgccatcattgttgaatacgggaaacctgatgagatccgtattgagatggctcgggaactgaagagtagcgccgcaaaacgagaggaaagaaccaagtccatcaaccaaaatgccgctgagaacaaaaggataacagaaattctacagactgagtttggcctgtcttatatctcgcgcaatgacattgtgaagtacaaactctatcaggagctggaagccaacggattcaagaccctttacagcaatacatacatcccaaaggagaaattgttttccaaggatttcgacatagaacacatcgtccccaaagcacggctgtttgatgactcattcggcaacaagaccattgaggcgagagatgtgaatttagctaaaagtaacaagactgccttcgactttgtaaaggaaaaatatggggagcagggaatcgaggaatacaagaaaaagctcgatacgctgcttaaagagaatgcaatttctagcggtaagtataagaaactgatgatgtccgaagccgacatcccgtcagatttcataaacagggacttgcgcaacacacaatacattgctcgaaaggcctatgagatcctcggcgagctggttaaaaccatcactcctaccacagggaagattaccgaccggctacgtgaagattggcagctgatcgacgtgatgaaagagctcaattttgaaaagtacgatagactgggacttactgaggtcattgaagacagggatggccgcaagataaaacggatcaaggactggacaaaaagaaacgatcataggcaccatgcaatggacgctttgacgattgccttcaccaagcccagctatatccagtacctgaataacttaaatgcgcgatctgataaatccggtagtatttacgccatcgagactaaggagctccaccgcgaaaacaatacactgcggtttaacgctccaatgcctcttaatgagttcagaaaggaagcaaaaaggcatctgagcgccatactggtgtctatcaaggctaaaaacaaggtcatgacccaaaatgtgaacaaaattaagactaaaaatgggatcattaagaaggttcagctcactccccgtggcgccctgcacaacgagaccatctatggaacgaaaatgcgcccaataattaagatggtgaaaatcggcgcagcgttggacgaagccaccatcaataaggtatcctcacccacaattcgggaggctctgttaaaaagactcaacgagtacagtggggatgccaagaaggcatttgctggaaagaacgccataactaagaatcctatctatctgaacgcagaacacaccaaaacagccccagctatggtcaagattgtggagtgggaaatgtactatccgatcaggaaacttattactcccgacctgaagatcgagaaggttatagataatggtatcaaagaaattttgaagaaacgactcaaggagttcggcggggacgcgaaaaaggcctttagcaacctggacgagtgccctatctacctagatgaagagaagaatattaccctgaaacgggtgtcgatcgaaggagtcctttccgcaataccagtgcatacgctcaagaaccacgctggcaaagagattaaggacgaggatggtaaagccgtactgggggactatgtgcagacatctaataaccatcacgttgccatctaccaggatgctaagggcaatttgcaagacaacgtcatcagcttctttgaagcagccgagcgcaaatcacagaatgtgcccattgtggataagaacctgaatagagacaagggatggcacttcttatacaccatgaaacagaacgaatattttgtcttccctaatgaggaaactggcttcgttccaagtgagatcgatctcatggacgagaacaattacgaaatgatatcccccaacctgtttagggtgcagacaatgtctcgggtggattatgggaagaccattatccgagagtacgtattcagaaaccatcttgaaactattctgaatgacaacttgaaactcaagggactggtctttaaaaagatcaagagcctaaaagcgctggagggcatagtgaaggttcgcgtgaatgctattggtaaaatcgtcgccgtgggggaatatgactga

SEQ ID NO: 3204 - RNA, 4143 nt, synthetic construct
  misc_feature 1..4143: note = Cas9 variant
  source 1..4143: mol_type = other RNA
atgaagaaaaagtacgccatcggcattgacatagggaccaacagcgtgggatggtccgtcgttacagatgactataaagtgccctctaagaaaatgaaggtattcggtaatactgagaagagatacatcaaaaagaacctgctcggcacgcttctgtttgatgaagggaataccgctgagaacaggcggttgaaacgcacagcacgacgtagatatactaggcggcgcaatagaattttatacctgcaggaaatcttcgccgaggaaattaacaagatcgacgattcatttttccaaaggctagacgatagttttctcatagtggaggacaaacagggaagcaagcaccctatcttcggcaccctgcaggaggaaaaggagtatcataaacagtttccaacaatttaccaccttcggaagcaactggcggattcctctcagaaagctgacatccgcttgatttatctcgccctggcacatatcataaagtaccgaggtcacttcctgtttgaaggggatctcaaatcggagaataaggacgtccagcatttattcaacgattttgtggagatgttcgacaaaaccgttgaaggatcatacctgagcgagaatcttccgaacgtggccgacgtcttggtggaaaaggtaagtaagtccagacacctggagaatattctacactattttcccaacgagaaaaagaatggcctcttcggcaacttcctggctcttgcactggggttgcagcctaattttaaaactaacttcgaactcgccgaggatgctaagatccaattttctaaagaaacatacgaggaagacctggaggaattactgggaaagattggtgatgactatgccgatctcttcatcgcgaccaagagcctttacgacggcatcctgttggcagggattctatccacgactaactcaaccacaaaagccccactgagtagctctatggttaataggtatgaggagcatcagaaggatctcgctctgcttaaaaactttatacaccagaatctgtccgactcatacaaggaagtgttcaacgataaattgaaggacggatatgccggctacatcgagggtaagactacccaggaaaatttttaccggttcattaaaaaggcaatcgagaaaatagatgggagcaactattttattgaaaagatcgagcgtgaggacttcctccgcaaacaaagaacatttgacaatggaagtatcccccatcagattcacctgagggaaatgcaggctatcattcggcgacaagccaagttctaccctttcttagaggaaaaccaggataagatagagaaaatcctgaccttccgcattccatattacgtcggccccctagcgagaggcaagtctgagttcgcctggctcaataggaaatccgacgaaaagatccggccttggaactttgatgagatggtggacaaagaaacgagcgcagagaatttcatcactcgcatgacaaactatgatcagtacctgccagaccagaaggtgcttccgaaacactcgttgctgtatgaaaagtttgctgtctacaatgagctcaccaaggttagatacgtgactgagcaagggaaatctttctttttcgatgccaacatgaagcaggaaatttttgacaggacattcaaagtatatcgtaaggtgaccaaagagaagctgatggattttctttccaaggaatttgacgagtttcggatagtcgatctgttgggactcgacaaagataataagtcattcaacgctagtctgggtacgtaccatgacctgaaaaagatcgtgagcgaagactttttagataactccgagaatgaggacattctagaaaacgttgtgctcaccctgacacttttcgaggatcgagaaatgatcagaaaaaggttggagaagtataaggacgtcctgactgaggaacagcgcaaaaagctcgagcggagacactacaccggctgggggaggctgtctgccaaattaattaatggaatccgcgataaggtgacacgaaaaactatactggactatcttatcgatgacggcaccagcaaccggaatttcatgcagttgattaacgatgacacactctcatttgtagatgaaatccgtctggcacaaggtagtgggaaggccgaggactacagagctgaagttcagaatctagcgggctcccccgcaattaagaaaggaatcctgcagagcctcaagatagtggatgagctgattgaggtcatgggctatgaccctgaacatatcgtggtcgagatggccagggaaaaccagttcaccaatcaagggcgccggaactctcagcagagatacaaaaagattgagaatgctatcaaaaaccttgactcaaatttgaacagtaagatactgaaagaatacccaactaataaccaggccttacaaaacgataggctctttctgtattaccttcagaatggaaaggacatgtatacggatgaggagctggacatcgatcagttgagccaatacgacattgatcacatcattccccaggcattcatcaaggacgattccctcgacaacaaagtgctgacaaagtctgccaaaaatcgaggtaagtcggatgacgttcctagcctagaaatagtgtataaaaagaagaacttttggaaacagctgctcgactcccagctgatttcacaacgcaagttcgataatcttaccaaagctgagcggggcgggttgactaacgaagacaaggccagatttatccagaggcagctggtagagacccgtcagatcacaaaacatgtcgcacgcattttagatacccggttcaatactaagctcgacgaagcgggaaacagaatcagggatccaaaggtgaatattatgacactgaaaagttctcttgttagccaatttcgaaaggactaccagctgtataaagtgcgggagataaacaattaccaccacgctcatgatgcctacctaaacgcagtcgtggccacggctctcctgaagaaatatccccagttggccccggagttcgtatacggcgactatcctaagtacaattcctataagtcacgcaaaagcgcaaccgaaaaggtgctgttttactctaacatcatgaatttcttcaaaagagttttagtctattccaagactggtgaggtgaggattcggcccgtgatcgaagtcaacaaagagacaggggaaattgtttgggataagaagagtgactttcgaaccgtgagaaaagtgctcagctacccacaggtaaacgtcgtgaagaaaacagaggttcaaaatcacggcctggatcgcggaaagcctaaaggcttctacaacgctaatctttctcccaggccaaaggaggggtccgtggaaaacctggtccccgccaaacagtcatttgacactaagcgttatggaggttacgcgggcatcagtaatagctatgccgtgttggttaacgggataatcgagaagggcaaaaagaaatcgaaggctgaagtgaccgagttccagggaatttccatcctcgcacggaaagattttgacaagaatcctaagcaatacctgctaaacctgggttataaagacattaagtctatcataaaacttccaaagtacagcctcttcgagctggaaaatgggtcaagaaggatgttggccagtattctgtccacgaacaataaacgcggcgagatccataagggaaacgaaatgtatttaccggataagtttgtaaccctcctgtaccacgctatgcgagtcaatagaacacttgagcccggccacaaaaagtacgtggaagcccatcggcacgtgttcgacgagctgttgacttatatcctcgagtacaacgagaaaattgtcggggcaaaggcgaatggaaaaaggatagttgaagcctattctgctcgcaaggataccgacaacctggaggaactatgcaatagctttatcaacctgcttaacctcacagccctgggctccgcagtggatttcgaatttttgggtactaagattcctcgttacagagactataccccaagctcattactgaaagctacgctcatccatcagagtgtaacagggctgtacgagacccggattgatctttctaagctgggaggcgactga

SEQ ID NO: 3205 - RNA, 4143 nt, synthetic construct
  misc_feature 1..4143: note = Cas9 variant
  source 1..4143: mol_type = other RNA
atgaagaaaatcctgggcctcgaccttgggaccacaagcattggatgggccctggtgtacgagtccgaaaacgctgatgagaagtcttcaatagtcagattgggtgttagggtgaatcccttaagtgtagacgaaaaaggcaacttcgagaaggggaaaagcatcactacgaatgcagatcggcagcaaacccacggagcccgcattaacctgcagcgatataagctacgtagagaaaatctcaaggactgcctgcagaaacagggctggatcggtacagaggcgctttacgaggaagggaagacttccacctttgagacatatatgctgagggctaaagccgcagaagaggagatttctttgcatgaactctgtcgggtgctgttcatgctgaacaagaaacgcggatacaagtcgaatagaaaggccaacaataaagaggatggcaagctctttgacggcatgaccgtcgctaaaaagttatatgaagaacacctgactcctgcagaatactcacttaaattgctgagcagtgggaagaaattcaagcaagagtattacaggtccgatctaaaggaggaatttgaccggatctggaacgagcagcagaaatactatccagaaatactcacagatgacttcaagcagcaactgcagggaaaatctaagggtaataccagcaaaatctttcttggcaagtacgggatttattccgccgatctgaagggattggaccgcaaactccagccgctgaagtggcgagtggaggctttaaaacagaaggttgataaagaagtgctggccttcgtcatctcagacctcaacggccaaattgcgagtacgagcggtcttctgggggcaatctctgacagatccaaggagttgtactttaataagcagactgtgggacagtatctatggacctcactgaaagagagcccccatgtaagtataaagaacaaacctttctacaggcaagattatctcgacgaatttgagaagatttgggaaacacaggccacttaccacaaagagctgaccccagaacttaagcaggagatccgggatattatcatcttctaccagcgtcccctgaagtctaaaaagggcttgatttccgtttgcgagctcgaacaacgcaaagtgaaggtcacaatagacggcaaagagaaggaaatcagcattgggcctaaagtggctccaaagtcgtctcccatgtttcaggagttcagaatctggcagaatctgaacaacatattactgattgataagggaaataactccaataggcctctatatgaggaagaacggaacctcctgtacgaagaactttcagtgaaagaaaagttgagtaaagccgaggcactgaaggtcctcaataaaaacggtaagcagtgggacctgaattataaggagatcgaaggcaaccgaacccaagctgttctttacgattgttataatcgcatcattgggatgacgggacatgaggaatgcaacttcaaaaagctgaaagccagcgacatcagatacaatgtgaagactatttttaaaaacttgggcttctccacagatatactcgactttgattctagcctgcagggtcacgagttagaaaggcagccatcatatcagctgtggcacctactctacagttacgagtccgacaatagccggaccgggaacgacgcgctgcttcgcaagttggagactgccttctctatcccgaaggaatatgcagctgtactgtcagatgtggtctttgaggacagttacggcaatctcagcgtgaaagccatgagaaacattctgccccatttacaagctggactggattattcccaggcctgtgaaaaggcaggctacaaacactctaggcgttcgcttacaaagaacgagttggacaaaaaggaatataaggagaaactcgagctgctacctaagagctccctgcataatccagttgtggagaaaatcctcaaccagatgatcaatgtcattaacgccgtgatagatgagtacgggaagcccgacgaaatccggattgagctggctcgagagcttaaaatcggagcggcagaaagagagaatatgaccaggtcaattaaccagggtaatgccgaaaacaagcgcatccgggagatattggaaaaagagttcgctctgagttatatctctagaaatgatattatcaagtacaagttatacgaggaactcaaaagcaacggctttaagacgctgtattccgacacctacatttcaaaagataaacttttcagcaaagactttgatatcgagcacataattcctaaggccaggctgttcgacgattctttgtccaataagacaatcgaagcacgcgacgtaaacattgccaaaagtaataagactgcttttgacttcatcagcgagaaatatgatcaacaggggatagaagcctacaagaaaaagctcgacatcctgctacaggatggatctatttccaaggcaaaatataaccgactgctcatgaaggaggcggacatcccatcaggctttattgatcgggacctgcgtgatacccaatacatcgctaaaaaggcctatgagatacttagtgacttggttagaaatgtgacacccactaccggtgcagtcacaagcaggctgcgcgaagattggcagttagtggacgtcatgaaagagctcaacttcgaaaagtaccagaagctggggcttgtggaggttattgaagatcgggacggcagaaaaatcaagaggatcaaagattggaccaagcgaaacgaccaccgccatcacgccatggacgctctgactattgccttcacgaaaccgtcgtacatccagtatctaaataacctcaatgcacggtccgataagaactctagcatttacggaatagagaataaggagctgcatagagaagacaacaaattgaggtttaatgctcctctgcccatcaacgagttccgtgccgaagcgcgccggcacttaaagtcaattctcgtgagtgtaaaagccaagaataaagtcatgacacaaaacgtgaatgttatcaagaccaaacatggcgtgattaagaaggtccagctgactccaagaggggagcttcacaacgctaccttttatggaacaaagaagaggcctatcataaaaatggtgaaggtaggtgcagccctggatgaggtgaccatcaaaaaggtttcctctagcttcattcgagaggctttgctcgaccggctgcacgagtacaatggcgatgccaagaaagcatttactgggcgcaactccatcgacaagaatcccatttatatcgatgaggagcataaaaagacagtcccagcgctagtgaaaacgatagaatgggagatgtaccaccccaccagaaagatgatttcacctgacctgaagatcgataaagtgatcgacaagggaattagggagatacttcggactcgactcgccaaattcaacggcgatgctcagaaggcctttagcaacctggacgaaaatccaatctataaagacgaggcaaagaagattacattgaaaagagtcagtctggaaggtgtttcttccgtgatcccgttacataagctcaaagatatgggcgggaagcccgtggtaggaaaagacggcaagcctgtctggggagattacgtgcagaccagcaacaatcaccacattgctttctacatggacgagaacgggaatctgcaagatgacgttgtgacatttttcaaagccgcacgcaggaagtcgcagggcgtcccagtgatcgataagaactataatcatgacaaaggttggcactttcttttcactatgaagcagaacgaatactttgttttccccaatgaggccaccgggttcatacctacggaggtggatctgatggacgaagctaactatgatatgatctcaccaaatttgtaccgtgtacagaaaatgtctaagaccaaacaaggaattacagacaagcgggattattggtttagacatcacctcgagactgtcctgaacaatgacctaaaggtgaggaacagtatcttcaaacagattaattccctgaagccccttgaaggcatcgtgaaagtccgcataaacgcgattggtaagatcgttgccatcggcgagtacgactga

SEQ ID NO: 3206 - RNA, 4143 nt, synthetic construct
  misc_feature 1..4143: note = Cas9 variant
  source 1..4143: mol_type = other RNA
atgaagagaatcctgggcctcgaccttgggaccacaagcattggatgggccctggtgaacgaggctgaatccaataacgaggcatcttcaatagtcaggttgggtgttcgggtgaatcccttaactgtagatgaaaagagtaacttcgagaagggcaaagccatcacgaccaatgcggaccgccagctgcgacacggggctcgtattaacctacaaagatacaagctcaggcggcagaatctgcatgattgccttcagaaacagggatggctgggcacagaagccatgtatgaggagggtaaggcaagcacttttgaaacctacaagttgcgcgccaaagctgcagaggaagagatctccctccacgagttcgccagagtgctgtttatgctgaacaagaaaagggggtataagtctaatcggaaagctaacaataaggaagacggacaactcttcgatggcatgacaattgccaagaaattatacgaggaacatctgacccctgcggagtattcgcttcagttgctgaacaagggcaaaaagtttactcaggggtactatcgctcagacctaaatgcagaactcgagcgaatctgggatgagcagaaaaagtactacccagaaatactgacagacgagttcaaacaacagcttgaaggaaagaccaagacgaacactagcaaaatctttctggccaagtatggtatttacagtgctgatttgaaaggcctcgacagaaagctgcagccgttaaaatggagggtcgaggccctgaagcagcaagtggataaggaagttctcgcattcgtgatctccgaccttaaagggcagattgctaatacctctggactgttgggcgccatcagcgatcggtccaaggagctatattttaacaaacagacagtcggtcaatacctgtgggcgtcactcgaggaaaacccccacataagtattaagaataaacctttctatcgtcaggactacctggacgagtttgaaaagatctgggagactcaggccaccttccataagcagcttacaccagaactgaaacaagagattcgcgatatcatcatattttatcagagacccctcaagagcaaaaagtctttgatttccgtgtgtgagctggaacagaggaaagtaaaggcaaccatcgacgggaaggagaaagaaattacgatcggacctaaggttgctccaaaatcaagccccgtgttccaggagttccggatatggcaaaacttaaataacgtcctgctaattgataatgacactaacgagaagcgacctctcgatgaagacgagcgctacctgctttacaaagaattgagtatcaaggccaaactgtctaagacagaggctctcaagatcctgaataaaaagggcaaacagtgggatcttaactataaggaactggagggcaatagaacccaggccattttgtttgactgctacaacaggatcattactctcacagggcacgaggaatgtgatttcaaaaagataaaggcatccgagatccggcactatgtgagcaccatttttaaaaatctgggattctcgacggaaatcttagactttgatccatctctggagaagcatgaactagagaaacagccgatgtaccaactctggcatctgctttattcctacgagtcagacaacagtcgcaccggtaatgagagcttgctgagaaagctcgaaacaactttcggctttcccgaagagtatgccaccgtgctgtgcgacgtcgttttcgaagaggattacgggaacttatccgtgaaagctatgaggaagatcctgccttaccttcaggcgggaaatgactattctcaggcatgtgcctacgctggctataaccacagccgtcactcattgacaaaggaggaactcgatcagaaagtatacaaggagcggctggaactactgcccaaaaacagtctccgaaatcccgtggtcgagaagattctgaaccaaatgataaatgtgatcaacgccattatcgacgagtatggtaaacctgatgaaattagaatcgagatggcaagggaacttaagtccagcgccgctgaccgcaagaaaactacccacgccataaatcaggggaacgatgagaatcagtgcatccgggaaattttggagaaggagtttgcactgtcttacatctcaagaaacgacattatcaaatataagttatacgaggaactcaaaccaaatggcttcaagacactgtacagtgatacctatatacccaaagacaaactttttagcaaggatttcgacattgaacatatcattccgaaagcgaggctgtttgatgactcctactctaacaagactttggaggctcgcgacatcaatctcgccaaatcgaacaagacggcattcgatttcgttaaagaaaagtatggagagcaaggcgccgaggcttacaagaaaaagctggacatgctactggggaataacgtgataagcaaacctaagtataataaactcctgatgacagaagccgatatcccctccgactttattaaccgagatcttcggaacacccagtacatcgcacgtaaggcttgtgagattttgggagaactggtcagaactgtgaccccaacaaccggtaagatcactaataggttacgcgaggactggcagctcgtagatgttatgaaagaactgaacttcgagaagtatgagaaacttggcctgacagaaatagtggaggaccgggatgggagaaagattaaaaggatcaaggactggacgaagcgaaatgatcaccgccatcacgccatggacgcgctagccatcgcttttaccaaaccttcatacattcagtacctcaacaatctgaacgcacggagtaataagggagattctatctatgccattgaaaacaaagagttgcattacgaggaaggcaagctgagattcaatgctcccataccagtcaacgtgtttagggccgaggcaaaacgtcacttaagcgcgatcctcgtctccattaaggccaagaataaagtgatgactcaaaacgttaataagatcaaaacaaagcacggtattatcaaaaagatacagctgaccccacgcgggcctcttcataacgaaacaatctatggcactaaaatgcggccaattatcaagaaggtgaaagtaggagctgccctggacgaggcaaccattaataaggtctcaagcccggctatcagagaagtgttgctcaaaaggctgaacgagtactctggcaacgccaagaaagcattcacggggaagaataccctagacaagaaccccatatatctgaatgccgagcgaacaaaaactgttcctgcttccgtgaagaccgtcgaatgggagaactaccacccaattcggaaacccatcacacctgatcttaaggtggacaaagtaatcgataagggaattggtgaaatactcaaggcgcgcctggaggaatttaatggcgacgccaaaaaggcattcagtaacttggaggagaatccaatctatctggatcagactaaaaagattgctttaaaaagagtgagcatcgaaggggttctctctaccattcccctgcatacgcttaagaaccaggccggaaagccgatcatgggcaaagacggtaagcctgtcctggggaattacgtgcaaacatccaacaatcaccacatagccttttactatgatgaggacggcaacttgcaggataatgctgtgtcattctttgaagcagccgagaggaaaagtcagggaatcagcgtcattgacaaggattacaaccgggacaaaggctggcgattcctctttaccatgaagcagaatgaatatttcgttttcccaaacgaggcgactgggtttatcccctcggaggtggacctgacagatgaagctaattacggaattatctcccctaacctatatagagtgcaaaagatgtctcgcatagagaagggcaccagcgtatcaagggactactggttccgtcatcacctggaaactattcttaacgatgacagtcggctcaaaaattccgcctttaaaagaatcaactctctgaagcccttggagggtatcattaaagtcaggatcaatagcatagggaagattgtggcagttggagagtatgattga

SEQ ID NO: 3207 - RNA, 4143 nt, synthetic construct
  misc_feature 1..4143: note = Cas9 variant
  source 1..4143: mol_type = other RNA
atgaagaaaggctacagcatcgggctggacattggaaccaactccgtgggtttcgccgtcataacagatgactataaggttccctctaaaaagatgaaagtgctcggcaatactgataagagatttatcaagaaaaaccttattggggctctgttgttcgacgagggaacgaccgcagaagccaggcggttaaagcgcacagcgcgacgtagatacactaggcggaaaaatcgcctgagatatctacaggagatcttttcagaagagatgagtaaggtagatagctccttctttcacaggctcgacgattctttcctgattcctgaagacaaacgggagtcgaagtacccaatctttgctacccttgaggaagagaaggaatatcataaaaagttcccgacaatataccatctgcgcaaacatttggccgattcaaaggagaaagcagacctccgactgatctatctggccctcgctcacatgattaagtacagaggccactttttatacgaggataccttcgacatcaaaaacaatgatattcaaaagatctttaacgagttcataagcatttatgacaatgcatttgaaggtagttccctgtctgggcagaacgcccaggtggaagctatcttcactgacaagattagcaaatccgccaagagggagcgggtccttaaattgttccccgatgaaaagtcaacaggactgtttagtgagttcctaaaactcatcgtgggcaatcaggcggactttaagaagcacttcgatctggaggacaaagcacctcttcaatttagcaaggatacctacgacgaagatctggagaacttgctcggccagatcggggacgatttcgccgacctgtttgttgctgccaaaaagttatatgatgcaattctgctctctggaatacttacggtgactgacccatccaccaaagctcccctgtcagccagcatgatcgaacgttacgagaatcaccagaacgacttggtcgtgctaaagcagttcattaagaataacctgcctgaaaattatgtagaggtttttagtgatgactctaaaaacggttacgcgggctatgtgggggtcgattccaagatccgcaaaagaaacgccaagctcgcaacagaggaagagttctacaaatacctgaagaatatacttaacaatgtgaagggagctgactattttctggataaaattgaaagggaggacttcttgcggaagcaacgaacttttgataacggcagcatcccacatcagatccacctccaggaaatgaatgccattctgcgcagacagggtgagcattaccccttcttaaaagagaacagggaaaagatcgagaaaattctgaccttccggataccttattacgtggggccactagctcgcggaaatagagactttgcctggctcacaaggaactcggatcaagcaatccgtccgtggaatttcgaagagattgtcgacaaggcctcttccgctgaggattttatcaacaaaatgaccaattatgacctgtaccttcccgaagagaaggttttgcctaagcactcactgctctatgaaaaattcgcggtgtacaacgagctgacgaaggtaaaatttatcgcagaaggccttcgggattaccagttcctggacagtggccagaagaaacaaattgtgaatcagttgtttaaggagaagcgaaaagtcactgagaaggacataatccactatctccatacagtggatgggtacgacggaattgaactgaaaggtatcgagaagcagttcaacgccagcttatccacctatcacgatctgctaaaaattatcaaggacaaggaatttatggatgacccaaagaatgaggaaatactcgagaacatcgttcatactctgacaattttcgaggatagagaaatgatcaagcagaggcttgctcaatacgactctttgtttgatgagaaagtgattaagagcctgacccgccggcactatacgggctgggggaaactctcagccatgctgatcaacggaataagagacaagcagaccggcaagacaattttagattacctgatcgacgatgcatattacaataggaacttcatgcagcttattaatgacgacggtttgagttttaaagaaatcatacagaaggcccaagtcgtggggaaaactgatgacgtaaagcaggttgtgcaggagctccccggctcccctgctatcaaaaaggggattctgcagagcatcaaaattgtcgatgagctagtgaagatcatgcgccataacccagaatctatagtcattgagatggcccgagaaaatcaaaccacagcacggggcaagaaaaactcacagcagcgttacaagagaatcgaggacgcgctgaaaaatctcgctcccgggctggatagtaacatccttaaggaacacccgactgacaatgtgcagttgcaaaacgataggctgttcttatattacctccagaatggaaaagacatgtataccggtgaggccctggatattaaccagcttagctcctacgacatcgatcacattatacctcaagcattcatcaaggacgactcttttgataatcgcgttctgacatcgagcaaggacaaccggggcaaatccgataatgtgccctcaattgaggtagtccagaagagaaaagccttctggcagcagttgctcgacagtaagctgatctctgaaaggaaatttaacaacctaaccaaggctgagcgagggggactggatgaacgcgacaaggtgggcttcattaaacggcaactcgttgagactagacagatcacgaagcatgtggcccagatactggatgcaaggtataatacagaagtcaacgagaaagacaagaaaaatcgtaccgtgaagatcattactcttaagagcaacttggtatccaattttcgcaaagagttccggctgtacaaggtgagagaaatcaacgattatcaccatgctcacgacgcctacttaaatgcggttgtcgccaaagctattctcaagaaatacccaaagctggagcctgaatttgtgtatggtgagtaccagaagtatgatcttaaaaggtacatctcacgaagcaaggaccccaaagaagtggagaaggcaaccgagaaatatttcttttactctaacctgctaaatttctttaaggaagaggtccactatgccgatgggacaatagttaaacgggaaaacattgagtactccaaggacaccggcgaaatcgcttggaataaggagaaagacttcgccatcattaagaaagtgctcagtctgccacaagtgaacatagtaaagaaacgcgaggtccagactggaggcttcagcaaggaatctatcttgcccaagggaaattccgataaactgattcctagaaagacaaaagacatcttatgggatacgaccaagtacggaggttttgactcaccagtgattgcatatagtatcctcctgatagcggatatcgagaaaggcaaggccaagaaacttaagactgttaaaacactggtggggattaccatcatggaaaaggctgccttcgaggacaacccgattacatttttggagaataaaggataccataacgtcaggaaggaaaacatcctctgcctgcccaagtatagcctattcgagctggaaaatggccggcgaagacttctcgcatcggctaaagagctgcagaagggtaacgaaatagtgttgcctgtttacctgactaccttactctatcactccaaaaatgtgcataagctggatgagccagggcaccttgagtacattcagaaacatcgcaacgaatttaaggacctgttgaatctcgtatctgagttcagccaaaaatatgtcctggccgatgcaaacctagaaaagatcaagtcactgtacgccgacaatgagcaggctgatatcgaaattcttgcgaacagttttatcaatctcctgacgttcaccgccttgggcgcacccgctgcctttaaattctttggaaaggacatagataggaaacgttacacaactgtgtccgagattttaaacgccaccctgatccaccagtctattacaggcctctatgagactcggatcgacctgagcaaacttggggaagactga

SEQ ID NO: 3208 - RNA, 4143 nt, synthetic construct
  misc_feature 1..4143: note = Cas9 variant
  source 1..4143: mol_type = other RNA
atgaacctgagacacgtgggcaattacaacatcgggctcgacatgggaaccgccagcgtcggttgggctgcaattgatgagcagggcgaacttctgcatttcaaggggaaacccacatggggatccaggttgtttgactctgccaatactgcggctacggcccggatgcctcgcggccaacgacgtagatatataaggcggcgctggagattagatctgctacagaagttcttttcagaggaaatggcagagaaagacccagagttctttatcaggctccggcagagtagcctgtggccggaagatcgcgagggtgggcacaccgcctaccattggccccttttcaacgactccgattttaatgaaaaggagtattacgaaaaattccctacaatttttcatctgcgacagtggttgatggagactgacgagaaggctgatatcagactcatttatctggcattccacaacatcgttaagcacaggggaaattttctgcaagaaaacaatgactctctctcggcccagaacgctaatatgcgggagtcattagagagcttctgcatagccctggaagaatggtgtgatgagaaagagcttacctgcagttgtgacccacagaagttggaacacctgtttaaagaggtgaagtaccgttccgatatccgcgacggcttcgcggcactactcggcctggcctgctctggggaaaacgaggtagacgtgaaagctatggccaaggaaatgggaaaggcaattgtcggttataaagctgatttcagcaagatctttacagagtgtgacaaagagggctcctcattcagacttagtgatgacgaagggcccgaggcctttctggatatttgccctgacgatggaatcgcgttgttcgaagccatacagatggtgtacagctcttttattctcaccggcatgctgactgagaagggtttatccctgtcaaaaatcagcgcatacaatcaatatgggcaggacctcgaaagtcttaaggctctggttaaagagtacgtgccaaacgagtattcttccttctttaggggacccacatacagcggctcgaccgaatatgatccttctaaggcccagggctacacgcggtataatttggggccatccaagaaaggatcaggtgctaagccgatggcctacgaggacttcaaaaagagtgtcgaacagctatttgcaaacactaacgccattaatgatgagcgatacaaagagatgatgggccgcttcgctgaagagaagtttctgagaaggctccggaccagcgacaacgggcgcatccccttccaactgaatcttgaagagatgacagcgatcattataaaccagggaaagtattacccttttctgttggaacagcaagagaaactcgagtccctggtgagattcaggatcccatattacgtaggccccttaactcgtattaatgcacggctggactctaagggtaacgcctgtttcgcttggagcaaacgaaaggatgggatggactcagccagtatcaaaccttggaattgggatgaagttatagacaagcatgcatccgcccaggcttttattgagagaatgaccggcacatgcacctatctaaggggagaaccagtgctcccccgctgtagcctgctttacgaggaatattgcgtcttgaacgagctgaatggcgcccggtggacgcaggatggggacaagttcatcagatttgattacaaagacaggtctgatatcattgaggaactcttcaagaaacgccgaggacggatccagtacgcagcggtggctgactggatgaagcaagagcgttcacacgccaacgtgcatgtcagtggtggccagggggaaaatgcatttgagagcagactgtcctcttatcacttcttttgtaacgatgttttcggagtggacgaacttccgggctcgtacgtagatatggtggaggagattatactgtggagcactttgtttgaagacaggtccatcctccgcgaggaaattcagcggaaatatggtgacgtcctgaatgaggagcagatcaagacaatctgcaagaaaagattctcagggtggggcaggttaagtcgaaagctgctatgctctctcaaagcccaaaccgataacggacctaagagcattatggacatactgcaggaaggcgatcagaataacgggcgcgtgggacgggctatggtttttcaggagatccttcacgacgaacaattgggtttcgagcagaaaattgaagaggagaacactcagtccatgctggaaggcgagaatctcctgatcgaagatttacccgggtcaccagccattagaaggagcatcaaccaggcagtgcgtatagtcgacgagatcgtgggaattgctggccatgcccctgataatatctttattgaagtaacacgcgaggacgataccaagaaaaagggtaagcggacgaccacaagatactctaacatccaaaaagcgctggaggcccttaaggaagagggggctgaagcattgagggagctcaaaacttataagcacaatgaactggacaaacgactatccctgtacttcatgcagaacggcaagagtctctatagcggaatacccctggatattcggcgcctttctgagtaccagatcgaccatattatcccacaatcctacataaaggatgactcatatgagaatatggccttggttctgcccggcgaaaaccagagtaaagctgacaatttactcatcagccaggatattagaatcaagatgaaagccacctggacagcactgcacaaggcggggcttatgggagacaaaaagtacaacaatctgatgaactcgtccatttctgatgccaagatgaaaggcttcatcaataggcagttggtggagactagccaatcagtcaagctcacccagatgatgctgagtcagaaatatcctggtgctaaggtgcggccaataaaagcctccatttctagccagctacgagacgcatgtgatctggtcaagtgcagagaagctaacgactaccatcacgcccacgatgcatatctcgcctgtcaagtggggcgctttgttctgaagaggcattcctcaatgttcgacaatccgatcggaatgacaaaagtgatccgtgattttgtaaagcggcagggccaggagttcaaaagaaacggtaaacttcccgcttacgcgagcaggagtggctttattgtccagtctttcatgcgctccgggtttgacgccgagaccggagaattgctgcgagatgactggaacgcacctttcgagatcgctagaattaaacggtgcttaaattatagggactgttacataagccgcatgccaatggaagattcgggcgccttttgggacgccactatctactcacccaaggctgggaaaaagggagcactccctgtgaagcaaggcctgccagttgagaaatatggttcttacagtcgtgaacagttcgcctactttttcgtgtataaggcgtataaccccaaaaagaaggcttacagacttgagttcgaggccgtcccggtgcgggtagcatccgccgtggaaacgagggagaatgctctggaagagtatgcaaagagcgttgccaagcaggcggggctagaatttgtcgaggtggctcgccctaaagtgtacaagtaccaactcattgagctgggagaagatcgattgtatatcacaggcaaaagagaggtccggaacgcctctcagctggcattcagcttagacgaaattgatctcctgaagaggcttgccgagggtgaagagacctcctcagaggaacgcgagagactgtttgacgttttgatcgaaaaatacgctaggtatgccccacggctcgcacgtcagctgagtgtggatagcatgtctgctactttcgagaccctaaatgccgaggaacagctgggcatacttctctccctggtggagatcgcgaacgggaagcgcaatatgattgacttgtcaagtgccggaggcagcaagaacgcagggtgcatgaatcccacattttcctctgaactgtcgagccctggatcaaacttcacctttatcgatcaatccgtaactggcatgttcgagcgaagacagaggttagaactctga

SEQ ID NO: 3209 - RNA, 4146 nt, synthetic construct
  misc_feature 1..4146: note = Cas9 variant
  source 1..4146: mol_type = other RNA
atggtgaagaaaaagtacgccatcggcattgacatagggaccaacagcgtcggatggtccatcgttacagatgactataaagtgccctctaagaaaatgaaggtattcggtaatactgagaagagatacattaaaaagaacctgctcggcacgcttctgtttgatgaagggaataccgctgagaacaggcggttgaaacgcacagcacgacgtagatatactaggcggcgcaatagaatcttatacctgcaggaaattttcgccgaggaaatcaacaagatagacgattcatttttccaaaggctagacgatagttttctcatcgtggaggacaaacagggaagcaagcaccctattttcggcaccctgcaggaggaaaaggagtatcataaacagtttccaacaatctaccaccttcggaagcaactggcggattcctctcagaaagctgacattcgcttgatctatctcgccctggcacatataattaagtaccgaggtcacttcctgtttgaaggggatctcaaatcggagaataaggacgtccagcatttattcaacgattttgtggagatgttcgacaaaaccgttgaaggatcatacctgagcgagaatcttccgaacgtggccgacgtcttggtggaaaaggtaagtaagtccagaaggctggagaatatcctacactattttcccaacgaaaagaagaatggcctcttcggcaacttcctggctcttgcactggggttgcagcctaattttaaaactaacttcgagctcgccgaggatgctaagattcaattttctaaagaaacatacgaggaagacctggaggaattactgggaaagatcggtgatgactatgccgatctcttcatcgcgaccaagagcctttacgacggcattctgttggcagggatactatccacgactgattcaaccacaaaagccccactgagtagctctatggttaaccggtatgaggagcaccagaaggacctcgctctgcttaaaaattttatccatcagaacctgtccgattcatacaaggaagtgttcaatgacaaattgaaggatggatatgccggctacattgagggtaagactacccaggaaaacttttaccgtttcatcaaaaaggcaatagagaaaattgaagggagcaattattttatcgacaagatcgaccgcgaggatttcctcagaaaacaaaggacatttgacaacggaagtattccccaccagatccatctgcaggagatgcacgctattatacggcgacaagccgagttctacccatttttagtcgagaatcaggataagatcgaaaagattctgaccttccgcatcccttattacgtgggccccctagcgagaggcaaatctgagttcgcctggctcaacaggaagtccgacgagaaaatccggccttggaattttgatgaaatggtggacaaggagacgagcgcagaaaacttcattactcgcatgacaaattatgatagatacctgccagaccagaaagtccttccgaagcactcgttgctgtatgagaaatttgctgtttacaacgaactcaccaaggtgaagttcatagccgaggggatgagggattaccagtttctggactctggacagaaaaaggatatcgtaaaaactcttttcaagacaaaacgtaaggtgaccgctaaggacattaaagcctatctggaaaattccaacggttacgcaggcgtcgaattgaaggggctcgaggaacaatttaatgcctcactgcccacgtatcatgatttactgaaaatcctacgggacaaggctttcattgacgcggaggaaaaccaggagatcctcgaggatatagtgctgacccttacattgtttgaagaccgagagatgatcagaaaaaggctggaaaagtacaaggatattctcactgaggaacagcgcaaaaagctggagcggagacactataccggatggggcaggttaagtgcaaaactgatcaacggtattcttgacaaggttacacgcaaaactatcttggggtacctcatagatgacggcaccagcaatcgaaacttcatgcaactgattaatgatgacacactatcctttgtggatgagatccggctggcccagggatctggcgaagctgaggactatcgtgccgaagtccagaacctcgcagggagccctgccattaagaagggaatcctgcagtcacttaaaatagtggatgagttgatcgaggtaatgggttacgaaccagagcatattgttgtggaaatggctagagagaatcaattcaccaaccagggcaggcgcaatagtcagcagcggatcaacagactggaaaatgccttaaaggactttgggtccaaaattctcgaggagcaaaagccctacggagtcagcaaagtgaacaatatccatctgcagtctgataggcttttcctgtattacttgcagaacggcaaggacatgtatactgacgaggaactcgatatagaccacctgtcagaatacgatattgaccacatcatccctcaagcattcattaaagatgacagtctagataataaggtcctgacaaagagcgcgaaaaaccgaggtaagtccgacgatgtgccatctatggagatcgttcacaatcgcaaaaacttttggcggcagctcctgaagtcgaaacttattagccagagaaagttcgacaacttgacgaaggctgaacgagggggcctgaccaatgaggataaagcccgttttatacagcgccaattagtggagactcggcagatcaccaagcatgtagcaagaatgctcgacacaaggttcaacaccaaactggacgaagccggaaataggattcgggatcccaaggtcaacatcattactcttaaatccaatctggtgtcacagtttcgcaaggactatcagctatacaagatcagagagataaacaattatcaccatgctcacgatgcctacatcaacgcagttgtggctacagccctcctgaaaaagtacccgcaattggcgcctgagttcgtctatggcgaataccccacgtataatagttacaactctaggaaaagcgccaccgaaaaggtgctgttttattccaatattatgaacttctttaaacggatcgtagtgcactcaaagactggggaggttcgaattagaccagtcatcgaggtgaataaggaaacaggagagatagtgtgggacaaaaagagcgatttccgcaccgtcaggaaagttttatcttaccctcaggtgaacgtggtaaagaaaacagaagtccagaatcatggtctcgaccgtggcaagcccaaggggttttataacgctaacctgtccccacggcccaaagagggaagtgtggagaatcttgttcctgcaaagcagagcttcgatactaaaagatacggcggttacgccgggatttctaactcctatgctgtgctggtcaatggcatcatcgaaaagggcaaaaagaaatcaaaggccgaggtgaccgagttccaaggaattagtatattggcaaggaaggactttgataaaaacccaaagcagtacctcctgaatctagggtataaagacatcaagagcattatcaaactgccgaagtactcgcttttcgaactcgaaaacggatcccgccgaatgctggcgtctattttgagcacgaataacaagagaggcgagatccacaaaggtaatgagatgtatctgcccgataagtttgttaccttactctaccatgccatgcgggtgaacaggacactggaacctgggcacaaaaagtatgtagagactcatcgccacgtcttcgacgaacttctgatatacatcttggagtacaatgagaaaattgtgggagctaaggccaacggcaagcgtatcgtggaagcatattcagctagaaaagataccgacaatctcgaggaactgtgcaacagttttattaatctactgaaccttacagccctcggttccgcagtcgacttcgagtttctgggcactaagatcccacggtacagggattataccccctctagcttgttaaaagccacgctgatacaccagtccgttacagggctctacgaaacccgcattgacctgtcaaaacttggaggcgattga

SEQ ID NO: 3210 - RNA, 4146 nt, synthetic construct
  misc_feature 1..4146: note = Cas9 variant
  source 1..4146: mol_type = other RNA
atgaactacgtgaaggagtatcacatcggcctggacattgggaccagctccataggatgggccgtcacagattctcagttcaaactcatgagaatcaagggtaaaactgctattggcgttaggctttttgaagaggggaagacggcagccgaacggcgcaccttccgaacaactcgtagaaggctgaaacggcgcaagtggagattgcattacttagacgagatctttgcgccccatctgcaagaagtggatgagaatttcctaaggcggctcaagcagtcaaacattcaccctgaggacccagctaaaaatcaggcctttatcggaaagctgcttttcccggatctgttgaaaaagaacgaacgcggctatcccaccctcataaaaatgcgagacgagctgcctgtagaacagagagcacactacccagtgacaaatatctataagctgagggaggccatgattaacgaggatcggcaatttgacctccgtgaagtctacttagctgtgcatcacatcgttaagtatcgcggtcacttcctgaataacgcaagtgtggataaatttaaggtcgggagaattgacttcgataaaagttttaatgtgcttaacgaggcctacgaagagttgcagaatggagaaggctccttcaccatcgagccctctaaggtagagaaaataggccagctgctactcgacactaagatgaggaaactggatcggcagaaggctgttgccaagtttcttgaagtgaaagtcgcggacaaggaggaaacaaaacgaaacaagcaaattgcaaccgccatctcgaaactggtgttggggtacaaggctgacttcgccacggtggcaatggctaatggaaacgagtggaagattgatctctcaagcgaaactagcgaggacgagatcgaaaaattccgcgaggaactgtccgatgcccagaatgacatcttaaccgagattacatctctgtttagccagataatgctcaacgaaatcgtccctaacggtatgtccatttcagagagtatgatggatagatattggactcatgagaggcagcttgcggaagttaaggagtacctggccacccaaccagcaagcgctcggaaagagttcgaccaggtgtataataagtacatcggccaggcccccaaagaaaaggggtttgatttggagaagggactcaaaaagatactgtctaaaaaggaaaactggaaagagattgacgaactcctgaaggctggcgatttccttcctaagcaacgcacatccgccaatgtagtgatcccacaccagatgcatcagcaggagctggacagaatcattgaaaaacaagcaaagtattacccgtggttggccaccgagaaccccgctacgggtgagagggatcgtcaccaggcgaaatatgaactcgaccagctggtctcatttcggatcccttactacgtggggccattagttactcccgaggtgcagaaggcaacaagcggagccaaattcgcttgggccaagcgaaaagaagacggcgagattaccccttggaatctgtgggataagatagacagagcagaaagtgccgaggcttttatcaagaggatgactgtcaaagatacatatctactcaacgaggacgtgctgccagccaattctcttttgtaccaaaagtataacgtactgaatgaactcaacaatgttcgcgtgaacggccggagactgtccgtcgggattaaacaggatatctacagcgagcttttcaagaaaaagaagaccgtgaaagcatcggacgtcgcgtctctggtgatggctaagacgaggggagttaataaaccctccgtggaaggtttgtcagatccgaagaaatttaacagtaatctcgccacctatctggacttaaagagcatcgtaggcgataaggtcgacgataactgctaccagacagacctggagaacattatagaatggcgctccgtgttcgaggatggggagatctttgcagacaaactaactgaagttgagtggctcaccgacgaacagcgatctgccctggtgaagaaacggtataagggatggggccgtcttagcaaaaagttgctgacaggtattgtcgatgagaatgggcaaagaatcattgacctcatgtggaacactgatcagaatttcatgcagatcgtgaaccagcctgtatttaaggagcaaatagaccagctgaatcagaacgctatcaccaatgatggcatgacattaagggaacgcgtggagtcagttctggacgatgcctacaccagtccccaaaacaaaaaggcaatttggcaggtcgtgcgggtggtcgaagacatcgttaaagctgtgggaaatgccccaaagtccattagcatcgagttcgcgagaaacgaaggcaataaaggggagataactaggtctcgacgcacgcagcttcagaagttgttcgaggatcaagcccacgaactcgtgaaagacacatcactgaccgaggaactagagaaggctctggatctcagtgaccggtactatctgtactttactcagggaggtaaggatatgtataccggcgaccctattaacttcgacgaaatcagcacaaaatacgatattgaccatatccttccccagtcctttgtaaaggatgactctttggataatagagtcctggtgtcgagggcagagaacaataaaaagagcgaccgtgttccagccaaattatatgctgccaagatgaagccctactggaaccagctcctgaaacaagggcttataacccagcgcaagttcgagaacctgactatggatgtggaccagaatatcaaatatcggtccttgggatttgtcaagagacagctcgtggaaacaaggcaagttattaaactgacggcaaacatcctaggctcaatgtaccaggaggcgggtaccgatattatcgaaactcgagccgggctgacaaagcagctccgggaggagttcgacctgcctaaggtgcgcgaagtaaatgattaccaccatgctgtcgacgcctatcttaccacatttgcaggccaatacttgaacagaaggtatccaaaactgcggagtttctttgtgtacggagagtatatgaagttcaaacgaggctctgacttaaagctcagaaattttaacttctttcacgaactgatggagggggataaaagccagggaaaggtggtcgaccagcagactggtgaacttataaccacgcgcgatgaggttgctaagtccttcgacaggctgctaaatatgaaatacatgctcgtgtcaaaggaggtacatgatcgtagcgaccaactgtatggcgccaccattgtgacagcaaaagaatctgggaagttgacttccccgatcgagatcaaaaagaaccggcccgtcgatctgtacggagcctacaccaatggcacaagtgctttcatgactattatcaagtttaccggtaacaaacctaagtataaagtgattggggttccaacgacaagcgcggtgggcttaaagagagtcggaaaacccggctctgaatcctacaatcaggagctccacaggataatcaagtcaaaccctaaagtgaagaaggacttcgaaattgttgtgccacacgtcagttatagccagctgatcgtagatggggactgtaaatttacccttgcctcggatacttaccagcatcccgcaacacaactggtgttgtccaaggagtctatggagattatcgctgacgatttcaaatttgttaaggaaaatccggccaccgccgacgagcagctcgtgcgcgtcttcgacgaaatagtgaaccagatgaatcactattttactatcttcgatcagcgaagcaacagacaaaaagtaaccaaggctcgggacaagtttgtgtcactgcctacagagagtgaatacgagggagccaaaaagacgcaggtcggcaaaaccgaggttattactaacctactgatgggtcttcatgcaaatgcggctcagggggatctcaaggtgctgggattgtccacattcggctttttccagtctagcggtggcctgaacttatccgaagacgccatgatcgtgtatcaatcaccaaccgggctattcgagaggcgcatttgcctgaaagatatctga

SEQ ID NO: 3211 - RNA, 4146 nt, synthetic construct
  misc_feature 1..4146: note = Cas9 variant
  source 1..4146: mol_type = other RNA
atgaagcagatcctgaaaaaggtgcaaggctacaacattgggctcgacataggaaccaatagcgtcggttgggttgtgacagatgagaacgccaatcttctgcagttcaggaaaaagaacatgtggggcgctagattgtttgaaaaaggggacactgcacagggacggcgcttatcccgatctacgcgtagaaggtatgatcggcgcagacagaggatccactacctgcaagagatgctagccaccatggtactccccattgacgaatcattctttatccggctgaatgaggcgttcctttggaaggaagataagagtgtgcagcgcgactatattctgtttgctgataaacagttcacagaccgagatttttacaagcagttcaaaactatctatcatttgagaaagtttctcctggacaccaaagagaaggccgatcctaggttcatatacctggcactccaccatatgatcaagtatcggggcaactttttataccaaggtcagagcttcgacgtcgtggagaatgttcaggaatcctttcgtgtgctgcttgaggaaatgtacgagcagttggggaaagagtgggaatatggagagcacttcgatgacattcaacgcatcctggaaaacacaaccattggcaagaaatctaagcaggagcagatcgccgctatactaactgaacaatacggcaataaaaagctcgcaaacgaggtcacaagagcctgcctggggtattcgttcgaccttaccgtggtaatggagaatgaaaacctgttggatgagtcaggaaagaagattaagatcagctttagtgactccaaatacgaagaacaggaactcgagctgcagaataggttagaggaaaagttcgctgttattgaggccctgaaacggatctataactggctcgtgcttaaggatacgctgcgaggtaaaaagtacatctctgaagcgatggtcaataagtatgaggcacatcacgaagacttggtgaaactaaagcgcctgtttagaacttacctcagcaccgaggagtactcctgtttctttaggaaagaaaagcagaaagataagtatatttcaaactacgtgaactatcggaagggcgccgagcgctgcagtaaagaaaagctgtacaaagctatacacgagcttttcgacacagtcgccaaggatgacgttgtgtatcaagagatcgtagagaaaatggatcagggggagtttctgactaagcagaatgaagtgagcaacgcatacattccatatcagtgtaatgaggtcgaaatgaagagaatcttgaaacaacagggagagttctacccggagctcaaggaaaacgctgacaaaatactgcagttactgctatttaggattccctactatgtgggccctctcgttgatgagaagcagtctaaattcgcctggatgaagcgtcggaccggtatggaacaagtgaaaatctacccatggaattttgagcaggtcgtggacatcgaccagacagcggaagccttcattacccgaatgacgaactattgcacttacctgcccgaggagaaggtacttcctaagcagtccttgctgtattcagaatacgagctcctgcaagaacttaataaaatcaagattaacgggaaatttagcctggagacaagaaataagataatcgaacagttgttcaaaaagcagaagaaagttaccgagaagcaactcaaaaagtggctggtgagggagcagtattgtactacaaaagtcaccgaaaagatggtgaagttagatgagaacgcatactacattacgggattccagaaagaaaatgagtttgctagttctctgacctcctatatcgacttcacaaagatcctaggcgagattactgaacgcaaccggaaaatgatagaggaaatcatttactggctcaccgtctttgaggaaaagagcatcgtgaaaagaaagattcagaagaaatatggcaatgagatcaacgataagcaactggcccagatacttaaattgaattactcggggtggggaaggttctctgagaagtttctgaacggtatcaaaggcttcgaccgccaggggcagaagaaaacaattatggaactcctgcgagaggattcccggttactgaacatcatgcaaattatcaataacgaagagatgggattttgcaagataattgaagctaatcagaagaaactttatggcaacgagaatttgctcgacgttgtgcaggagctgcatggttcaccagccatcaagcgtgggatttggcagagtctaaaaatcgtagaagagataatcagcattatgggcggagtcccccaaaacatcttcattgaatttgcaagagaggatgacgatagggtgcgcactaattcccgggttaagcagatcgaaagactgtacaaaaagttcaaggaggaggtgaacgactttaatgaacacgccgctaacgagctcaaagaaaagaggtatcagaatcgaatagatgaggagaaagtcttcctgtactttatgcaaaacggcaagtctctttacagcggggtgaccttggacattgatcgcctgaatgaatatgaggtagaccatatcatccctcggacattagtgaaagacgattcactcgaaaacaaggcgctggttcttaagggagagaatcagagaaaaggtgaaggcctgattccacacgagtggcagaacaggcagaaggaggtctggaaaaagttgctcagttgtgggctgatgggcaaaaagaagtacgcaaacctatgcaaagaatccttcggaaatgagaaggaacaaaaacacttcatcgcccgtcagattgtggagacccgccagataatcaaacaggtggctaacattctggcccaatattaccagggtgtcaatgttgcagccgtgaaagctagcctcgggtctgaactgcgggagaactatactatcgagaagaaggacgataatggctttttcatggaaaacaaatcatacacgatgcttaagagtagaaaaattaatgactttcatcacgcccaggatgcatatttggcgtgtgctgtgggactgtacatcaaggccgcattcccgaaatacgagaaggaaatagactatgagggctacaggaaatattaccagaagaagaaccaacagaaagatggggtacgaaatgaaaagcggcagtttttcagctatgtcatgtcccgcttttctgagcagatcgtggacaaagagacaggagaaattttatgggatggtacccaaaagctcgcctacatcaaaaagattttcggctatagagactgcctgatcactaagaaacttgaggaaaacaccggggagttttacaagcagacaataaatgctaaacccgagaagggaaaagaaaacaataccaagctgctacctattaagaaaggcctctcggttgagaagtacggtgggtatcagggcggagaagccgcatacagctgtctggtgaggtatcaacagggccggaaaactaagttgtccctggagaaaatctcagtcatcattgctaagaagatagccgaaaaagaggtgagtttagatcgatacctcaaggagaaactgggggttgaagagatcgtgattcttagaaagaaagtaatgaagaaccagctgatcgaagactctgatggaaatcgcttctatttgacagcggccacggaggtcgtgaacgctaaacagtttattctcgacggcaagcatcaacatctgctaaggaccatcgcaataatggaaaagggtgagtactatgggtaccgtctggacgagcttgaaaacagcatggatgagctctacgcctattaccggatgaaaatccagcagcagtatccagcttacgaatccattgtgaagaaaatcgtcgagtcacacgtttatgaaagcctgcacgtggaggagaagattaaagccgtacaagaaaagggaaagttcttgatccagctgttaagactcactgaggcaaatgcggaatgcatagacctgaaaacaatttctgatggcaggcttgccgaccgcatcggtcgaaagaaccactacaccatcaaagagggcattaagttcatcgatcagtccataacagggctgtatgagagatacatgactgtgtga

SEQ ID NO: 3212 - RNA, 4146 nt, synthetic construct
  misc_feature 1..4146: note = Cas9 variant
  source 1..4146: mol_type = other RNA
atggactacgtgaaggagtatcacatcggcctggatattgggaccagctccataggatgggccgtcacagactctcagttcaaactcatgagaatcaagggtaaaactgctattggcgttaggctttttgaagaggggaagacggcagccgaacggcgcaccttccgaacaactcgtagaaggctgaaacggcgcaagtggagattgcattacttagataagatctttgcgccccatctgcaagaggtggacgaaaacttcctaaggcggctcaaacagtcaaatattcaccctgaggatccagctaagaaccaggcctttatcggaaaactgcttttcccggacctgttgaagaaaaatgagcgcggctatcccaccctcataaagatgcgagatgaactgcctgtagagcagagagcacactacccagtgacaaacatctataagctgagggaagccatgattaatgaggaccggcaatttgatctccgtgaggtctacttagctgtgcatcacatcgttaaatatcgcggtcacttcctgaacaatgcaagtgtggacaagtttaaagtcgggagaattgatttcgacaagagctttaacgtgcttaatgaagcctacgaggaattgcagaacggagagggctccttcaccatcgaaccctctaaagtagagaagataggccagctgctactcgatactaaaatgaggaagctggaccggcagaaggctgttgccaaacttctggaggtgaaggtcgcggacaaagaagagacaaagcgaaataaacaaattgcaaccgccatgtcgaagttggtgctcgggtacaaggctgattttgccacggtggcaatggctaacggaaatgaatggaaaatcgacctgtcaagcgagacgagtgaagatgagattgagaagttccgcgaagagttatccgacgcccagaacgatatcctgaccgaaatcacatctctcttcagccagattatgcttaatgcgatagtccctaacggtatgtccatctcagagagtatgatggacagatattggactcatgaaaggcagctggccgaggttaaagagtacttggcaacccaaccagctagcgcccggaaggaatttgatcaggtgtataacaaatacattggccaggtacccaaggagaaggggttcgacctagaaaaaggactgaagaaaatcctctctaagaaagagaattggaaggagatagatgaactgcttaaggctggcgactttctgcctaaacaacgcacatccgccaacggtgtgattccacaccagatgcatcagcaggagttggatagaatcatcgaaaagcaagcaaaatattacccgtggctcgccaccgagaatcccgctacgggggaaagggaccgtcaccaggcgaagtatgagctggaccagttagtctcattccggattccttactacgtgggaccactggttactcccgaggtgcagaaagcaacaagcggcgccaagtttgcttgggccaaacgaaaggaagatggcgagatcaccccttggaacctatgggacaagattgatagagcagaaagtgccgaggctttcataaaaaggatgactgtcaaggacacatatctcctgaatgaagatgtgcttccagccaactctttgctgtaccaaaaatataatgtactcaacgagctgaataacgttcgcgtgaatgggcggagactttccgtcggaatcaagcaggacatttacaccgagctgtttaaaaagaagaaaacggtgaaggcaggcgatgtcgcgagcttggtgatggctaaaaccaggggtgttaacaagccctcggtggaagggctctctgacccgaaaaagttcaattccaacctggccacatatttagatctgaagtcaatcatgggagacaaagtagatgacaatcgctaccagatggatctagagaacatcattgaatggcgaagtgtctttgaggacggcgaaatattcgcagacaagctcactgaggtggagtggctgaccgatgaacagcggagcgcccttgttaaaaagcgttataaaggttgggggagattgtccaagaagctgctcacaggcatcgtggacgagaacggacaaaggattatcgatctgatgtggaatactgaccagaactttatgcagattgtcaatcagcctgtgttcaaagaacaaatcgatcagttaaaccagaaggctataaccaatgacggcatgacactgcgcgagcgggtagagtctgtgcttgatgacgcctacaccagcccccaaaacaaaaaggcaatctggcaggttgtcagagtggtggaagatattgtcaaagctgttgggaatgccccaaagtcaatcagtattgagtttgcgaggaacgaaggaaataaaggtgagatcactcgatcccgccggacgcagttgcagaaactcttcgaagaccaagcccacgagctggtgaaggatacaagcctaaccgaggaactggagaaagctcctgacctctctgatagatactatttctactttactcagggcgggaaggacatgtataccggagaccccataaacttcgatgaaatttcaacaaaatacgacatcgatcatattctgccacagagttttgtgaaggacgatagccttgacaatagggtattggtctcccgtgcagagaacaataaaaagtctgatcgcgtgcccgccaagctgtatgctgccaaaatgaagccttactggaaccagttactcaaacaaggcctgatcacccagcggaagttcgaaaatcttactatggacgttgatcagaacataaaatatagatcgctgggttttgtgaagaggcagttggtcgagacacgacaagtgatcaagctcacggcaaacattctggggagcatgtaccaggaggcgggcaccgacatcattgaaactcgggccggactaacaaaacagctgcgcgaggagttcgatctcccaaaggttagagaagtgaatgactaccaccatgctgtagacgcctatctgaccacatttgcaggccaataccttaacaggcggtatccgaaattgcgatccttctttgtctacggggaatatatgaagttcaaacacggatcagatctgaagttaagaaattttaacttctttcatgagctcatggagggtgacaagagtcagggcaaagtggtggatcagcagactggggaactgatcaccacgcgcgacgaggtcgctaagtctttcgataggcttctgaatatgaaatacatgctagttagcaaggaagtgcacgaccgttccgatcaactctatggagccaccatagtaacagcaaaagagtcaggcaagctgactagccccattgagatcaagaaaaaccggcctgtggacttgtacggtgcctacaccaatgggacatctgctttcatgactatcattaagtttaccggcaacaaaccaaagtataaagtcatcggagtgcccacgacatccgcggttggcctgaagagagtggggaaacctggaagtgaaagctacaatcaggagttacacaggattataaagtctaacccaaaggtcaaaaaggatttcgaaatcgtggttccccatgtgtcctattcacagctcattgtcgacggcgattgcaaatttaccctggccagtgacacttaccagcacccggcaacacaacttgtactgagcaaggagtcgatggaaatcattgctgatgacttcaaatttgtgaaggagaatcctgccaccgccgacgagcagttggttcgcgtgttcgatgaaatcgtcaaccagatgaatcattattttactatattcgaccagcgatccaacagacaaaaggtgaccaaagctcgggataagtttgtatctctcccaacagagagcgaatacgagggtgcaaagaagactcaggtggggaaaaccgaagtcatcactaatctgctaatgggactgcacgccaacgcggctcagggcgaccttaaggttctcggtctgtcaacattcggctttttccagagttccgggggattgaacctgtctgaggatgccatgattgtgtatcaaagccccaccggcttattcgagaggcgcatctgtctcaaggacatttga

SEQ ID NO: 3213 - RNA, 4146 nt, synthetic construct
  misc_feature 1..4146: note = Cas9 variant
  source 1..4146: mol_type = other RNA
atgaagaaaagctacgccatcggcattgacatagggaccaactccgtgggacactgcgtcatgtatacagagaattacaaggttccctctaaaaagatgaaagtgttcggtaacactgaaaagagatatatcaagaaaaatctgctcggcacgcttctgtttgatgaggggaacaccgctgaaaataggcggttgaagcgcacagcacgacgtagatacactaggcggcgcaacagaattttatatctgcaggagatcttcgccgaagagattaataaaatcgacgattcatttttccaaaggctagacgatagttttctcatagtagaggacaagcagggaagcaaacatcctatcttcggcaccctgcaggaagagaaggaataccacaagcagtttccaacaatttatcatcttcggaaacaactggcggattcctctcagaaggctgacatccgcttgatttacctcgccctggcacacatcataaaataccgaggtcatttcctgtttgagggggatctcaagtcggagaacaaagacgtgcagcacttattcaatgattttgtcgaaatgttcgacaagaccgtggagggatcatatctgagcgaaaaccttccgaatgttgccgatgtgttggtcgagaaagtgagtaagtccagaaggctggaaaacattctacactactttcccaatgagaagaaaaacggcctcttcggcaatttcctggctcttgcactggggttgcagcctaactttaagactaacttcgagctcgccgaagacgctaaaatccaattttctaaggagacatatgaagaggacctggaagagttactgggaaaaattggtgatgactacgccgatctcttcatcgcgaccaagagcctttatgacggcatcctgttggcagggattctatccacgactgattcaaccacaaaggccccactgagtagctctatggtaaatcggtacgaggaacatcagaaagacctcgctctgcttaaggattttatacgtcagaacctgtccgactcatataaagagttctttaatgatactttgaaggacggatacgccggctacatcgaaggtaaaaccacacaggagaacttctatcgctttattaagaaggcaatcgaaaagatagaggggagcaattacttcattgataaaatcgacagagaggactttctcaggaaacaacggaccttcgataacggaagtatcccccaccagattcatctgcaggaaatgcacgctatcattcgacgccaagccgagttttatcctttcttagttgaaaatcaggacaagatagagaaaatcctgacgttcaggattccatactatgtgggccccctagcgagaggcaagtctgagtttgcctggctcaagcggaaatccgatgaaaagatccgcccttggaacttcgacgagatggtcgataaagaaactagcgcagagaattttatcacaagaatgaccaactacgaccagtatctgccagatcagaaggtgcttccgaaacactcgttgctgtacgaaaagttcgctgtgtacaatgagctcactaaagtcaggtatgttacagagcaagggaagtctttcttctttgacgccaacatgaagcaggaaattttcgatggagtgtttaaagtataccgtaaggtgaccaaagagaagctgatggacttccttggtaaagaatttgatgagttccggatagtcgacctgatgggcttggataaggacaataagtcctttaacgcttcactcgggacgtatcatgacctgaaaaagatcgtgagtaaagatttactggacaatcccgaaaacgaggatattctagagaacgttgtgctcaccctgacacttttcgaagaccgagagatgatcagaaagaggttggaaaaatacaaggatgtcctgactgaggaacagcgcaagaaactcgagcggagacactataccggatggggcaggctgagcgccaagttaattaatggtatccgcaacaaaacaactcgaaagaccatactggactaccttatcgatgacgggacatccaatcggaacttcatgcagttgattcatgatgacaccctctcttttgtggatgagatccgtctggcacaaggcagcggagaagccgaggactatagaactgaagtacagaatctagctggcagccctgcgattaaaaaggggatcctgcagagtctcaagatagttgatgagctgattggagtgatgggttacaacccagagcacgtcgtggtcgaaatggcaagggagaatcagttcacgaaccaaggccgccggtccagccagcagagatacaaaaagatcgaaaatgccattaaaaaccttgactctaatttgaactcaaagatcctgaaagagtatcccacaaataaccaggctttacaaaatgacaggctctttctgtactatcttcagaacgggaaggatatgtacaccgacgaagaactggatatagaccagttgagtcaatatgatatcgaccatattatccctcaggccttcattaaagatgacagcctcgataacaaggtgctgactaagtccgccaaaaatcgaggaaagtctgacgatgttccatcgctagagatcgtgcacaaaaagaaaaacttttggaagcagctgctcgacagccagctgatatcccaacgcaagttcgacaatcttaccaaagcagaacggggcggtttgacaaacgaggataaggctagatttattcagaggcagctggtagaaacccgtcagatcactaaacacgtcgcccgcatcttagacacacggttcaatacgaagctcgatgacgcagggaacagaattagggatcccaaagtgaatatcattaccctgaagtcaagtcttgtttctcaatttcgaaaggactaccagctgtataaagtgcgggagataaacaattaccatcacgcgcatgatgcttacctaaacgccgtcgtggcaactgccctcctgaagaaatatccgcagttggctcctgaatttgtatacggcgactatcccaagtacaatagctataaatcccgcaagtcagccacagagagagtgctgttttacagcaacatcatgaatttcttcaagagggttgtcaaatcttccaagaccggaacagtgaaaattcggccaatcattgaggtgaacaaggaaactggcgagatcgtctgggataaaaagagtgactttcgaaccgttagaaaggtgttaagctatcctcaggtgaatgtagtcaaaaagacggaagtgcaaaaccacgggctcgatcgcggaaaacccaagggtttctacaacgcaaatctgtctccaaggcccaaagagggctccgttgaaaaccttgtgcctgctaagcagtcatttgacaccaaacgttacgggggatatgccggcataagtaatagctacgcggtcctggtgaacggtatcattgagaaggggaagaaaaagtcgaaagccgaggttacagagttccagggcatctccattttggctcggaaggattttgagaaaaatccaaagcaatatctcctgaacctaggatacaaggacatcaaatctataattaagctgccgaaatatagccttttcgaactcgagaatggctcaagaaggatgctggcaagtatcttgtccactaacaataagcgcggggagatccacaaaggaaacgaaatgtacctgcccgacaagtttgtgaccttactctatcatgccatgcgagtaaatagaacactggagcctggccacaagaaatacgtcgaaactcatcggcacgtgttcgatgagcttctgacctacattttggaatataacgagaagatagtgggtgctaaagccaatgggaagaggatcgtcgaggcatactctgcgcgcaaagacacggataacctcgaggaactgtgtaatagctttattaacctactgaatcttacagccctcggatccgctgttgacttcgaatttctgggcaccaagatcccacgttatagagattacactccctcatcattgttaaaggccacactgattcatcagagtgtgaccggtctctatgagactcggatcgacctgtctaaacttggcggggattga

SEQ ID NO: 3214 - RNA, 4146 nt, synthetic construct
  misc_feature 1..4146: note = Cas9 variant
  source 1..4146: mol_type = other RNA
atgaagaaaatcattggcctggacctcgggaccacaagcataggatgggcctacgtgcacgaggctgaatccgcacaggagagatctgaaatcgtcaggcttggtgcccgggttgtgcccctgactacggatgagcaagacgagttcaagaaaggcaagtcaattaccacaaacgcggctcgcttgagtaaacgatcattacgtagaaatgccgataggtttcagctgcggcgcgacgaactagcaggggtaatgaaggaggccggatggatcgatgaaactaccgtgctcgctgagcagggccctagatccacattcgaaaccctgaggcttcgggcaaaggccgcttctgaggaggtcactctggccgaatttgcgcgcattttgctccagatcaaccgaaaaagaggttataagtcgaataggaaaacagacggggatgaggaaggagcactgatagacggcatggatgtgtcaaagcaactgaacgccagcggccagaccccaggggagtgggttctcgctcggatgcaggaaggaaatgccgtgatcccggcattctactgcagtgacttatccgaggagctggatcgtatttggcgcaaacagcaggcttctcatcaagcctggatgacggaggaacttcacactgtcttgagacatgcggacggtaggagcgccatccggctgatggataaggcaggcgtggtacccgactccgttaacgtgaaggaacgacgcagagtcatgtatgagtggagggctgccgctgtgcgggactgtctacctgccgggcgcgtggcagccgctctcatgcaggtctcaaaagaaattggcagagcggatagttacctgggaaggatcggtgaccgtagcaaggagctttattttcaccggcagaccgttgggcaatacctgtggcgattgatatgcgataatccaaaccagtctctcaaaaatctggtgttctatagacaggactaccaacatgagtttgaaacattatggtccattcagactaagtaccacgtagagctgaccgaagatctcaggaaacgcgtgggacggatcattttctttcagagaccccttaagagcaaaaagggcctggtcaacaggtgtgagttggtgcactatagcgtttgcgaaaatagtggcgacgatctaacagagaaggtggacgtcgggcctaaagtgtgtccaaagtcttccccactgttccaggagtttaaagtatggcaagttctcaacaatgtggaagtcatccatcctagcacccaggaggcacgccgactggaaatggaggagaaggaacttctggcctcggagctactcttccgggatcgtatgaaaaagatcgacgtgctgaagttactgttttctaactggagagatctagacctcaattacaaagaactggagggaaacaggacgatggctgccttctatcgcgtctacgaacaggtgattgcacagactggtcacggcgactatgatttcgccaagatgcgggctgccaaagttaaggagcttgcagagggggtgtttgcgggattgggcttcgaagtaggtctgctcacatttgacgctgagctggattccccagcctacgaacaacagccgtgctatagactttggcatctgttgtactcatacgagggggacaaaagtgcaaccggcaacaagtgtctcctgaagaaattatgcaggctgactggaatgaatgccgaattggtcggcctcttcatgcagatacgatttagcggggattatggatccctgtctacaaaggctatgcgccggatccttccctacttgaaagccggtaacacctatgacgtggcatgtgagtacgctggcttcagacacagcgccaggtcactgacgcgtgaggaactcgcgcagaaggagtataaagattacctggacttactgcctcgcaatagtcttcggaacccagttgtggaaaagattttgaatcaaatgatccacgtcgtgaacgggctctccagcacctatggaaagcccgatgagataagagtagaaatggccagggagctgaaaaagtctgctcgagagcgggaagagatgacatcagcaattagtaaaactaccaaggaaaatgccgagatcacagctatcctacagcgcgactttggcctgagatacgtgagcaggaacgatattctccggtacaaactgtattgcgagcttcgaatcaagggtaatgggtgtagaactttgtactccaacacctatattaatcctaacgaactgttctctcgcgagtttgacatagaacatatcattccacagtcgaggttattcgatgacagcttttccaataaaacactcgagtcacgtaccgccaacctggaaaagggcgaccggactgcatgggattacgttaatgagaagtatggagcggagagagccgacgaatacagggctcaggtcgaggccctttatcgcgatggcacgatcagtaaagcaaagcgagacaaactgttgatgcccggggataagatcccggaagacttcattgatagagacatacggaacacacaatacatcgctaaaaaggccctcgagatttttgaagatttcgtgccttctgtggtcgcaaccagcggaaacgttactgccaggctgcgcgaggactggggtctagtggatgtgatgaaggagctgaattggtccaaatacgaatcacagggcatggtacacatcgagtatgaccgtgatgggagacccattcggaggatcgtcgactggaccaagcgcaacgaccatcgacaccatgctatggatgcgctcgccgtggcattcacaaaaagaagctacatacagtatctgaatcaccttaacgctcggaaggaagccacctctgttgcctacgctatccaacacaaagagatggaattggacggatccaataggtggcgctttaagtgcccattcggcgatagaagtgcatttaggcgggaggccaaggcgcagctggagcgtattttagtgagcatcaaatctaagaacaaagtcctcactccttccgtgaatcgcacaaagaaacgaggtgggttcaacaagaaggttgaatggacgcccagaggcgctctgcataatgagaccgtgtatggaaggattcggcgctacgacgtaaaagaacttagagtcggctcaagttttactgccgaggtgatcgggaaggtggcagatagcaggtatcgggccgctctgatgcaccgactagcagagttcggaggcgaccccaaaaaggcctttacaggtaaaaactcgctcgaaaagaatcccctgtacaccgatgaggcgcatacagcttgcgtcccttcctctgttaaagtggtgagcttcgtagaaatagggactattagaaagggagtcgacccaaacttgaatgtggataaggttgtggacacccacatcaaaaacattctgttagcccgcctctcagcatacggcggtgatgccaagaaggcttttagtaatctggacgccgacccgatctggcttaacaaagagaaaggcatagcaatcaagagggtcacgatttccgatgactctgaagtgcggcccatccacgttaagcgtgatatgagagggaggctggtgtgtgacgagcatggacgccctgtcccaagcgattatgtacagttgcggaacaatcaccatgtggctattttccgagacgccaacggcgagctcaaagaaagagttgtgacctttttcgaggcggtcgaaagggtgcgccagctgcggtccgaggggagagccgtagaagtgatcgataagaattacaaatgcgaggagggatggacatttctattctcaatgaagataaacgaatatttcgtctttcccgacgcagctagcggcttcgatcctcgtgagattgacctgactgatccagccaattacgctcttatcagtccccacctctttagggttcaaaaactgtcttccaaggactattacttccggcatcacttggaaaccacagtgaacgatgtgaagcagctgcgcgacatcacttggaaacgaattagctcgttacaggacctcgcaggtaccgtcaaggtgagagttaatcacatcgggcagattgtagccgtgggagagtattga

SEQ ID NO: 3215 - RNA, 4146 nt, synthetic construct
  misc_feature 1..4146: note = Cas9 variant
  source 1..4146: mol_type = other RNA
atggtgaagaaaaagtacgccatcggcattgacatagggaccaacagcgtcggatggtccatcgttacagatgactataaagtgccctctaagaaaatgaaggtattcggtaatactgagaagagatacattaaaaagaacctgctcggcacgcttctgtttgatgaagggaataccgctgagaacaggcggttgaaacgcacagcacgacgtagatatactaggcggcgcaatagaatcttatacctgcaggaaattttcgccgaggaaatcaacaagatagacgattcatttttccaaaggctagacgatagttttctcatcgtggaggacaaacagggaagcaagcaccctattttcggcaccctgcaggaggaaaaggagtatcataaacagtttccaacaatctaccaccttcggaagcaactggcggattcctctcagaaagctgacattcgcttgatctatctcgccctggcacatataattaagtaccgaggtcacttcctgtttgaaggggatctcaaatcggagaataaggacgtccagcatttattcaacgattttgtggagatgttcgacaaaaccgttgaaggatcatacctgagcgagaatcttccgaacgtggccgacgtcttggtggaaaaggtaagtaagtccagaaggctggagaatatcctacactattttcccaacgagaaaaagaatggcctcttcggcaacttcctggctcttgcactggggttgcagcctaattttaaaactaacttcgagctcgccgaggatgctaagattcaattttctaaagaaacatacgaggaagacctggaggaattactgggaaagatcggtgatgactatgccgatctcttcatcgcgaccaagagcctttacgacggcattctgttggcagggatactatccacgactgattcaaccacaaaagccccactgagtagctctatggttaaccggtatgaggagcaccagaaggacctcgctctgcttaaaaattttatccatcagaacctgtccgattcatacaaggaagtgttcaatgacaaattgaaggatggatatgccggctacattgagggtaagactacccaggaaaacttttaccgtttcatcaaaaaggcaatagagaaaattgaagggagcaattattttatcgacaagatcgaccgcgaggatttcctcagaaaacaaaggacatttgacaacggaagtattccccaccagatccatctgcaggagatgcacgctattatacggcgacaagccgaattttaccctttcttagtcgagaatcaggataagatcgaaaagattctgaccttccgcatcccatattacgtgggccccctagcgagaggcaaatctgagttcgcctggctcaacaggaagtccgacgagaaaatccggccttggaattttgatgaaatggtggacaaggagacgagcgcagaaaacttcattactcgcatgacaaattatgatcagtacctgccagaccagaaagtccttccgaagcactcgttgctgtatgagaaatttgctgtttacaacgaactcaccaaggtgagatacgtaactgagcaagggaagtctttctttttcgatgccaatatgaaacaggagatatttgacaggacattcaaggtgtatcgtaaagtcaccaaggaaaaactgatggattttctttccaaggagttcgacgaatttcggatcgtggatctgttgggactcgacaaggacaacaaatcattcaatgctagtctgggtacgtaccatgatttaaagaaaattgttagcgaggactttctggataactccgaaaacgaggacatcctagagaatgtggtcctcaccctgacacttttcgaagatcgagagatgattagaaagaggttggaaaaatataaggacgtgctgactgaggaacagcgcaagaaactcgagcggagacactacaccggctgggggaggctgtctgccaagttaatcaacggaatacgcgataaagtaacacgaaagactatcctggactatcttattgatgacggcaccagcaatcggaacttcatgcagttgatcaatgatgacacactctcatttgttgatgagattcgtctggcacaaggtagtgggaaagccgaagactacagagctgaggtgcagaacctagcgggctcccccgcaatcaagaagggaatactgcagagcctcaaaattgtcgacgaactgatcgaggtgatgggctatgatcctgagcatattgtcgtggaaatggccagggagaatcagttcaccaaccaagggcgcagaaattctcagcagcggtacaagaaaatcgaaaacgctataaagaatcttgactcaaacttgaatagtaaaatcctgaaggagtacccaactaacaatcaggccttacaaaacgataggctctttctgtattaccttcagaacggaaaagacatgtatacggatgaagaactggacattgatcagttgagccaatacgacatcgatcacattatcccccaggcattcataaaggacgattccctcgacaataaggttctgacaaaatctgccaagaaccgaggtaaatcggacgatgtgcctagcctagagattgtatataagaaaaagaatttttggcagcagctgctcgactcccaactgatctcacagcgcaagttcgataaccttaccaaagctgaacggggcgggttgactaatgaggacaaggccagatttatccagaggcagctggtcgaaacccgtcaaattacaaaacatgtggcacgcatcttagatacccggttcaacactaagctcgacgaggcgggaaatagaattagggatccaaaagttaacataatcattctgaagagtaatcttgtgtctcagtttcgaaaggactaccagctgtataaagtccgggaaatcaacaattaccaccacgctcatgatgcctacctaaacgcagtggtagccacagctctcctgaagaaatatccccagttggccccggagttcgtgtacggcgagtatcctacgtacaatagctataactcccgcaagtcagcaaccgaaaaagttctgttttacagcaatattatgaacttcttcaagagaatcgtcgtgcactctaagactggtgaggtgaggatacggcccgtcatcgaagttaacaaagagacaggggaaattgtgtgggacaagaaatccaattttcgaaccgtgagaaaggtattaagttatccacaagtcaacgtggttaaaaagacagaggtgcagaatcatggcctcgatcgcggaaagcctaaaggcttctacaacgctaatctgagccccaggccaaaggaggggtctgtcgaaaaccttgtgcccgccaaacagtcctttgacactaagcgttacggaggttatgcgggcatctcaaatagttacgccgttctggtgaacgggattatcgagaaaggaaagaaaaagagcaaggctgaagtaaccgagttccaaggcatatcgattttggcacggaaagattttgacaagaatcctaaacagtatctcctgaacctaggttacaaggacatcaaatccatcattaagctgccaaagtattctcttttcgagctcgaaaatgggagcagaaggatgctggcctcaatattgagtacgaacaataaacgcggcgagatccacaagggaaacgaaatgtacctgccggataaatttgtcaccttactctatcacgctatgcgagtgaatagaacactggagcccggccataagaaatacgtggaagcccaccggcatgtcttcgacgagcttctgacttacattttggagtataacgaaaagatcgttggggcaaaggcgaatggaaaaaggattgtggaggcctactccgctcgcaaggataccgacaacctcgaggaactgtgcaactcttttatcaatctactgaaccttacagccctcggcagcgcagtagatttcgaatttctgggtactaaaatacctcgttatagagactacaccccatcctcattgttaaaggctacgctgatccaccagagcgtgacagggctctatgagacccggattgatctgagtaaacttggaggcgactga

SEQ ID NO: 3216 - RNA, 4146 nt, synthetic construct
  misc_feature 1..4146: note = Cas9 variant
  source 1..4146: mol_type = other RNA
atggtgaagaaaaagtacgccatcggcattgacatagggaccaacagcgtcggatggtccgttgtgacagatgactataaagtaccctctaagaaaatgaaggtgttcggtaatactgagaagagatacatcaaaaagaacctgctcggcacgcttctgtttgatgaagggaataccgctgagaacaggcggttgaaacgcacagcacgacgtagatatactaggcggcgcaatagaattttatacctgcaggaaatcttcgccgaggaaattaacaagatcgacgattcatttttccaaaggctagacgatagttttctcatagtcgaggacaaacagggaagcaagcaccctatcttcggcaccctgcaggaggaaaaggagtatcataaacagtttccaacaatttaccaccttcggaagcaactggcggattcctctcagaaagctgacatccgcttgatttatctcgccctggcacatatcataaagtaccgaggtcacttcctgtttgaaggggatctcaaatcggacaataaggatgtgcagcatttattcaacgagtttgttgagatgttcgacaaaaccgtggaaggatcatacctgagcgagaatattccggacgtcgccgatatccttgtggaaaaggtaagtaagtccagaaggttggagaacgttctgcagtattttcccaatgagaaaaagaacggcctactcggcaatttcctgtctcttgctctggggttgcaacctaacttcaaaactaattttgaactcgcagaggacgccaagattcagttcagcaaagaaacatacgaggaagatctggaggaattactgggaaagatcggtgacgattatgctgacctctttatcgccaccaagtccctttacgatggcattctgttggcggggatactatcaacgactgacagtaccacaaaagcaccactgtctagctccatggtgaaccggtatgaggagcaccagaaggatctcgccctgcttaaagacttcatccgtcagaacctgtcagatagctacaaggaagtctttaatgacgctttgaaagacggatatgccggctacattgagggtaagactacccaagaagatttctacaagtttgtgaaaaagacaatcgagaaaatagaagggagtgactatttcattgataagatcgaccgcgaggattttctcagaaaacagaggaccttcgacaacggatctatcccccaccagattcatctgaaggagatgcaagcaatcattatacggcaggctaagttttaccctttcttagaagagaatcaggataaaatcgaaaagattctgacgtttcgaatcccatattacgtgggccccctagcccgcggcaactccgagttcgcgtggctcaatagaaaaagcgacgagaagatcaggccttggaacttcgatgaaattgtcgacaaagagacttcggccgaaaattttataacacggatgaccaactatgatcagtacctgccagaccaaaaggttcttccgaaacactctttgctgtatgagaagttcgcagtgtacaatgaactcactaaggtacgctacgtgacagagcaggggaaatcctttttctttgatgctaacatgaagcaggagatcttcgacggagtctttaaagtgtatagaaaggttaccaaagaaaagctgatggacttccttggtaaggagtttgatgagttcaggattgtggacctgttgggcctcgataaagacaataagtcatttaacgccagtctggggacgtaccatgatctgaaaaagatcgtcagcaaagacttactagataatcccgaaaacgaagacattctcgagaatgtggtactgacccttacattgttcgaggatcgtgaaatgatccggaagcgactggagaagtataaagaagttctcactgaggaacagagaaagaaactggagaggcgccactacaccggatggggccggttatccgctaagctgataaacggtatcagagacaaagtgacaaggaagactattcttgattatttgatcgacgatgggacctctaaccgcaattttatgcaactcattaacgacgacacactgagcttcgtcgatgagatccgactagcccagggctcaggagaagcagaggactaccgggccgaagtgcagaatctggctggcagtcctgcgataaagaaagggattctccagtccctgaagatcgtcgatgagcttattgaggtgatgggatatgaaccagagcacatcgttgtggaaatggcacgtgagaaccaattcaccaatcagggtagaaggaacagccagcagcgctacaaaaagatagaaaatgccatcaaaaacttggactctaatctgaactcaaagattttaaaagagtaccccactaataaccaagctctccagaatgatcggctgtttctttattacctgcagaacggcaaggacatgtatacggatgaggaattggacatcgatcaactcagtcagtacgacattgatcatatcatacctcaggccttcattaaggacgacagcctggataataaagtactaacaaagtccgccaaaaacagagggaagtctgacgatgtcccatcgctggagatcgtgtataaaaagaagtccttttggaaacagctcctggacagccaacttatctcacagaggaagttcgataacttgaccaaagcagaacgaggaggcctgactaatgaggacaaggctcgctttattcagcggcagttagttgaaaccagacaaatcacaaaacacgtggccaggatgctcgatacccgtttcaacactaagctggacgaggcaggtaatcgcattcgggatcccaaggtcaacataatcacacttaaaagtaatctggtgtctcagtttagaaaggactaccagctatataaagtaagggagattaacaattaccatcacgcgcatgatgcttacctcaacgccgtggttgcaacggccctgttgaagaaatatccgcagctggctcctgagttcgtctacggggaatatcccacctacaatagctataactcccgaaagtcagccactgaaaaggtgttattttacagcaatatcatgaacttctttaaacggattgtggtccactctaagacaggcgaggttcgcatcagaccagtgatagaagtgaataaagagaccggagagatcgtatgggacaagaaatccgatttcaggacagtccggaaggtgctcagttatcctcaagttaacgtggtcaagaaaactgaagtgcagaatcacggcctggaccgagggaagcataaaggattctacaacgcaaaccttagccccagaccaaaggagggttctgttgaaaatctggtgcccgctaaacagtcctttgacaccaagcgctacggcgggtatgccggaatttcaaacagttacgcggtattggtcaatggcatcattgagaaaggtaagaagaaaagcaaggccgaggtgacggagttccaagggatctcgatactcgctaggaaagattttgacaagaaccctaaacagtatctgctaaatctgggctacaaggatattaagtccatcatcaaacttccaaagtattctctcttcgaactggaaaacggaagccgtcggatgttggcatcaattctgagtaccaataacaaaagaggcgagatacacaaggggaatgaaatgtacttaccggacaaatttgtgacactcctgtatcatgccatgagggtcaaccgcactcttgagcccggacacaagaagtacgttgagacccaccgacatgtgttcgatgaactgttgatctacattctcgagtataatgagaaaatcgtaggcgctaaggccaacggtaaaagaattgtggaagcatactccgcgcggaaggacacagataatctggaggaactatgcaactcttttatcaatctgcttaacctcactgccctggggagcgctgtcgacttcgagtttttgggaaccaaaatacctaggtatcgcgattacacgccatcctcattactgaaggccacactcatccaccagagcgtgaccggcctgtatgaaactcgtattgaccttagtaagctgggtggcgattga

SEQ ID NO: 3217 - RNA, 4146 nt, synthetic construct
  misc_feature 1..4146: note = Cas9 variant
  source 1..4146: mol_type = other RNA
atggtgaagaaaaagtacgccatcggcattgacatagggaccaacagcgtcggatggtccgttgtgacagatgactataaagtaccctctaagaaaatgaaggtgttcggtaatactgagaagagatacatcaaaaagaacctgctcggcacgcttctgtttgatgaagggaataccgctgagaacaggcggttgaaacgcacagcacgacgtagatatactaggcggcgcaatagaattttatacctgcaggaaatcttcgccgaggaaattaacaagatcgacgattcatttttccaaaggctagacgatagttttctcatagtcgaggacaaacagggaagcaagcaccctatcttcggcaccctgcaggaggaaaaggagtatcataaacagtttccaacaatttaccaccttcggaagcaactggcggattcctctcagaaagctgacatccgcttgatttatctcgccctggcacatatcataaagtaccgaggtcacttcctgtttgaaggggatctcaaatcggagaataaggacgtgcagcatttattcaacgattttgttgagatgttcgacaaaaccgtggaaggatcatacctgagcgagaatcttccgaacgtcgccgacgtgttggtagaaaaggttagtaagtccagacacctggagaatattctacactattttcccaacgagaaaaagaatggcctcttcggcaacttcctggctcttgcactggggttgcagcctaattttaaaactaacttcgaactcgccgaggatgctaagatccaattttctaaagaaacatacgaggaagacctggaggaattactgggaaagattggtgatgactatgccgatctcttcatcgcgaccaagagcctttacgacggcatcctgttggcagggattctatccacgactaactcaaccacaaaagccccactgagtagctctatggtgaataggtatgaggagcatcagaaggatctcgctctgcttaaaaactttatacaccagaatctgtccgactcatacaaggaagtcttcaacgataaattgaaggacggatatgccggctacatcgagggtaagactacccaggaaaatttttaccggttcattaaaaaggcaatcgagaaaatagatgggagcaactattttattgaaaagatcgagcgtgaggacttcctccgcaaacaaagaacatttgacaatggaagtatcccccatcagattcacttacaggaaatgcaagctatcattaggcggcaggccaagttctacccttttctggaggaaaaccaggataagatagagaaaatcctgaccttccgcattccatattacgtgggccccctagcgcgaggcaagtctgagttcgcctggctcaatagaaaatccgacgaaaagatcaggccttggaactttgatgagatggtggacaaagaaacgagcgcaaagaatttcatcactcggatgacaaactatgatcagtacctgccagaccaaaaagtccttccgaagcactcgttgctgtatgagaagtttgctgtttacaatgaactcaccaaagtgcgctacgtaactgagcaggggaagtctttctttttcgatgccaacatgaaacaggagatttttgacggagtgttcaaggtctatagaaaagtgacaaaggaaaagctgatggattttcttggtaaagagttcgacgaatttaggatagttgatctgttgggcctcgacaaggagaataaatccttcaacgcttcactggggacctaccatgatttaaagaaaatcgtgagtaaggactttctggacaacagcgaaaatgaggatattctagagaacgtcgtgctcacgctgacccttttcgaagaccgtgagatgatccggaagcgattggaaaaatataaggatattctgacagaggaacagagaaagaaactcgagaggcgccactacactggatggggccggctgtccgccaaattaatcaatggtataagagacaaggtaaccaggaagacaatcctggattatcttattgacgatgggacttctaactgcaatttcatgcaattgatcaacgacgataccctcagctttgttgacgagattcgcctggcacagggctcaggagaagccgaggattaccgagctgaagtgcagaatctagcgggcagtcccgcaatcaaaaaggggatactgcagtccctcaaaattgtcgacgagctgatcgaggtgatgggatatgatcctgaacatattgtcgtggagatggcccgggaaaaccaattcacaaatcagggtcgtagaaacagccagcagaggtacaagaaaatcgagaatgctataaagaaccttgactctaatttgaactcaaaaatcctgaaggaatacccaaccaataaccaagccttacagaacgaccgcctctttctgtattaccttcagaatggcaaggatatgtatactgacgaggagctggatattgaccaattgagtcagtacgatatcgaccacattatcccccaggcattcataaaagatgacagcctcgataacaaggttctgacgaaatccgccaagaatcgggggaaatctgacgatgtgccttcgctagaaattgtatataagaagaaatccttttggaagcagctgctcgacagccaactgatctcacagagaaaattcgacaaccttacaaaggctgagaggggaggcttgaccaatgaagataaagcccgatttatccagcgccagctggtcgagactcggcaaattaccaagcatgtggcaagaatgttagacacaaggttcaacaccaagctcgatgaagcgggtaatcgtatccgcgacccaaaagttaacattataactctgaagagtaatcttgtgtctcagtttcggaaagattaccagctgtataaggtcagagagatcaacaattaccaccacgctcatgacgcctacctaaacgcagtggtagccacagctctcctgaaaaagtatccccagttggccccggagttcgtgtacggggaatatcctacgtacaatagctataactccaggaagtcagcaaccgagaaagttctgttttacagcaatattatgaacttcttcaagcgaatcgtcgtgcactctaaaactggcgaagtgcggattcgccccgtcatcgaggttaacaaggaaacaggagagatagtgtgggataaaaagtccgactttagaaccgtgaggaaggtattaagttatccacaagtcaatgtggttaaaaagacagaggtgcagaaccatggcctcgatcgggggaaacctaagggattctacaatgctaacctgagcccccgaccaaaagaaggttctgtcgagaatcttgtgcccgccaagcagtcctttgacactaaaagatacggcgggtatgcgggaatctcaaacagttacgccgttctggtgaatggcattatcgaaaagggtaagaaaaagagcaaagctgaggtaaccgagttccaagggatttcgatcttggcacgcaaggattttgacaaaaaccctaagcagtatctcctgaatctaggctacaaggatataaaatccattatcaagctgccaaaatattctcttttcgaactcgagaacggaagcaggcgtatgctggcctcaatcttgagtacgaataacaagcggggcgaaattcacaaagggaatgagatgtacctgccggacaagtttgtcaccttactctatcacgctatgagagtgaacaggacactggaacccggacataagaaatacgtggagactcaccgccatgtcttcgacgagcttctgatatacatcttggaatataatgagaagattgttggcgccaaagcaaacggtaagcgaatcgtggaagcgtactccgccagaaaagataccgacaatctcgaggaactgtgtaactcttttattaacctactgaatcttacagctctcgggagcgccgtagatttcgagtttctgggaactaagatccctcggtatagggactacaccccatcctcattgttaaaggcaacgctgatacaccagagcgtgacaggcctctatgagacccgcatcgatctgagtaaacttggtggcgactga

SEQ ID NO: 3218 - RNA, 4149 nt, synthetic construct
  misc_feature 1..4149: note = Cas9 variant
  source 1..4149: mol_type = other RNA
atgaagaaaatcgtgaactacaatctgggcctcgacattgggaccagctccataggatatgccgctatcgatgaccagggtagacccgtcaggcaccaaaacaagacagttatgggcgtgcggcttttcaaagaggggaagactgcagaatctacgcgcatttttcgaggaacccgtagaaggctgtcacatcggcactggcgcttgggctacttagatagaatcttcgacaatgagattgccaaagtagatgaaaactttctgcctaggctaaaggcgagtaagcgggctcgcagcgacgagaaacgatccttcagaggttctctcctgtttccagaaacaggggatgacgcctattaccagaagtatccgactatctaccatcttaggtatgcactgataacccagaaaaagcagttcgatatccggttgatttacctcgccctgcaccatatgatcaaataccgtggaaattttctggacacaacccccgtgtcggctttcaacattcacgatatcgacctcactgatcaatttgcatcattaaatgactgctatcagctgcttgacatggatttcgagtttcagttcgacttgaacaatatagagcaggtccaaaagctgctactcgatgaaacactgagcaagaccaaacgccaggccgctgtgagtaaggttcttgtgatgtccacgggcaacaaagcctttgacgatcagcagaatggcattgcgtctgagttcatcaaggcactgctcgggggacctttcgacttgagcaaaattctgaacttatccgtcgccgatgtgaagtcatggaaactgcacatgactgacaaggatgtagacgataccctcaatagtcttgttgaggaactggacgagaaccataagcaaatcgtgaatttgctacagatgatctacagccaggtcatgatgctgggtctcctgaacggccaacagtctatttccgcttcaatgatagaaagatatgacgatcacgccaaacattgggcagctcttaagaaactgttgccagccctcggggagcaggaacagagcacaatcattcacgcgtacactgcctataccggacacagtaggacaaagcaactgtctcgggcagagttttacaccaaagtgaactccatcttaaagaagcatgaaaatatagctgaggccacgggcctgattgagctaatcgaccgaaacgaatttatgcccaaacagcgcgatgctgtgaatggtgtcatccctcaccagctccatcagagagagctgcaacttattatccagaaccagcagaagtattacccatttttggccgcaaaagcctaccccgacgctgatgaaactatgattgagcaactgctcagcttcagggttccttattacgcggggccactggtggaccgggattttataaatgaatcgtctgaccaggagcaggcaatgcagaacacaaagttctcctggcttaaacgcagagaggccggagaaatcaccccgtggaattttgagcaaaaggtagatgtgcaggaaactgctaacaggttcattaagcgtctgacaaccaaagacacgtatttgatgaccgaggatgtcctccccaaggaatcactgatctaccagcggtttgaggtgttaaatgagctgaacgccatccgaattaatgacagaaggctaacagcagaaaacaaacaactcgccttccagcagctgtttatggctggcaatactaagaacgttagtatcaaaaagttccgcaattttgtgttcgatagccttaagttccctgagaaagtcaagataaccggctttgccgggcagcacaacttcttggcaaaactgtccacatatcatgactttaagaaaattttcggagaacgggtggaccacactgatctccaaccagactttgagagaatcgtagagtggtgtaccattttcgaagataggcacatctaccgcgagaagctgaaagaaatacagtggttatctcagagcgagatcgaccagctggttcttattcgaaaccatggttggggccggttgtcaaagcgtctcctgacagggatcagagatagtgacggaaggaccgtgatggatcaactatggtttggcactgacaatttcatgcgcattatctcccagagcgattttgcggctgccatagcaaacgaaaatcggacgcagctgaaccagcacggtctcgaggacgtcctggattctgccttcatgtcaccccaaaataagaaagctattagacaggtgcttaaggtcgtggacgatatcgagcagacattggggtgccctcccaaaaaggttatgattgaatttaccaggagtccagacaaaaagaagcaacgaactgtgacccgcctggagaaagtacagcaggcctataaggcagtcgctgaccagttagccggccaaagcatcgtgtccgaactcgatcagtacgcgaacacacattctaaactgtcggacacctactatctttacttcatgcagctgggacgggatttgtatagcggcaagccgatagacatcgattcccctatgctcgacgatgaccacattctgcccagagcctttatgaaagataattcactagacaacagggctctgactgagaagccaatcaataacacaaaggcagccaaattccctagtaaggttttcgggcagcaaaaagaagtgacggatttttggaagctcctgcgtcgctgtggacttatgtctaatattaaagagaagcacttgtacctggaccccgacaacgtcgataagtggacccggagaggtttcatccataggcagttagtggagactagccaggtaataaaaattgtggctaatatcctcaacgaccgatatcagcaatcccagacagaagttctggaggtcccagcccggcttggcaccgaactgcgcgagtgctttgggtggtacaaggtgagagaagtgaatgattatcaccatgtcttcgacgcatacctagcggcctttatcggaaactacctctataggcggtaccccaaactgcagccttatttcgtttacggcaactttgctgagttgaataaggcccagctgaaaaacattaagtcattcaatttcttatataacatcacagataataaacgagtggtgaaggacattgagactggtcaaaccctctgggatgaccagataagacagcaaatccagcacatttacgaatataagtacatgctgacgagccatgaggcattcacccagcacaaagaactttacgggcagacaatctatccacgcagggagtttaagccgggcactctgaaagctattaagcaagatcagccccaggagttgtacggaggctataaaaacctcaccgccgcatacatgtgtatcgtaaagatacaggcccgtaagcggagagctgcggaatatagggtcgtgcgcgttgccacagagtctctgtccgcactacaacaggctaaacgactgggggtgcaggcctacgaaagatgccttcggcaggagctcgtcaggaataacgaaatcctgcgcactaatgccgaccctaacagtgctccacgtgagttcgaggtgttgctggatagagttttatgtcaccaaatgattatcagcgacggacagaagtatctcctgggttctcatgcatacaaaattaattgcatgcagcttgtgctgtccaacaattcaatgaagatcttgagtaccagcatagtaaaactcaagcaaatgacgaacgaacccctggtccaggtgtaccgggagattctagatgtggtcaataagtatttcacactgtacgacgttaactcgtttagggaaaaccttaatcagttctttgacaaattccgcaccctccctatcactaacgagtatgaatcctctaagagcggcaaaaagctgatccaccgagggcagttggagacattaaccctgattctcagaggactgcatgccaattcagataaagtgcaatacggcgaccagagtactcttctgggtgggtttcagaccaaggatggcataaagttgtccaaagactctgtaatccagtatacaagcccagcgggactaaacgtgcggacggtcaagctgagggatctcgagcaaaaagaagctcagaagtga

SEQ ID NO: 3219 - RNA, 4149 nt, synthetic construct
  misc_feature 1..4149: note = Cas9 variant
  source 1..4149: mol_type = other RNA
atggtggacgagaagatcttctggggcctggatattgggaccgacagcgtcggatgggccgttacaaactccgaatacaaactcaagaaatataagaataaccttatgtggggtgtgcacctgtttgatgaggctaaacagtctgcagaaagaaggtcattccggactgcccgccgacgtttggacagaaggaagcaacggataatcttactgcaggagtttttcgtacgcgcggtgtgcgaaaaggatgagaactttttcagaaggctaaaagagagtgctctcctgcccgaagacgccgagcatcggacgaataatatctttttcgatgaccctgattacaccgacaaggattattttgaagagtacccaacaattcaccatcttatttgtgagctgatggaaagcaaagagccgcacgacgtccgcttggtgtatctcgcatgcgtttacctgctggcccatcgaggccacttcctcttacccgtgtccgaagatgacatctctaaggtcactgagtttgaacctctgtatgagtcgttctacaaagctcttgaggaaaagttggacgatgagccaccctttgacagatcagcagatgacttcgccgaaatacttaagagccacaaaaccgtgagtgctaagaacaaagatttcgacaagctactctttgggggaaaagtaaagacatacgataatgagaacatctcctattctgccctgattaaacttctgagcggcggtaccgaaaagttgtccaagttctttgcgaatgaggagtacactgacctcgaaaaagattcagtttgtgtgaggaacgcagacttcggggatacactggagatgttagaaggacagatcgacgagctggactttgccctccttaagagtgtcaaaagcctgtatgattggtctttgctagtggacattctggaaggcaagtccctcatctcagaggctaaaaaggataagtacgacgagcatggctatgatctggacgcccttaaatacctgttccgggaatatttgaccaaggatgactacaatgagatgtttaaagaagtgagcgggaagcagaactacgcaagttatgtctacaatgcttcttccgataaaacgcgtgacagcaagtataagaaatgctcgcaaaaggatttctgtaaatttactaagaaattcctctctaagataaagcctaacgagaaagacaagccatgcctggataaattactggagaagtgtgaacaaaattccctatgccccaaacaggttaccacagacaaccgcgtgattccttaccagctctattacgtagagctgaagaaaatccttgaaaacgcctgtggatatttgccatttctgaatgagagagacgaatacggtactgtggcggataagattctctcaatcatgaagttcagggtcccgtactatgtgggccccctggttgacagtaaaaagagccctaacgcctggcttgtgcggaaactggatgggaagatcaccccatggaattttacagacatggtcaacgaggatgagtccgaaaatgcattcattcgacgcatgacctgcaaatgtacgtacgtggctggacaggacgtattgcccaagtattctctcctgtacagcaagttctcagttttaaacgagataaataacatcaaactgaatggcgaacctattagtgtgcagactaagcaggagatctatacagaactatttgagagaaacaaatccagggtcagcaagaaaaagatacgggattgcctcatttctcacggttacgccgctgactcagatgaggtgaccgggatcgacgatatcgccaagagtgcactgcgcagctatcatgacttcaaaaagatgctttccaatggaattttgactgaacagcaagtcgaggaaatcattgagcacataacagtgaccacggataacatcagactgaaaaagtggctcaaaacccagtttccaatgctggccgacgaagacgttaagtacattacaaagttaaaatacaaggattatggcaggctgtctcgttgcttccttgaggacgtgttgcccgtagatactaaaaccggcgaggctgaatcggacaagaatatcatcacaatgctctgggagactaacgaaaatattatgcagctgctaagctccaaataccggtattcagagaacatagagcacatgaaccgacaatactatgcgctgccggaaaatcataagagtatgtctgagagactcaaagatatgtacgtccctaccgcagtgaggcgcgccgttacacggacctttgacatcgtgaaggaactgaagaaaattcaggggagagatcccgacaagatcttcattgagatggctaggggaactggtgaaacgccaaaaggcaagcgcacaaacagccgaaaagatcagatccttgagcactggcatgggttggacaataaggatataaacgacctgaagaaatccggaatctgggagcacttagacaccattgatgacgccaagctccggtcagataaatattttctgtacttcatgcagcttggccgttgtatgtacactgaaaagcctatcccctttgaggaagtcgagaatgaacataaatggaacattgaccacatctggccacaagcaaagataaaggatgacagcctggataataaagtgttggtatcttccaacgagaatggtaagaaaagtgacagctatcccatttctgatgacatcagacactccatggccgggctctggcattcactgtacaagaaaggcctaattagtgagaagaagtatcagaggctgacccgcagcacacctttcaccgatgacgaactctcgggatttatcgctcggcagctggtggagactagacagtccacaaaagccgttgcaacgcttttgaaggaacaattcccaaacaccgagatagtctacgtgaaagcgggcctggtgtctgattttaggcaggaaatggggatgttaaagtgccgagaggtcaatgacctccaccatgctaaagacgcctatctgaacatcgttcttggaaatgtgtacaacactcgcttcacaaaggatccgctgaatttcgtgaagaacaacgagaaatatagcattaagatctttcagaaaaattcagacggtaagaaaaccggcgtaattacacggaaggtcgaaagagggggagaggtggcatgggatcccgaaaccagtttcgccatcgttaggaaaatgatgtccaagaactctatacgttacgtgcgctacgcttatatgagaaagagcggccagaatggtgggtttttcgaccaaaaccctctacggaaaggcaagggaatggtctccattaaacacaatctctcaatcgagaagtacggcgggtatgataacgccactatcagctttttcagtctggtgtctattaaagactttggagttatcttgctggcagtggagttactctccgctaataagttcctgaagaacattagcgaagccaaagagtacgcggccgataagctgtcgaaagaactgaatgtaaagatagtcccaaacgacgtggcttttcccttgaataacaggtataatgtggtcaaaatcaacgcagttctcgagctggatggttaccgagtgatgattgccgctaagcaaaattcatctatcaagttcgtaagtaacgaatccctaattctgagctctcagcacatggcctatgtgaaaaagatcacgaaatttatagagaagcggaaacaggacaaggtctgtatgatcaacgcattcagcggcatttccatcgaggataatattgaactttacgacgtgctcgtttcaaagtgcaacatcaaacctttcaatataatgtacgagaacctggggattaagttgagtgataatcgcgacaactttatcaaaaagagcgtggaaaatcaggtcctgatcttatctgagatggtgagactcttcaaaaccggaaggaaggcgggcgttaacctggaagaggtgggtgggcggaaaaattccggcgtcaagacacttaacacttgtctgtataaggtaaaagactactcaaatatatttttggtggatcagagtccaaccggactcattgagcataagagccccaacctgctagacctgtga

SEQ ID NO: 3220 - RNA, 4155 nt, synthetic construct
  misc_feature 1..4155: note = Cas9 variant
  source 1..4155: mol_type = other RNA
atgaacaagccctacagcatcggcctggacattgggaccaattccgtgggatggtctataatcacagatgactataaagtccctgccaagaaaatgagagttctcggtaacactgataaggagtacattaaaaagaatcttatcggcgctctgttgttcgacgggggaaacacggcagccgataggcggttaaagcgcaccgcgcgacgtagatatacaaggcggcgcaatagaatcctgtacctacaggaaatttttgctgaggaaatgtcaaaagtggacgatagtttctttcacaggctcgaggacagcttcctggtagaagaggataagcggggctccaaatatccaatatttgccactcttcaagaggaaaaggactaccatgagaaattctctaccatctatcatctgcgcaaggaattggcagataagaaagagaaggccgacctccgactgatttacatcgctctggcacacattatcaaatttagaggtcacttcctcatagaggatgactcgtttgacgtgaggaacacagatatttcaaagcagtaccaggacttcttagaaatctttaataccactttcgagaacaatgatctgcttagccagaacgtcgacgtggaagccattttgacagataaaatcagtaagtccgctaaaaaggaccggatcctggcccaatatccgaatcagaagtctaccgggatttttgcggagttcctaaaactcatagttggaaaccaggcagatttcaagaaatactttaatctggaagacaagacgccccttcagttcgccaaagatagctatgacgaggatctggagaacttgctcggccaaatcggcgacgaatttgctgacctgttctccgccgcaaagaagttatacgattcagtgctgctcagtgggattcttactgtcatcgacctgagcaccaaagctcctttgtctgcctccatgatacagcgttatgatgagcatcgcgaagacctaaagcagctgaaacagtttgtgaaggcgtcactcccagagaaataccaagaaattttcgccgatagcagtaaggacggatatgcaggttacatcgagggcaagacaaatcaggaggctttttacaaatatctgtctaagctgctgactaaacaggaagattccgagaacttcttggaaaagatcaaaaacgaggactttctcagaaagcaaaggaccttcgataatgggagcattccccaccaggtacacctgacagaattaaaggccatcattcggcgacagtcggagtactatccttttctgaaagagaaccaggaccgcatagaaaagatcctaaccttcaggattccatactatatcggacccctcgctagggagaaatctgattttgcctggatgacgcggaagactgacgattccatccgcccttggaatttcgaagacctggttgacaaagagaagtcagcagaggccttcattcatagaatgacaaacaatgatttttaccttccagaagagaaagtgttgccgaagcacagtctgatatatgaaaagttcaccgtctacaacgagctcactaaagtgaggtacaagaatgaacaaggcgagacatactttttcgacagcaacatcaaacaggagatttttgatggtgtgttcaaggaacatcgtaaagtctccaagaagaaactgcttgactttctggctaaggagtatgaagagttccggatcgttgatgtgattgggttggacaaagaaaataaggcgtttaacgcatctctcggaacctatcacgatctggagaaaatcttagacaaggatttcctggacaatcccgataacgagagcatactagaagacatcgtacagacgctcaccctgtttgaggatcgagaaatgattaagaaaagacttgagaattacaaggacttgttcacagaatcacagctgaaaaagctctataggcgccactacactggctggggccggctgagtgccaaattaatcaacgggattagagacaaggagtcccaaaagaccatcctggattatcttatagacgatggaaggagcaatcgcaactttatgcagttgattaacgacgatggtcgatctaatcggaacttcatgcagctcatcaatgacgatggcctgtcattcaaaagtattatcagcaaggctcaggccgggtcccattctgacaacctaaaagaggtggtcggagaactggcaggctcgcctgccataaagaaaggtatcctccaaagcctgaagattgtggatgagcttgttaaagtgatggggtacgaaccagagcagatcgtcgtggagatggctcgtgaaaatcagacaactaaccagggcagaagaaattcccgccaacggtacaagttgctggacgatggagtaaagaacttagcctcagacctcaatggcaacattctgaaagagtatcccaccgacaatcaggcacttcagaacgaaagactgtttttgtactatctccaaaatgggagggatatgtacacaggagaggcgctggacatcgataacctaagtcagtatgacatagatcacattatccctcaggctttcatcaaggacgattctattgacaatcgagttctggtgagctccgccaaaaaccgcggtaagtcagatgacgtcccaagcctcgaaatcgtgaaagattgcaaggtcttttggaagaaactgcttgacgcaaagttgatgtctcagcggaaatacgataacctgaccaaggccgagagaggcgggttaacttccgacgacaaagctaggttcattcaacgtcagctcgtggagacgcgccagataacaaagcatgttgcccggatcctggatgaaagatttaataacgagcttgacagtaagggaaggcggattcgaaaagtgaagatcgtaaccctgaaaagcaatctagtctctaacttccgcaaggaatttggcttctataaaattagagaggtgaataactaccaccatgcacacgatgcttacctcaatgccgttgtggcgaaggccatcctgactaagtatccccagttggaaccggagtttgtctacggtgactatcctaaatacaactcctataagaccaggaaatcagctacagagaagctgttcttttacagtaatataatgaacttcttcaaaaccaaggtgactttagcagatgggacagtagtggttaaggacgatatcgaagtcaataacgacacgggcgagattgtgtgggataaaaagaaacactttgccaccgtgcggaaggtcctcagctatccccaaaataacatcgttaaaaagactgaaattcagacaggaggcttctcgaaagagtccatcctggctcatggaaattctgacaagttaataccacgaaagaccaaagatatttacctggaccctaagaaatacgggggttttgatagccccatcgtggcctattcagtgttggtagtcgcagacatcaagaaaggcaaggcgcagaagctcaaaacagtgactgaactgctagggattaccataatggagagaagtcgcttcgagaagaacccatccgcctttctggaatctaaaggataccttaacatcagggctgacaagctcattatcctgcccaaatatagcttgttcgagctggaaaatggccgtcggagattactcgcctccgctggtgagctgcagaaggggaacgagcttgcactgcctacgcaatttatgaagttcttgtacctcgcctcaaggtataatgaaagcaaaggcaagccagaggaaattgagaaaaagcaggaatttgttaaccagcacgtgagttacttcgatgacatcctgcaactaataaatgatttttctaaacgcgtcatcctggcagacgccaaccttgagaagattaataagctctatcaggataacaaagagaatatctccgtggacgaactggctaacaatattatcaacttgttcacctttacaagccttggagcgccggccgcattcaagttctttgataaaatagttgaccgaaagagatacacttcgaccaaagaggtgcttaattcaacactcattcatcagtctatcactggcctgtacgaaacccggatcgatcttgggaagctgggagaggactga

SEQ ID NO: 3221 - RNA, 4155 nt, synthetic construct
  misc_feature 1..4155: note = Cas9 variant
  source 1..4155: mol_type = other RNA
atgaagctgagaggcatcgaggacgattacagcattgggctcgacatgggaacctcctctgtgggttgggccgtcacagatgaaaggggcactcttgctcacttcaaacggaagcccacgtgggggtcacgcctgtttcgagaggcacagaccgccgcggttgctcgtatgcctagaggacaaaggcggcgctatgtgagaaggcggtggcgcttggacttactgcagaaactattcgaacagcagatggagcaagccgatccagactttttcatacgactcagacagagtaggctgcttcgggatgaccgtgcagaagaacatgccgattaccgctggccgctgtttaacgactgcaagttcacagagagagattattaccagaggtttcccactatctatcacgtacggagctggttgatggaaaccgacgagcaggctgatattcgactcatctacctggcactgcataatattgtgaaacaccgcggcaacttcctcagagaaggtcaatccttatctgccaagtcggctaggcctgacgaggccctgaatcatcttcgggagacattgcgcgtctggtcaagcgaaagagggtttgagtgtagtatcgcggacaacggatccatactggcaatgctaacccacccagatctctctcccagcgacaggcgtaagaaaatcgcccctctgttcgatgtgaagtccgacgatgctgccgcagacaaaaagctaggcattgctctggccggcgcggttatcgggttgaaaactgaatttaagaatattttcggagattttccatgcgaggactcaagtatctatctcagcaacgatgaagccgtggacgcagtccggtctgcttgtcccgatgactgcgccgagctgttcgaccgattatgtgaggtgtactccgcttacgtactgcagggtctcctttcatatgcccctggccagacaataagcgcaaatatggttgaaaagtacagaaggtatggggaggatctggccttgcttaaaaagctggtgaaaatttacgctccagaccagtatcgcatgttctttagtggagcgacctacccgggcacgggtatctatgatgcagcccaagctcgggggtacactaagtacaacctcggacccaaaaagtctgaatataaaccttccgagagcatgcagtacgacgatttcagaaaggccgtcgaaaagctgtttgcaaaaaccgacgccagggctgatgagcgctatcgaatgatgatggaccggttcgataagcagcaatttcttcgtagactgaaaacatcggacaatggctctatttaccaccagttgcatctcgaggaactgaaggccatcgtggagaaccagggcaggttctatccatttttaaaacgcgatgcagacaagctggtgtccctagtctcattccggatcccctactatgttgggcctctcagtactagaaatgcgaggaccgatcagcacggagaaaaccgatttgcttggagcgagcgcaagccaggtatgcaagacgaacccattttcccgtggaattgggagtccataatcgaccggtctaaaagcgccgagaagtttattctgagaatgacaggcatgtgcacctaccttcagcaggaacctgtgttgcccaaatcaagtctgctctacgaggagttctgtgtactgaacgagcttaatggggcacattggtccatcgatggagacgatgagcacaggtttgacgccgctgatcgtgaaggcataattgaggaactgttccgccggaagagaacggtgagctatggtgacgtcgccgggtggatggagagggaacgaaaccagatcggcgcacacgtgtgcggaggccaaggggagaaaggattcgagtctaagttgggttcatacatctttttctgtaaggatgtttttaaagtggaacggctcgagcagagtgactatccaatgattgaacgcatcattctgtggaacactttattcgaggatagaaagatactgagccagaggctaaaagaagagtacggctcccggctctctgctgagcagatcaagacaatttgcaaaaagcgatttaccgggtggggaagactgtcggaaaagttccttactggcatcacagtccaagtggacgaggatagcgtatccatcatggacgttttgcgcgaaggttgtcctgtgtcagggaaaaggggccgtgccatggtcatgatggagattctgcgggatgaggaactcggatttcagaagaaagtggacgacttcaatagagcgtttttcgccgagaacgctcaggcactgggcgtcaatgaattacccgggagtccagccgtgaggcgctctctgaaccagagcatacgaatcgttgatgagattgcttccatcgccggaaaggcacccgcgaatatttttatcgaagtgaccagagacgaggatcctaaaaagaaaggtcggaggacgaagcgccgttataacgaccttaaggatgccttggaggctttcaaaaaggaagacccagagctctggagagaactgtgcgagaccgccccgaatgatatggacgaacggctatcactgtactttatgcaaaggggcaaatgcctctatagcgggcgcgcaatagatatccatcagctgtctaacgctggaatttacgaggtagaccacatcattccccgaacatacgtcaaggatgactcccttgagaataaagccttggtgtatagagaagagaaccagcggaagactgacatgctgttaatcgatcctgaaataaggcgcagaatgagtggctactggaggatgctccatgaggcaaagctgattggtgacaaaaagttccggaatcttctgcgtagccgcatcgatgacaaagccttgaaggggttcattgctcgacaactcgttgaaaccggccagatggtgaaactggtcagatctctactggaggcgaggtatccagagacaaacatcatatccgtgaaggcctcaatcagtcacgatctccggactgcagctgaactggtaaagtgtcgcgaggccaatgactttcatcacgcccacgatgctttccttgcatgcagagtgggattgtttattcagaaaaggcatccctgtgtttacgaaaaccctatcggcctgagccaggtcgtgcggaattatgtgcgacaacaggccgacattttcaagagatgccgcaccatcccagggtcgtccggatttatagtcaactctttcatgacaagcggctttgataaagagaccggtgaaattttcaaggacgattgggacgcggaggctgaggttgaagggatcaggcggtcattaaactttcgtcagtgtttcatcagtagaatgccctttgaggatcacggagtgttctgggacgccactatttactccccgagggcgaaaaagacggccgctctccctctgaagcagggccttaatccatctcgctatggtagcttctcccgggaacaatttgcatacttctttatctacaaagcccgaaaccccagaaaggagcagacactgttcgagtttgcacaggtgcctgtaaggctatcagctcagattcgccaagacgaaaatgccctcgagcggtatgcaagagaactggccaaagatcagggcttggagttcatacgtatcgaaaggagcaagattctgaaaaaccagttaatcgagattgacggggatcggctctgcatcaccggaaaggaggaagtccgcaatgcttgtgagctggcctttgcacaagacgaaatgcgagtgataagaatgcttgttagtgagaaacccgtgtctagggaatgcgtcatctccctgttcaaccggattttgctccatggcgatcaggctagccgcagactgtcgaagcagctaaagctggcccttctctcagaggcgttttctgaggccagtgacaatgtgcagaggaacgttgtgctggggttgatcgcaattttcaatggatccactaacatggtaaatctgagcgatatcggcggttctaaatttgctgggaacgtccgaataaagtacaaaaaggaattagccagcccaaaagtgaatgtgcacctcattgaccaatccgtcaccggaatgttcgagcggcgtacaaagatcggcctgtga

SEQ ID NO: 3222 - RNA, 4158 nt, synthetic construct
  misc_feature 1..4158: note = Cas9 variant
  source 1..4158: mol_type = other RNA
atgaccaagccctacagcatcggcctggacattgggacaaactccgtgggatgggccgtcataactgatgactataaagttccttctaagaaaatgaaggtgctcggtaatacgtcaaagaagtacatcaagaaaaaccttctgggcgctttgttattcgatagtgggattaccgcagagggaagaaggctgaagcggacagcccgccgacgttatactagaaggcggaatcgcatcctatacctccaggaaatttttagcaccgagatggcgacactggacgatgctttctttcaaagacttgacgattccttcctggtaccagacgataaaagggactctaagtatccgatctttggcaacttggtggaagagaaagtctaccacgatgagttccccaccatatatcatctccggaagcacctggccgactcgtcaaagaaagcagatctgcgcctcgtgtacttagccctggctcatatgatcaagtaccgaggtcactttcttattgaaggggacttcaatagcaaaaacaatgacttgcagaagaactttcaggatttcctggacacttataatgcaatctttgagagtgatctatccctcgaaaactctaaacagctggaggaaattgttaaggacaaaatcagcaagtccgccaagaaagatagaatacttaagctgttccctggagagaaaaattcaggcatttttagtgagttcttgaagctcatcgtgggcaaccaagctgacttcaggaaatactttaatctggatgaaaagaccagcttacagttctctaaggagtcctatgacgaagatctggagacactccttgggcatattggagacgattactcagacgtctttctgaaagccaagaaattgtatgacgcgatcctactgagcggtatcctcacggtgactgataacggcaccgaagcaccactgagttctgccatgattatgcggtacaaggagcacgaggaagaccttgctctgttgaaagcctatatacgtaatatctccctcgagacatacaacgaagtattcaaggataacactaagaatgggtacgcaggatatattgacggcaaaaccagccaggaggatttttacgtttatctgaagcgcttactggctggtctagaaggggccgactacttcctcgagaaaatcgatagagaggactttctgaggaagcagcggacattcgataacggatcgataccctatcaaatttaccttcaggaaatgcgagcgatcttggacaaacaggccaagttttatcctttcctggcaaagaataaagagcgcatcgaaaagattctcacctttagaatcccatactacgtgggccccctggctaggggcaactctgatttcgcctggtccattcggaaacgcaatgagaagataacgccttggaactttgaagacgtcatcgataaagagtcaagtgctgaggccttcattaatagaatgactagcttcgacctttatctgccagaagagaaggtgttgccgaaacactccctcctgtacgaaaactttacagtgtataatgagttaaccaaggtcaggttcatcgcagaggggatgcgtgactaccagtttctggattctaagcaaaagaaggacatcgttcggctatatttcaaaggaaagcgaaaagtgactgataaggacattatagaatacctccatgccatcgatggttatgacggcattgagctgaaggggatcgaaaaacagtttaacagctcacttagtacataccacgatttgctgaatattatcaacgacaaggagttcctcgatgactccagcaatgaaaccataatcgaggagattatccatacgctgaccatgtttgaagatagagagatgattaaacagaggttatctaagttcgacaacatctttgataaatcagtactgaagaaacttagtcgccggcactacacaggatggggcaaattgagcgctaagctcataaatggtattagagacgaaaaatccgggaacactatcctggactatctaattgatgacggcgtgtctaacaggaatttcatgcaactgatccacgatgacgcgctctcgtttaagaaaaagataaagaaagcacagatcattggagataaggacaacatcaaacaggtcgttaagagcctgcccggctcccctgccattaaaaaggggatccttcagtcaataaaaattgtggatgagttggtgaaggtcatgggacgcgaaccagagagtatcgtggtagagatggctcgagaaaatcaatacaccaaccagggtaagtctaatagccagcagcggctgaaacgtttagaggaatccctcaagggcctggggtcaaaaatccttaaggagaacgttcccacaagactgagcaaaattgacaataacgccttgcaaaatgataggctctatctgtactatctacagaacggaaaggacatgtacactggcgaggaactggatatcgaccgcctctctaattatgacattgatcatataatccctcaggcattcctgaaggacgattccattgacaacaaagtgcttgtcagtagcgcctctaatcggggtaagtccgatgacgtgccatcattggaggtcgtgaaaaagagaaaaaccctgtggtaccagttactcaagagtaagctgatcagccaaaggaaatttgataaccttacaaaggctgaacgagggggcctgtcgcaggaggaaaaagccggattcattcagcgccagctagttgagacccggcaaatcactaagcacgtggcaagactcctggacgagaggttcaataacaaaaaggatgaaaacaatcgtacgttgcgcacagtaaagataatcaccctgaaatcctctttagtcagccagtttcggaaggacttcgagctctacaaagtgagagaaattaacgattttcatcacgcgcatgacgcttatctgaatgccgttgtggcatcagcccttctgaagaaataccccaagttggagccggagttcgtctatggcgattaccctaagtataacagttttagggaacgaaaatccgctactgagaaggtgtacttctattctaatatcatgaacatttttaaaaagagcatccccctcgccgacgggaccgtaatagaccggccactgattgaagtgaatgaggaaacaggagagtccgtttggaacaaagtcgcagatctaaataccgtgcgcaaggtgctgtcatacagccaggtcaacatcgttaaaaaggtggaggaacaaaatcacggtcttgacagaggcaagcctaaaggactcttcaacgctaatctgagttctaagcccaaaccaaactccaaggagaatttggtgggggccaaagaatacctggatcccaagaagtatggcggttacgcggggatcagcaactcgtttgccattttagtaaaaggcactatagagaagggagctaaaaagaaaatcacaaacgtcctcgagttccagggcatttcaatcctggacaggatttattaccggaaggataaacttaattttctgttggaaaaagggtataaggacatcgaactcataatcgagctgcctaaatactctctattcgagctgagtgatggatcccgaagaatgcttgcaagcattctctctacgaacaataagcgcggcgaaatccacaaaggtaaccagattttcatcagccagaagtttgtgaagctgttgtatcatgccaaaaggatatcctcaaccttcaatgagaaccaccgtaagtacgttgaaaatcataaaaaggagtttgaggaattattctactatattctggagtttaacgaaaattacgtgggggctaaaaagaacggagagctcctgaaaagtgccttccaaagctggcagaatcactctatcgacgaactttgctcctcatttatcggcccaactggtagtgagcggaagggcctgttcgagttgacaagcagagggggagcagcggattttgagttcctaggcgtcaagattccgaggtatcgcgactacaccccctcctctctgctcaaagatgccacactgatccaccagtcggtgactgggctttatgaaacccgaatagacttaggaaagctgggcgaagattga

SEQ ID NO: 3223 - RNA, 4158 nt, synthetic construct
  misc_feature 1..4158: note = Cas9 variant
  source 1..4158: mol_type = other RNA
atgcagacctacttcggcatgaagaaaatcctggggctcgaccttggaacaaacagcattggttgggccctggtgaatgaggctaacgatgacaatgaaaagtcctctataatcaaattgggcgtcagagttaaccccttaactgtggatgagcaatcaaattttgaaaaggggaaaagtattacgaccaacgcagagaggacaatcaagcggagcattcgccgatccctgcagcgttataagctaagaagggaaaatctcatcgagatactgaaagagcacaacttcatcactgacgataccattctttctgaagacggaaatgcctcgacatttgagacctaccggctgcgcgcgaaggctgcctcagaaaagatcagcttggaggagctcggcagagtactgctgatgattaacaagaaaaggggttataagagttcccggaaggcaaagaatcaggaagaggggcagctcatcgatggaatggaagtggccaaggagttatacgaaaagaacataactcctggccaattcgtctttcagctgcttaagcagggcgggaaattcattccagacttttatcgctctgatttgcaggctgagttcgacaagatctgggagtttcaaaaactgttccatgcagaaattctagtggatgactttaagaagcagctcgagcgaaaaggaaagctgaatagctccaaaatcttccttggtagatttggcatctacacagccgaaaacaaggggaatgataaaaggctgcaggcttatcagtggcgggttgacgccttgaccaaggagctcacgaaggaggaactggcgtacgtgatttcagacttaaacggaataatcagttcatcttccggctacctgggttcaattagcgatcgtagtaaagagctctatttcaacaatcaaactgtcgggcagttccttatggcacagctggaccactctccgcatacctccttgaagaaccaagtgttttaccgccaggattatctagacgagttcaatacactgtgggaaaaccaggcccactaccataaagtactcactagcgatctgaagtcggaaatcagagacgttataatcttttatcagaggcggcttaaaacccaaaagggactgatttctttctgcgagtttgaatcccgaaagatcgaggtggagattgatggcaaaaagaaaatcaagaatgtcggctcacgcgtgtgtcccaaaagtagccctattttccaggaatttaagatatggcagatcttgaacaatattgagctcctggaaaagtcctctaaagctaagagattcttagaccaggaggagaaagaactgctatttaaggagctcagcatcaaatcaaagatcagtaaatccgatgccctgaaacttttgttcaagaacagcagggaactggacctcaattacaaagagattgaagggaaccggacacaatctgcactgtttgatgcttattcaaagataatcgagcttagtggacacggtgagtacgacttcagcaaaatggaagcctccaatattatcgagctggtgcaggaagtctttaccggcttgaactacaatacggagattctctatttcgactcttcgctggaagggaaggatttcgagaaccagccaatgtaccgcttatggcatctgctatatagctttgagggagacgattccaaaactggcaatgaaaagctcatcaacaagctgtcagagctttacggtttcgaaaagaagtatagtatagttttggcgaacgtgtcttttcaggaggactacgggagcctgtccacaaaagccatcagaaagattcacccctatctcaaagaaggcatccaatacgatgtagcatgcgagttcgctggatacaggcactcaaagagctctctgaccaaggaggaaattgagaataaaatcttaaaggaccagctggaaatacttcctaaaaactccttgcgtaatccagtggtcgagaagattctcaaccagatgatcaatgtggttaacgccctgaatgagagttatggcaaacccgatgaaattcggatcgagctagctcgagaactgaaaaagagcgccaaagagagagaggaactcactgcatctataggggagacaaccatcaagcatgaaaaatacagggccattctggagaacgaatttggaatctcccacgtgtcacgcaatgacattatccggtataaactttacttggagctggaaaacagaggttataaaacgttatacagtaatacctatgtcagccaggagaaactcttctcgaaagagtttgatatagaccacattatccctcaatcctgtctgttcgatgactcttttagcaacaagacacttgaatcaaagagtgtgaatatcgagaaaggcaacgatactgctttcgactacgtatttgcgaagtacggggaagcaggactgtccgactatattatccatattgaggaattgttcaaagatggcaagatatctaaaaccaagctcaataagctgaaaatgaagggtaacgagatcccaagcgactttattgccagggatatccgcgacacacagtacattgctcgaatcgccaaaaacatactagaggaaactgttcggaatgtggtctccacctcagggagcatcacagatcgtctgagagaggactggcagctcattgatgtgatgcaagaactgaactgggagaagtatagtgcacttggcttgaccgagatctacgaaaatagggagggacacactattcgccggatcaaagactggacgaagagaaacgatcataggcaccatgccatggacgctctgacaatagccttcaccaagcgatctcacattcagtatttaaataacctcaatgcacgctccgataaaagcggctcgatctacgggatcgaaactaaggagctgtatcgggacgatcacggaaaacttaagttcaaaccgcccattcctctgaacgaatttagagcggaggctaagaagcatctagagaataccctcatatcaatcaaagccaagaacaaagtcgcaacaattaatatcaacaccacttctacaaaggaaggtaaaaataagaagaggcagctgacgccacgtggccagttgcacctggagaccatttacgggagtatccaacagtacgtgactaaacaggaaaaggttggagcctccttcaacgaggaacagataagcaaagtggctaagcaaaaatatcgccaggccttactcaatcggctgagagagtttgacaacgaccccaagaaagcattcacaggcaacaattcttttgagaagaaccctatctaccttgatgtactgcagacccagaaggtcccagacaaagtggaaacagttagcaaggagattatctatactattaggaaagatatcacccccgaattgaagatagagaaagtgattgacaagaagatcaaaacgatcctccaatcccgactgaatgaatactcaggtgatagtaagcgggctttcagcaacctaaaagagaatccgatttggctgaaccaggagaaggggatcgaaataaaacgcgtcaccatttctggcatctccaatgccgtggcgattcatgacaagaaggataaaaacggaaatcttatcctcgacaacgagggctcaacacaggccgtagattttgtgaatactgggaacaatcaccacgttgctatatataaggacgaaagaggaaacctgcatgagagtgtcgtgagcttctttgaggcatgcaccagggtgaatttgggcggtcctgtcattttcaaaaactacaataagtccgatgggtgggaatttctgttctctatgaaacaaaacgagtatttcgtttttcccaacgaaaagacaggattcaatccaaacgagatcgacttactcgaccctgataattaccggctgatctcgcccaacctttttcgagtgcagaagattagcagcaaaaattacgtgttcaaccaccatctggaaacttccgccatcaccggcgagacgttgaagaataaaaagcagctcagttctgtaacatatcactttattcagagcctgccacccataaaagacatcgtcaaggtgagaattaacaatatcggtcaaatcgtttgggtgggcgagtactga

SEQ ID NO: 3224 - RNA, 4158 nt, synthetic construct
  misc_feature 1..4158: note = Cas9 variant
  source 1..4158: mol_type = other RNA
atggacgagctgcagaacttcgaaaagggcaaaagcatcaccacaaatgccgatagaactgctgggaggtccatgcggcgcaacctccaacgatacaaacttcgtagagagaatctgattgaagtgttgaaagagtataactttataacggacgaaatgatcttatctgagaatggaaacaggaccacattcgagacttaccggctgcgcgcaaaggccgcggtcgaagagatttcactagaacagtttgctagagttctcctgatgatcaataaaaagaggggttataagagtagccggaaagccaagggcgcagagaacgggacccttattgatggaatggaggtggccaaaaagatgtacgacgaaggcatcacacccggtgagctgtgcttgcagctcctgaccgctgggaaacgctatttccctgatttttaccgatccgacctgcaggcagagttcgatagaatatggaattttcaaaagcagttctatccagactctctcatcgataaggtaaaagacgaggtgaggggaaagaacaaatcgcagacttgggccattttagctaagtactttgtctggaaagaagtggaaaattcatggaacgaggaagaggcccagacacggcgtgttgaaaaggagtaccgcctggtgggcatcaaaagaggcgtcaagagggaagaacttaagttggagaatttccaatggcgggtgaaagcgctgagcgaacgaatgaacccggaggaactagcaattgtactccaggagatcaatgaacagataagtaactcctctgggtatctgggagccattagcgatcgctccaaggagctttactttaacagacagaccgttggtcaatatcagatggctgtgctggacaataaccccaatatcggcttgaggaacatggtcttctaccggcaggggtatctcggagagtttaatacgatttgggaaaaacaagccgagttccacaaggaactgactgaggatctcaaaaaggagatccgcgacatcgtgattttctaccagagaaggctgaagtcacagaaaggcctcataaacatctgtgaatttgagcgtcggcagattgaagtggagatcgacggtaagaaaaagataaaaaccattgggagtcgagtcatccctagaagctctccacttttccaagaatttaagatctggcagacactgaatgatattgaggtttccgtgttgggagtaaagaacaaaaggaagaaacaggacgataattcaactaccctactggacagcgcagagaacatcgatagtctcaagctgaatgtgtctcgcccccttgacgctgatgaaaaatccctgttggccaaggagttattcattcgggacaagctgacaaaaagcgatgtcttaaagctgctatttaacaatcctcagaacctcaatctgaacttcaaaaacatagacggcaatagaaccggctcggcgctttatcaagccttttctaagatcttggaaatttccgggcatgagtcaatcaacttcaaaaagagtgcagatgaaatcgtggagcaggttaaaacgatttttagcgctctgggatggaatactgaggtgctctgcttcgactccgaaaaggagctggacaagcagccatactttaaactttggcacctgttgtactctttcgaaggtgatagcacacccaccggcgacgggaacctcatacagaagatcgccgatctgtgtggatttgagaaagactatgcttcaattttagccaatatcactttccaagaagattacggcagtctgtccacaaaggcaattaggaaaatcctacctcatctcaaggacggtaaccagtatgatgtcgcctgcgagtacgctgggtataagcacagcaaatcttcactgaagaaagaggaaataaagaataaagtgcttaaggacaagttggagctgctcccaaagaacagtctgcgcaatccggtagttgaaaagatcttaaaccagatggtgaatgtcattaacgcgatcattaccacgtacggcaaacccgatgagatccgaatagagctggcacgggaacttaagaaaaaggccaagaaacgtgaggaattgaccaagacaattgtggacactaccaaaacacatgagggaatcagagctattctccagaatgatttcggcatgagccacgtctccaggaacgccatcatacgctataagctgtacgaggagctaaaagacaatgggtacaagactctgtattctaacacctacatccctaaagagaagctcttttcgaaggatttcgacattgaacacatcattccacaagcacggctgtttgacgatagcttctccaacaaaacacttgaggtgaagtcaatcaatatagaaaaaggaagtaagaccgcctatgactttgttgaggaaaaatacggtgagcagggcttgcaggagtatctgaacagatgtgaagtgttattcagggataagaagactaaactccgaaagctgaaaatgcaagagtctgaaattcccgaggggtttatcgaccgcgatcttcggaatacgcagtacatcgctaagaaagccctgagcatgttgaacgaaatttgcagaagggtagtcgcaacaaccggagcgatcactgacgagctccgtgaggattggcagctggtggacgttatgaaggaactaaattgggagaagtataaagtgctgggcctcgtcgaatacttcgaggataacgacggtcgcctgattgggcggataaaggattggaccaaaagaaatgaccataggcaccatgctatggatgcccttacagtggcatttaccaaggacgtattcatccagtactttaacaataaaaacgcctccttgaagcctgacactaatgaggctgccattcgaaacaagtatttccaaaatggcaaagcaatcccacccatgtcactggatgaatttcgggctgaggccaagaaacacttaaacgacacactcattagcatcaagacgaaaaataaggtggttaccataaacctgaaccgcactaagaaaaagaatggaatcaacaaaaagcagcagcagacaccgagaggccaacttcacctggaaaccgtctacgggtctcataaacagtatgtggtgaaggaggaaaaagtcaatgcgtccttcgatgccgctaagattgcaacagttaacaagcctgcctacagggacgctctactccggcgactgcaggagaatggaaacgatagtaaaaaggccttcactggtaaaaatagcttggacaagcagcccgtgtggctggatgcaaaacaaaacgagtgtgtgccagaaaaggtaaagaccgtcatgttagagacggtgtataccgttagaaaacctatcgacgaaaagctcaatgtggataaagtcgtggacgcgcgcattaggaagctgcttcaggatcgtatcaaagagtacggcaacgccaagtctgcttttgccaatctggacgaaaaccccatatggttgaataaggagaaagggattacaatcaagcgggtttccgtgtcaggaatcagtaaagcacagagcctccacgagaagaaagacaaggatggcaacttcattctggacaaggattcgagaaggataccagtagactttgtcaatactggtaacaatcatcacgtggctatctatcgcaaacccgtgctagataagaaagggcaagccgtcttcgacgaaaacggcgagctgaagtttgaacttgaggaagttgtggtatccttctttgatgcagtgacccgagtcaacctctctcagcctattatcgacaaagattacaagagaagcgagggatggaaattcctgttttcaatgaagcagaatgagtacttcgtgtttccaaacgaaaagacaggcttcgacccgaaagagattgatttgctgaatcccgaaaactatgccttaatcagtcctaatctcttccgggttcagaagatagcttccaaagactacgtgtttaggcatcacctggagactgtcgtggcggatcgcaaggagcttcaagaaatcacctggaaacgtatttctagcctgtccatcttgaacagaattatcaaggttcgggtgaatcacatagggcagattgtcatgatcggagagtattga

SEQ ID NO: 3225 - RNA, 4158 nt, synthetic construct
  misc_feature 1..4158: note = Cas9 variant
  source 1..4158: mol_type = other RNA
atgaccaagccctacagcatcggcctggacattgggacaaactccgtgggatgggccgtcataactgatgactataaagttccttctaagaaaatgaaggtgctcggtaatacgtcaaagaagtacatcaagaaaaaccttctgggcgctttgttattcgatagtgggattaccgcagagggaagaaggctgaagcggacagcccgccgacgttatactagaaggcggaatcgcatcctatacctccaggaaatttttagcaccgagatggcgacactggacgatgctttctttcaaagacttgacgattccttcctggtaccagacgataaaagggactctaagtatccgatctttggcaacttggtggaagagaaagcctaccacgatgagttccccaccatatatcatctccggaagtacctggcagactcgactaagaaagccgatctgcgcctcgtctacttagctctggcacacatgatcaagtatcgaggtcattttcttattgaaggggagttcaattcgaaaaacaatgacatccagaagaactttcaggacttcttggatacatacaatgccatttttgaaagcgacctgagtctagagaactccaaacagctcgaagagatcgtgaaggataaaatatctaagagcgctaagaaagacagaatactgaagctgttccctggagagaaaaattccggcatcttttcagagttcctgaagttgattgttggcaaccaagccgatttcaaaaagtattttaatctcgacgaaaaggcgccactgcacttcagtaaagaaagctacgatgaggacttagaaaccctgctcgggtatatcggagatgactactctgatgtgtttcttaaggcaaagaagctgtatgacgccatcttgctatccggtattctgacggtcactgacaacggcaccgaggctcccctctcaagcgccatgataatgaggtacaaagagcatgaagaggatctggcacttctgaaggcttacatccggaatattagtttggaaacatataacgaggtgttcaaggacgatactaaaaacgggtacgccggatatatcgacggcaagacctctcaggaagatttttacgtacacctcaaaaagctgttagttggtctggagggggcggactatttcctagagaaaatagatcgtgaagactttctccgcaagcagagaacattcgataatggatccattccttaccagatccatctgcaagagatgagggccatccttgacaagcaggcaaaattttatccattcttggctaagaacaaagaacggattgagaagatcctgacctttcgcattccctactacgtgggccctctcgcccgaggcaatagcgatttcgcttggtcgataagaaaaaggaacgaaaagatcacgccatggaattttgaggacgtcattgataaagagtcttccgccgaagcattcatcaaccggatgacttcattcgacctgtatcttccggaggaaaaggtgctgcccaagcacagtttgctctacgagacatttaatgtgtataacgagctgaccaaagtccgcttcatcgccgaaagcatgagagactaccagtttttagattccaagcagaaaaaggacattgttaggctgtatttcaaaaataagcgtcgggtgactgataaggacataatcgagtacctacacgctattgatgggtatgacggaatcgaactcaaaggtattgagaagcaatttaactctagcctgtcaacataccatgatcttttgaatatcataaacgacaaagagttcctggatgacagttccaatgaagcgatcattgaggaaatcattcacaccctcacgatctttgaggatcgagaaatgataaagcagagactgagcaaattcgagaacatttttgacaagtctgtattaaagaaactgtcaaggcgccactacaccggctgggggaaacttagtgcaaaattgatcaatggcattcgggatgaaaagagcggaaacacaatcctcgactatctgatagacgatggtgtgtccaacagaaatttcatgcagctaatccatgacgatgccctgtcttttaaaaagaagattaaaaaggctcaaatcattggggacaaagataacatcaagcaggtcgtgcaggccctccctggcaggccagcaattaaaaagggcattctgcagtcgatcaaaatcgttgacgagcttgtgaaggtcatgggacgccgacccgagagcattgtggtagaaatggcccgggagaatcaatacactaaccaggggaagtccaattcacagcagcgtttgaaaagactggaagagagtttaaaggaactcggatctaaaatcctgaaggagaacattcctgctaaacttagcaagatagataataacgccctgcaaaatgacaggttgtatctctactatctgcagaacggtaaggatatgtacaccggcgaggaactagacatcgatcgcctgtccaattatgacattgaccacatcattccacaggcattcctcaaagataactcaatcgacaataaggttctggtgagctctgcgtccaaccgggggaaaagtgatgacgtccccagccttgaggtggtcaagaaaagaaagacattgtggtaccagctgttaaagtctaaactcatatcccaaaggaagtttgataatctgactaaagctgaacgaggaggcctttcaccggaggccaaggcaggtttcatccagcgccagctggtggagacccggcagattacaaaacatgttgccagactactcgacgaaaggttcaacaacaagaaggatgaggacaataaaaccctgcgtactgtgaagatcattacgttgaaaagtagcctggtatcgcaatttcgcaaggatttcgaattatacaaagtccgggagatcaacgactttcaccatgctcacgatgcctatctcaatgcagtggttgcttccgccctgcttaagaagtaccctaaactggaacccgagttcgtgtatggggactacccaaagtataactcttttagagagaggaaaagcgcgacagaaaaggtctacttctattcaaatataatgaacatttttaaaaagagtatctccttggccgatggcaccgtgatcgagcgacctctcattgaagtaaatgaggaaactggagagtctgtgtggaacaaagttgctgacctgaataccgtccggaaggtgctaagctactcccaggtgaacatagtcaagaaagttgaggaacagaatcacggcctggaccgcgggaagcccaaaggacttttcaacgcaaatctctcaagcaagccaaaacccaacagtaaggagaatctggtgggtgccaaggaatacttggatcctaaaaagtatggcgggtacgctggaatctctaactcctttgccgtgctggtaaaaggcacaattgagaagggtgcaaagaagaagatcaccaacattttagagttccaagggatcagcatactcgacagaatcacttataggaaagataagtttaatttcctgcttgaaaaaggctacaaggacattgatctgatcattgagttgccaaaatattcactcttcgaactgtcagacggatctcggcgaatgctagcgagtatcctgtccacaaacaataagagaggcgagatacataaggggaaccagatttttatcagccagaaatacgtcaaacttctctatcacgccaaacgcatctctaatacgttcaacgataatcataggaagtacgtggaaaaccacaaaaaggagtttgaggaactgttctactatattttggagtttaatgaaaactacgttggagctaaaaagaatggcgagttacttaagagcgccttccagtcctggcaaaaccactcaatcgacgaactctgcagtagctttataggtccgaccgggtctgagcgtaaaggactgttcgagcttacttcccggggcggtgcagctgattttgacttcctgggcgtgaagattcccagatatagggattacacaccttcaagtttgctaaaagacgccaccctgatccatcagagcgtcacagggctctatgaaactcgcattgatctgggaaaacttggcgaggactga

SEQ ID NO: 3226 - RNA, 4158 nt, synthetic construct
  misc_feature 1..4158: note = Cas9 variant
  source 1..4158: mol_type = other RNA
atgaagaacaaaacctggtacctgggcctcggggtgggacccacaagcatcggttgggccgctactgactccaattataagctgctgagaaagaacaagaaaaggttgtggggcgtccggttattcgaggaagcaaagacggccgttgatcgccgaacctttcgtgcggagagaaggcggctggctcgcagaaagtggaggatttctctactcgaggagctgttcgccaaagaagtgtcaaagaatgaccctaactttttccttcggctgaaagagagtaagtaccactttgaggataagagcttgatgaatgaatatatactcttcaacgacaaggattacacagacaaggattattacaaagagtatccaactatctaccatctgcgcctgtccctcaccacagaagagaatccggacattcgaaaggtatacttagcagtgcactctatgctgaaaaacagagggcattttcttttgcagggacaatcgttcaatgattcaaacatcgacagcgtcattaaggagctgctagaactcgagaccgtgaaaatcaattttgaagttactgatgaggtgatacacagtctgaagaaaatcgcccttgaaaagaagaacctgtccgacaaaaataacgatgtcaagaaattgtatcccaaggagaaacagctccaggagattttcaagctggtgtttggcggtaagacatctttagacaaactgtacgacatcgaagagtataaggaactcgataatagcgtaaaatccatttcattcaaggagaaagtttacgaagaggtgaggcctgactatgagcagatccttagtaactacatagaactgttggatctagctaagctggtctatgacagcattgtgctcgcagatatcaagaaagaggggaagaccatttctgaatccaaagtggagctgtacaacaagcataaagacgatcttgccaatctgaagaagttggtcaaaatcgactcaaagctcagcgaagataaaaagaaagaggtttactttacgatcttcaaggaggacaaagaaaagggaactaactatgtgaattacacccaccggagtcaagagggcaagtcttgctcctatgaagatttcaaaaagtttctgaaaaaggagttagagaaactggaagacagcccaacaaagactaccattctagaggaactcgacctggagacattccttcccttgcagcgtaccaaggataactcggtagtgccttaccagatacacaaagaggaactggtcaagatcctcgacaatgctgccaaatatcattcttttctggcggagaaggatgactccggctactcaacgcgcgaaaaagtggttcagcttttcgagtttaggattccatattacatcgggcccctgaacgcacaccataatactgaaaacggaggttacagttgggccataagaaagaagggcatggagagcgtgcctgtcacaccatggaatttcaaagatgtgattgacgaatccgcttctgccgaggcatttgtaaacaatttgaagaacaaatgtgcttatctcagcggggaggatgttctgccgaaaaattcattactgtacagtgaatatgccctactcaacgagctgaatgcgcttcggtacgaaggaaaccgaatctccgtggaggcccgcgacgtcatcgtgaccaaattgttcaaggaacaaggcaagaaagtcactaagaaaacaattaaggagctgctcaaaaccgagggttttatcgatgggaagggagaaattgtgggcatagacaacatcgttaaaaatgatcttaagagctatagagacttcaagaaaattttagcagataagtttgacaaagagagggtggaaaacatcatcctgtggattacgctttacggcgagtctcggaagttgataaaagagaagatcaccaaggtatatggggacttctacacagtcgatgaaattgagaaaatgtcacgcctcacttacaaggactggggaatcctgagtagaaaactactgaccgaactcgtgagcgagaagctgtataatgaagagacaggtgagtgccttaacattatcggcgctatgaggcaggggactatattgtttatggaactgttagccgataaattcgactacatgtcccagatcaagaatcacaacaaggagaataaagatgacattaccgaaatcacacccgatattctcgagaacctgcacgcttctcctgccgttaagcgttcgatctggcagaccgtgcggatagtcgaggaacttaaaactattatcggatgtgtgccaacgaagattttcatcgagacaaccaaacgaaataacgcaccctataaggtacctactctgaatagaaacgacttggtgaccaagtacaaaacaataagggaacatgagatctttgaactcgagaaggaactgaaaaataccctagatttcactctgaacaagaatcgcctcattaacgaggagccaagcaaactgaaggccacaaaactttatttgtactatacgcaactgggccggtgcatgtacaccggtaaaaagatcgacttaggggaactctttgataacaataacaaatacgacattgatcacatctatccccagtccaaggttaaagacggctcattcaataacatagtcctggtgactaaggctagtaatgacatgaaagcggatgtgtttccgcttaagtctaagttccagacaaaagagaacaagatcttttggagattcctgaaagaaaagaaactaattaccgaggagaagtacaataggctcgtccgcacagaagagtttagcaacggagaactgactggcttcatcacccgacaattggttgagacgtcccaggcaattaaggtgatctcaaatgtgctgcgggaattaaaccctgagaccacaatttgttatagcaaagccgagaatgtatcttcctttcgtcagagtttcgggaagataaaagaagctaacagaaaggccgagaataacgaaaaactcatcagggtccaggagattaatgactactataacgcaaaggatgcctacctgagcatcgtggttggaaacgtgtatgacgtcaagtttactcgcaatgtgcataacttcattaaaaataacaaggatgctcggagatactctcttaatggtctgttctacaccgacgttaaaaacgccaatacaatcgcatgggaaatggataagactgtgcacgtagtcgagaaaaccatgaacaataacaatatattgatcacgaggcgaacatccgagcaaaagggcgcgctctatgacgctaccctgtacaaggccaaagtggcagaaaaggccaaagaggggacttattaccccctaaagacaaccgattcaaaaattaaggacgtgggaaaatatggcggttttactaagatcaagattgcttactatagtatcttcgaatacaccctggatgggaaaaagggcaaacagaagataacacgcattgtcccaatccctatctacattagccagaacataaaagacgacaaggcccttctcgagtatgcacagacgcggctgcccggaaaggatttgaaaatcaagtacagaaaactgtgcattggctcgttagttaagatcaataactttaattattacattgggggaaaaaccaacaataacttcacttttgactccgctgtgcaagtaatcctcgataaggactctgaaagctatataaaggagctggccaaataccttaactggaagaaagagaataaggatggtaaactgtgggaatcaatcacagaggacaagaacattcagttgtatgatagtctcgtgaagaaaatgaataccggcatcttcattaggaagacaccaaacaaatacactgaactgctaaccctggaggtcaagaataaatttatcaacatagacattgatgaacaggtgaaacttctcctggaaatcttgaatttactgacgaacaagaagttcacatccaagctcaatgagatcgggattaccgcgtctcgtggagtttgtagctttaacctgtccaatcagtcacaattcagcatcatagaacagagtgtgactggcgtctacgagaaagaaaaacttattatcgagaagaagaaagagggtattctgtga

SEQ ID NO: 3227 - RNA, 4161 nt, synthetic construct
  misc_feature 1..4161: note = Cas9 variant
  source 1..4161: mol_type = other RNA
atgaaccagaagtacagcatcggcctggacattgggaccaattccgtgggatgggccgtcataacagatgactataaagttcccgctaagaaaatgaaggtgctcggtaacactgataaacaatctatcaagaagaatcttctgggcgcattgttattcgactcaggggagacggccgaagcgaccagactgaaaaggacagctcggcgccgatacactcgtagaaggaaccggctacgctatctccaggagatttttgccgaagagatgatgcaggtagatgaaagtttctttcagagactggacgatagcttccttgtggacgaggataagaggggagagcggcaccctatctttggcaatattgcagccgaagtcaaataccatgacgagttcccaaccatctatcatctgcgcaagcacttggctgatatatcccaaaaagcagacctccgactggtgtacctggccctcgctcacatgatcaagtttagaggtcatttcttaattgaagggcagctgaaggccgagaacacaaatgttcaggcgctttttaaagatttcgtggaggtctatgacaagaccgtggaagagtctcacttgtcggaaatcactgtagacgcactgtcaattctaacagagaaagttagcaagagtaggcggctcgaaaacctgatcgcccactacccggctgagaaaaagaataccctttttggaaacctgatagccttgttcctcggcctgcagcccaattttaaaacgaacttccaattatccgaggatgcaaagctgcagttctctaaggacacttacgaagaggatctcgaaggccttctgggggaggtgggagacgaatatgctgatttgtttgccagcgcgaaaaatctatacgacgccattctgctctccggtatcctgaccgtcgatgacaactcaacaaaggcacctcttagtgctagcatggtgaaacgttatgaggagcatcagaaggatctgaaaaagttcgaagactttattaaggtgaatgccttggatcagtacaacgctatcttcaaagacaagaacaaaaagggctatgccgggtacatcgagtctggagtcaaacaagacgaattttataagtacctcaagggcattctgttacagataaatggttccggggatttcctggacaaaatcgatcgcgaggactttctaagaaagcagaggactttcgataacggatcaattccacaccaaatccatctccaggaaatgcacgcaatactgcggcgacagggcgagcactacccctttcttaaagagaatcaggacaagattgagaaaatcttgaccttccgcatcccttattacgttggcccactggccagaaaggggagcaggtttgcttgggcggaatataaggcagatgaaaagattacaccctggaacttcgacgatatcctcgacaaagagaaaagtgccgagaagtttattacccggatgacgctgaatgatctttacctgcctgaagagaaagtgttgccaaagcattctctcctgtatgaaactttcacagtatacaacgagttaaccaaagtgaagtatgtcaatgaacaaggagaggctaagttctttgacgccaacatgaaacaggagatattcgatcacgtgtttaaggaaaatcgcaaagttactaaggacaaactgctaaactacctcaataaggagttcgaagagtttagaatcgtgaacctgacaggtcttgacaaggaaaataaagtcttcaactccagcttgggcacctaccatgatctgaggaagattctcaataaatcgtttctggacaacaaggagaacgcacagatcatcgaggatattatacagacgttaaccctgttcgaagaccgtgagatgatccggcaacgacttcagaaatattctgatatttttacaaaggcccagttgaagaaactcgaaagaaggcactacactgggtggggacgcctgtcctataagctaatcaatggcattcggaacaaagagaataagaaaaccatcctggactacctcatagatgacggttatgctaacagaaatttcatgcagctgatcaacgatgacgccctttcatttaaggaagagattgcaaaggcgcaaatcattggggatgtggacgatatcgctaatgtagttcatgacttgccgggcagtcccgccattaaaaagggaatactgcagagcgtgaaaatcgtcgacgagttagtgaaggtcatgggccacaaccctgcaaatattatcatagaaatggccagggagaaccagacaactgatcgcgggcgacgtaattcccagcaacggctcaaactgcttcaggactctctgaagaacttggataatccagtgaacatcaaaaatgttgaaaaccagcaactccagaacgacagactgttcctatactatattcagaatggaaaggatatgtacaccggtgagacactggacatcaacaatctcagccagtacgatattgaccacatcataccccaggcttatattaaggatgactcatttgataacagggtgctgaccagttccagcgagaatcgcggcaaatctgacaacgtaccttcaatcgaagtcgtgtgcgcccggaaggcagactggatgagacttaggaaagctgggttgatcagtcaacgaaagttcgataatctgactaaagccgagcgcggaggcttaacggaaaacgacaaggcgggtttcattaagcggcagctcgttgagacaagacagatcaccaaacatgtggcccaagtcctggatgctaggtttaatgcaaagcacgacgaaaacaaaaaggtgattcgtgatgtaaaaataatcactcttaagagcaatctggtgtcccagttccgcaaggactttaaattctacaaggttcgggagattaacgattatcatcacgcccacgacgcttacctaaatgccgtcatcgggaccgcactcctgaaaaagtatccaaaattggcgtctgagtttgtgtacggcgagttcaagaagtatgatgtgagaaaatttattgccaagtcggacaaagaaatcggaaaggctacagccaaatacttcttttacagcaacctgatgaatttctttaagaaggaagtcaaattcgcagatggcaccgttgtggagaggcccgacatagaaacttccgaggatggggagatcgcttggaacaagcagacagacttcaaaattgtgcgaaaggtattatcatatccgcaggtcaacatcgtgaaaaagacggaagttcaaacccatggactcgaccggggtaaacctcgcggcctgtttaatgccaaccccagtccaaagcctaagcccgattctagcgagaatcttgtgggggtcaaaagaaacctggacccaaagaaatacggaggctatgcaggtatttccaattcatacgccgtgttggttaaggctatcatagaaaaaggggtgaagaagaaagagactatggtactcgagttccagggcattagcatcctggataggatcacatttgaaaaggacaaacgggcgttcctactgggaaagggctataaagatattaagaagataatcgagcttcccaaatactctctctttgaactgaaggacgggtcccgaagaatgttggccagtattctgagcaccaacaataaacgcggagagatccacaagggcaacgaattattcgtccctcagaaatttacaactctcctgtatcatgcaaagaggattaataacccaatcaataaggatcacatagagtacgtgaaaaagcatcgtgacgatttcaaagagcttctgaactacgtgttggaatttaatgagaagtatgtcggtgctaccaaaaacggggaacggctcaaggaggccgttgccgacttcgattctaaatccaatgaagagatctgtacgtcatttctgggagctgtgaacagtaagaatgcaggcctattcgagctgaccagccttggttcggcctccgactttgagttcctcggcgtaaagattccgagatacagggattatacaccctctagcctgttgaaagactcaactttaatccaccaaagtattaccgggctgtacgaaacacgcatcgacctctccaagctgggagaagattga

SEQ ID NO: 3228 - RNA, 4161 nt, synthetic construct
  misc_feature 1..4161: note = Cas9 variant
  source 1..4161: mol_type = other RNA
atgaccaagatcacagaggactacattgtgggcctggatatagggactaacagctgcggatgggtcgccatggactccaaaaatacgatcctcagaatgcacggtaagaccgctattggctctcatcttttcgatgcagggaactcagccgcggacaggcgggcttttcgcacaactcgacgtagaatcaaaaggcggaagtggcgcctgaaattgttagaagagattttcgatagtcacctggccaaggttgacccctactttttcgcaagactaaaggaaagcggactctcccctctggataccaggaaaaatgtgtcttcgatcatatatccaacatcacttgaggacaagaaattttatgtagataacccgaccatctaccatctgcggtataagttgatgactgaagaccgcaaattcgatctccgagaggtgtacctggccattcaccatatcgtcaagtatagaggcaattttctgtacaacacacccgtgaaggctttcgaggcaagcaaaattgacgttaagggtagtctcaaaaagttaaatgaactgtacgaggggcttgattccgaatttaacgtggagttggactctaataacgccctggagatcgaaaatataattagggacaaaaagatcttcaaaattaacaaggtcaaggagatcaatcagctactcagcctgaaaaccgaagataaggagcggacgaaacttatgaaggacgtgtccaaacaaatcgtaaacgctattctgggatataagactaagtttgaaaccatattgctcaaagatgtttcaaaggacgaggccgatgactgggagttcaaactgacagatgtggacgcggataataagtttgaaaacttaatcggcgacctgaacgagaatgaacaggagattctccttgtcatccgtaaactggcaaacgccataactttgagtaatattgtggaagagggcaagaccctaagcgagtctatgaaggataaatacaagaaacactccgacgacctgaagctcctgaaacaggtgatctcagatcaccctgaccgcgataaggctaagaaacttgccctggcatatgacttgtacgtcaacaatagacatgggaagatcctccaggctaaagatattctggaaaagaaaaagacattaagcaaagaggacttctataaggaaatcaagaaaaacctggatgacagtaaggagtctcaagaaattctagatgccatatccctcgacagcttcatgccaaaacagaggaccaatgagaacggagttatcccctaccagctgcaccagcttgagttggataagattatcgaaaatcaaggtaaatattacccttttctgaaggaggtgaacccagtatcgtctcatctcaagcaggcgccctacaaactggacgaacttatccggttccgagtgccttattacgtcggcccactgatttccccgaatgagtcaacgaagaacaaacagactaagaaaaatcagaactttgcctggatgatacgcaaggagcaagggcagatcacaccctggaatttcgatcagaaggtggacagaatggcaagtgctaacaaatttattaagaggatgaccactatcgacacatatttgctcggagaagatgttctgcctgccaacagcttactgtaccaaaaattcaccgtgctaaatgagctcaacaatgtcaagattaacggcaaacggatctccgtgccactgaagcaggaactttataataacttgtttaagaaaaattctacggtaaccacaaacaagctgaaaagctacctcaaggagaattataaactgataaaggttgaaatcaaaggtttatcagacgagaagaagttcaacagtgggctgactacctacaataaacttaagaacttgaaaatttttgatcagcagatcgacgatcccaattacaacaaggacttcgagcgcattatcgaatggtccacaatatttgaggataaagctatttataaggaaaagctcaaaactatcgactggctgagcgatagacaaattgacaagctatctaaaatcaggatgcagggatggggccagctgtcaaagaaactcctgagtcagcttaccgataataacggccaaacaataatcgagcagttgtgggacagccagaacaatttcatgcagattgtgaaccaagccgattttaaggacgcaatcgccgtcgctaatcagaacctgttagtggacacctccgtcgaagatattctcaatgaggcgtacacttctcctgcaaacaagaaagccatccgtcaggtggttaaggtggtagacgatatagtcaaagctacgtcggggaaggtgccaaaacagattgccatcgagttcacacgggacgcagatgacaatgccaagatcagccaatcccgagctaacaagctgagaaaagtttataaggaaatgtcaaatgagcttgccagtgaaaccattaggaacgagctggaacgcgtggcaaaagatcagaagttgctcaaagacaagcactacctgtatttcatgcagctaggacgggatgcgtacactggtgagctgatcgacattgataatctcgagcaatatgacatagaccacgtcctgccccagtcttttatcaaggatgacagccttgaaaacagagtgttggtaaagaaggctgtgaataacggcaaatccgataatgttccggtcaagctgtacgggaacaggatggccaccgacttaggaatgacaattcgccatatgtgggagaaatggaaggaacagggcctcatcaccaaaactaagtacaacaatctgattatcgatcctgacaagataaacaaatatgagtcaagcggtttcatccaccgacagcttgtggagacatctcaaattatcaagctggtgtccacgattctacagagtaaataccccgataccgaaatcatagtcgttaaggcacggtataatcattacctccgtaaaagactgaacttgtataagagcagggaggtgaatgactaccaccatgccattgatgcttatctgtctgccatctgtgggaacttactctaccaggtgtacccatatctgcgcccctttttcgtatacggccagtataagaaattttcctcagaacctgagaaggagaaaatcatttacgacaagactcggagatataatttcataagtcaaatctttgaaaacaaagataatgacattatcagcagggagacaaagaagaaagtcttcgataagaaagacattatcgaaaaacttaaacgagcatacaactataagtacatgctggtgtcgcgcgagaccgaaacacacgaccaggagatgtttaagatgactgtttacccacggttgtccagagataccaaaaagtctaggaatctcatacccaaaaagaaagacatgcctacggaaatctatggaggctacaccaacaatagcgatgcttatatgattatcgcccgtattaacaagaaaaaggggccagagtaccgcgtgttcggagtcccgatgcgggagctggtgaatctaagaaaggcggagaaaaacggtcactataaggcctacctgaaacaggttcttgaacccgaaatcatgtattcaaagaatggcaaaaagaacaagacaataagttcctttgagattgtgaaagctaaggtaccttacaaacaggtcatcctcgacggggataagaaattcatgctggcatctagcacttacgtgcaaaacgccaagcagttgaccctgtcccagtattcaatgcaagctatcacagacaattgcgaaaacgatactgaggaggaaaaggccttagtggaggcatacgacgaaattctcaccaatatcgataaatatctgccactttttgacataaacaagttcagggagaaactgcatgcgggacgagagaagttcgtcgatttgcccctcgccgagaaaaaggaaacgattctgcaggttctaaatggcctgcacgacaacgctgtgatgcctaagatcaaaagccttggtctcagtacaccactggggtttatgcagttccataccggcgtatctttgtccgaaaatgccaagttaatttaccagagccccactggactgtttgagaaacggctcaagatctcggatctgtga

SEQ ID NO: 3229 - RNA, 4164 nt, synthetic construct
  misc_feature 1..4164: note = Cas9 variant
  source 1..4164: mol_type = other RNA
atgagcgactccaagaaattcgagggcgaaaacgtgaagtctggggataaaaagaccaataaaaaccacggaaaggtcctgaagtcaagtcccaaagagatcagaaagaatacagaatactttattggtctcgacataggcactagctccgttgggtgggccgtgacgaacaccgattatgagatccttaaattcaatggaaagaggatgtggggctctcggctgtttaacgaagcatcgacagctgaggagcgccgaggtcatcgtgtaaatagaaggcggattcagcgcagaagggaccggttgaacttactggaagagatcttctcagaagagatggccaaagtggatcctgagtttttcatgcgcctaaaggaaagcaagtttcacctcgaggacaaagatgaacgaatcctgggggagagtaatattatattcaagggatccgaagacggcgataaaaagtactatgagaaatacccaactatctatcatcttagacacaagctgatgcaatcttgcgaggacgtcgatattagggaattgtacatggcgctccatcacatcattaaatatcggggccactttctgttcaagggggactttgaggaaaccggaacaagcatcgagaacataattatcgaactgctcgagttaattaataacaatctgggtgtgaagaaattcgagtacaacgaatcccttatcaatgagttgaagaacatcgtttcaaacaccagtaatactattacaaacaaaaagaaactgctaggcgaatttttcaataagaaggagtacaaagctcataagagcctcttcatactgtctatcggggcctccgtgaaaccggtcgatctttttctggaagaggagtataaggacattgacgatatcaaaaacatatcattcaagaatttggaatacgaccaggtgcgtgatacctatgagagcatttttctcgacaagatcgagttcatcgatgtagcaaaacgcctgtacgacgccacgattttactgagtatcaagcccgaaggaaaaactctctctgaggctaaggttgatatttataacaaacaccataatgaccttgaactgttgaagaaggtgctaaaaaccgataaggagaaatacgactccatactgaagctcgatatcaaaaagggcaacaattatgtcaactacgtgaaaaagagcaagaatggtatttcgtgttctaaagaagagtttcacaacgcactgaagaaagtgcttgtcaagatcgaaaagacagacgacatcaagtacattctgaatgagatagagttggaaagattcctccctctgcagagggttaaggataactccgtgatcccatatcagattcaccggtacgagctgaaaaagatcctggaaaatgccagtaaaaagtttactttcctaaacgaggaatcagacgggcataccaacattgagaaaatcataaagatcatggagtatcgcattccctactatgtaggacctctcaatgatcaccatagcgtgtacaacaatggctttgcttgggtctcccgaaagagatctggcaggatcacaccatggaacttcgacgaaatggtggataaagaggaaagcgccgagcggtttattgaaaatctgaccaacaagtgctcatatcttatcggggaggacgttttgcccaaagagagtctgctctactccgagttcagcctgcttaatgaactgaacaatataaagtacgatggaatttctttgcctatcgacattaaaaagtcaatcgtggaaaagatatttcgcgtcgagaaaaagagagtgacgaaaaagtatatcaaagagttcctcaagcaagaaggttacagtgatggcaaaggggaggtaagcggaattgacatcgatattaagtccgacctgaagtcttatagggatatggttaaaatcttcggcactgaaatagactaccgtatggcggagaacattatcaagtgggtgacattatttggtgactcgaaagatctgctaaagaccaaaatcaataaggaatatggggagaaggtcagcaaagaccagctcaagaaagtgtgtaagctgaaataccgggattggggccgactttccaagaagttcttgactggaattagatcaagtgtcctggtgaacgacgcaacaggcgaggggtataccatcattgaagccatgaggaatacggataacaatctcatgcagctgttacgcaacgagtacgactacctgaaaaagatagatcagatcaacatgctttctcggaaagacattgatgaaatcagccacgacattttggatgacctctattgctccccagctgttaagagatcactgtggcaaaccatcaaaatagtggaggaaatcaagaagattatgggacatgagccgaaaaaggtatttgtcgaggtgacaaggactaataaagccgataagaaaaccacaatcactcgcaagaaccgactactggaactctacagcgcaattaatgctgagtctcgggactgggttaacgaattaaattccaccgaggtgagtaagttcaacagcaaaaagttgtatctttactatacacagatgggtaaatgtatgtacaccggcaagaatatcgacatagaatctctgtttactgatatgtatgacattgatcacatcttcccccgttccaaaacgaaggacaactcatttgagaatttagtcctcgtgacaagaaaagccaacgcggataagagggacgtataccctatcgatccaaagattcagaccgagcgcaaaagtctgtgggacatgcttcacgataagaaactgataggggacaagaaatacgatcggttgactagaaccacaggattcaccgacgacgaaatgagcggctttatcgccaggcagctcgtggagacttcgcaagcatccaaggctgccgctgaaatgctgaagctaattaataacgattctgagatcgtttatgtcaaagccgagaatgtgagcgacttccgacatgaaaacgagtttattaaggtgcgcgaaatcaatgatcaccatcacgcaaaagacgcctacctgaacatagtcgttggtaacgtgtataatgagaagttcacgaaaaaccccgctaattacatcaagaaagggggcggaaacaattattcactcaactgcatttttaatcggaacctggatagaaatggcaaaaggatctgggacgaaaagaaaagtattgatacagtgaaccgtatgatgaagtccaatgacgtacgcgtcaccttcaaaaaccgggtggataaggggcctatccttaataaggttactatacacaaagcgtctgagttcatggacgatggaaagaaaaacaagaaaggttttccaattaagagctccgagaaaaatggcaacaatagattgtgtaacctgtacaagtatgggggatacaaggacttaaactactcacattatacaatcgtgaggtacaatgtctatgagaaaaagggcctcgatatcaaatactatatgattcccatcccgtactatctgtgcctttgtaacataaatcagcacgactacgtgtacgactatattagcaaccgaagtaagaaagatgttaataacatcgaaattatcgtgaatgaactgaagatgggttctctaataaacattgacgggtacaattattacctcggcggatccaagcctaaaaccttctatgtagatcccgcataccagatcatcctggacaaggagattgaacggtgcatcaaagagattgtcaaggccaaaaacaatgagtatcgctttataaacacagataagatcaataagaacttgaatatgaaaatttacaagtacatcgtgaacaaaaagatcattggcgtgttcagaaacaggaaatgggacaagggggaatatctgaatagctcggagactatagaaaagttttcaggattatctgtcgagagtcaatgtaacgttatcctccggctgattaatgatatgcgaggctccaacaaaggtggggctaatagcaagttcgacgaacttgagatgaccatctctagagccgagattccacagacgctgagcaacgtgtcctcatttaaaatcataaatcagagtatcaccggattgttcgaaaacgaggtaacaattgtgtga

SEQ ID NO: 3230 - RNA, 4167 nt, synthetic construct
  misc_feature 1..4167: note = Cas9 variant
  source 1..4167: mol_type = other RNA
atgaccaagccctacagcatcggcctggacattgggacaaactccgtgggatgggccgtcataactgatgactataaagttccttctaagaaaatgaaggtgctcggtaatacgagtaaaaagtacatcaagaaaaaccttctgggcgctttgttattcgattcagggattaccgcagagggaagaaggctgaagcggacagcccgccgacgttatactagaaggcggaatcgcatcctatacctccaggaaatttttagcaccgagatggcgacactggacgatgctttctttcaaagacttgacgattccttcctggtaccagacgataaaagggactctaagtatccgatctttggcaacttggtggaagagaaagcctaccacgatgagttccccaccatatatcatctccggaagtacctggcagactcgactaagaaagccgatctgcgcctcgtctacttagctctggcacacatgatcaagtatcgaggtcattttcttattgaaggggagttcaatagcaaaaacaatgacatccagaagaactttcaggacttcttggatacatacaatgccatttttgaatcagacctgagtctagagaactccaaacagctcgaagagatcgtgaaggataaaatatctaagctggagaagaaagacaggattcttaagctgttccctggagaaaagaatagcggcatcttttccgagttcttgaaactcattgttggcaaccaagctgatttcaaaaagtattttaatctggacgaaaaggcctcattacacttcagtaaagagagctacgatgaagacctggagaccctccttgggtatatcggagatgactactctgatgtgtttctgaaggcgaaaaagttgtatgacgcaatcctactgtccggtattctcacggtcactgacaacggcaccgaggccccactgtcaagcgctatgataatgaggtacaaagaacatgaggaagatcttgggctgttgaaggcctacatccggaatattagtctcgagacatataacgaagtgttcaaggacaactctaaaaatggatacgcaggctatatcgatggtaagactaaccaggaggacttttacgtatatctgaaaaatttactgtccaacttcgagggggctgattactttctagaaaagatagaccgtgaggatttcctccgcaaacagagaacctttgacaatggaagcattccctatcagatccatctgcaagaaatgagggccatcattgataagcaggcgaagttctacccttttcttgccaacaataaagagcggatcgaaaagattttgacattccgaataccatactatgttggccccctggcacgcggcaactcggactttgcttggtctatcagaaaaaggaatgagaagattaccccttggaacttcgaggatgtgatcgacaaagaatcctcagccgaggctttcatcaatcggatgacgagttttgatctctacctgccagaagagaaggtccttccgaaacacagcctgttgtatgagactttcaacgtgtacaatgaactcacaaaggtgcgctttattgccgagtccatgtctaagtatcagttcctggacagcaaacagaagaaagacatagtcagattatactttaaggataaaaggaaggttaccgacaaggatatcattgaatatctgcacgcaatcgacgggtacgatggaattgagctaaaaggtatcgaaaagcaattcaactcaagtctctccacttaccacgacctgcttaatataatcaacgataaagagtttttggacgatagctctaacgaggccattatcgaagagattatccatacactgaccatattcgaagaccgtgagatgattaagcagcggctctcaaaatttgaaaatatcttcgataagagtgtgctgaagaaattaagccgaagacactatacgggctgggggaagctgtccgctaaacttattaacggaatcagggacgagaagtctggcaataccatattggattacctcatcgacgacggtatttcgaaccgcaattttatgcagctgatccacgatgacgcgctgagcttcaaaaagaagattcaaaaagcacagatcataggggatgaggacaagggcaacattaaagaagtagtgaagtccctgcccggaagtcctgccatcaaaaagggcatcctccagtcaattaaaatcgtcgatgagctggtgaaggttatgggagggcggaagccagaatctattgtggtcgagatggctagagaaaatcagtatacaaaccaaggtaaaagcaattcccagcagaggcttaagcgcttggagaaatcactgaaggagttaggcagcaaaatactcaaggaaaacatccccgccaagctgtctaaaattgacaataacgcacttcagaatgatcgactgtacttgtattacctccaaaacgggaaggacatgtatactggagatgacctggatatcgaccggctatccaattacgacattgatcatatcatacctcaggcctttctgaaagacaacagtatcgataacaaggtgctcgtaagctctgcttccaatcgtggcaaatcagacgatgttccaagtctggaggtggtcaagaagagaaaaaccctttggtaccagttgctaaagagcaaattaatttcgcagaggaagttcgacaacctcacaaaagccgaacgcggtgggctgtcccgggaggataaggcatctttcatccaaagacagcttgtggagactaggcagattaccaagcacgtcgcgcgactgctagacgaaaaatttaataacaagaaagatgagaataaccgcgctgtgcggacagttaagatcataaccctcaaaagcactctggtgtcacagttcagaaaggactttgaattgtataaggtaagggagattaatgatctgcatcacgcccatgacgcatacttaaacgccgtcgtggctagtgccctcctgaaaaagtatcccaaacttgaaccggagttcgtttacggcgattatcctaagtacaattcctttcgtgagcgcaaatctgcaacggaaaaggtgtatttctacagcaacatcatgaatatctttaaaaagtccatttcactggctgacggaacagtcatagagaagcccttgatcgaagtgaacgaggaaaccggcgagagcgtatggaataaagagagtgacctcgccactgtgcggagagttctgtcttacccacaagtcaacgtggtgaagaaagtcgaaaagcagaatcacgggctagataggggaaaacctaagggtctgttcaacgcgaacctttccagcaagcccaaaccaaattcgaacgagaatctcgttggcgccaaggaatatctggaccccaaaaagtacgggggatatgctggcatttcaaactcttttgcagtgttggtgaaaggtaccatcgagaagggggccaagaaaaagattacaaatgtactggagttccagggcatcagtatattagatcgaatcaactaccggaaagacaagctcaattttctgcttgaaaaaggatataaggatattgagctgatcattgaattgcctaagtactccctcttcgagctgagcgacggctctcgcagaatgctagctagcatcctgtccaccaacaataaaagaggggaaatacacaagggaaaccaaattttcctttcacagaaatttgtcaagctcctgtatcatgccaaacggatcagtaatactatcaacgagaatcaccgaaagtacgtggagaaccataaaaaggagttcgaagaattgttttactatattttagagttcaatgaaaactacgttggcgcaaagaaaaatggtaagctgctcaacagcgcgtttcagtcttggcagaaccactccatcgatgagctgtgctcaagtttcatagggccaacaggaagcgagagaaaaggcctttttgaactgacgtcccgcggttctgccgctgacttcgagtttttgggcgtgaagattccgaggtatcgtgattacaccccctcgagcctactgaaagacgccactctcatccaccaatcagtcacagggctgtatgaaacccggattgatcttgcaaagttaggagagggctga

SEQ ID NO: 3231 - RNA, 4167 nt, synthetic construct
  misc_feature 1..4167: note = Cas9 variant
  source 1..4167: mol_type = other RNA
atgaccaagccctacagcatcggcctggacattgggacaaactccgtgggatgggccgtcataactgataattataaagttccttctaagaaaatgaaggtgctcggtaacacgagtaaaaagtacatcaagaaaaatcttctgggcgtattgttattcgactcagggattaccgctgagggaagaaggctgaagcggacagcacgccgacgttatactagaaggcggaaccgcatcctatacctccaggaaatttttagcaccgagatggccacactggatgacgcgttctttcaaagacttgatgactccttcctggtgccagatgacaaaagggattctaagtatccgatctttggcaatttggtcgaagagaaagtgtaccacgacgagttccccaccatatatcatctccggaagtacctggctgattcgactaagaaagccgacctgcgcctcgtttacttagcactggcccacatgatcaagtatcgaggtcattttcttattgagggggagttcaacagcaaaaataacgatatccagaagaattttcaggacttcttggacacatacaacgctatttttgaatcagatctgagtctagaaaattccaaacagctcgaagagatcgtgaaggacaaaatatctaagctggagaagaaagatagaattttaaagctgttccctggagaaaagaacagcggcatcttttccgagttcttgaagctcattgtcggcaatcaagcagacttcaggaaatgctttaacctggatgaaaaggcctcattacacttcagtaaggagagctatgacgaagatctggagaccctccttgggtacatcggagacgattattctgacgtgtttctgaaagctaagaaattgtacgatgccatcctactgtccggtttcctcacggtaactgacaatgagaccgaagcgccactgtcaagcgcaatgattaagcggtataacgagcataaagaagaccttgccctgttgaaggagtacatacgtaacatcagtctcaagacatacaatgaagtttttaaagatgacactaagaacggctatgctgggtacattgatggaaaaaccaatcaggaggacttctatgtgtacctgaagaacttactggccgagtttgaaggcgcagattatttcctagagaaaatcgaccgcgaagattttctcagaaagcagaggacattcgacaatggttctataccctaccagattcatctgcaagagatgcgggctatccttgataagcaggccaaattttatcctttcttggcgaagaacaaagaacgaatcgagaagattctgacctttcgcatcccatactacgtcgggcccctcgccagaggaaattccgacttcgcatggagcattaggaaacggaacgagaagataacgccttggaatttcgaagatgtgatcgacaaagagtcgtctgctgaagcctttattaaccgcatgacttccttcgatctgtatcttccagaggagaaggtgctgccgaagcactcattgctctacgaaacatttaatgtctataacgagctgaccaaagttagattcatcgctgaaagtatgagggactaccagtttttagacagcaagcagaaaaaggatatcgtgcgtctgtatttcaaagacaagcggaaggtaactgataaagacattatagagtacctacacgccatctatggctacgatggcattgaactcaaggggatcgagaaacaatttaattcctctctgagcacataccacgaccttttgaacattatcaatgataaggagttcctggacgattcaagtaacgaagcaataatcgaggaaattatccataccctcacgatttttgaggaccgagaaatgatcaaacagagactgtccaagttcgagaacatatttgataagagcgtgcttaaaaagctgtctaggcgccactataccggatggggtaaactttcagccaagttgattaatggcatccgggacgagaaaagtgggaacacaattctcgattacctgatcgacgacggaataagcaatagaaacttcatgcagctaatccacgatgacgctctgtcctttaagaagaaaattcaaaaggcgcagatcattggcgatgaagacaaaggtaatatcaaggaggtcgtgaaatctctccccgggtcgcctgcaataaagaaaggcattctgcagagcatcaagatcgttgatgaacttgtgaaggtcatgggaggcaggaaaccagagtccattgtggtagaaatggcccgcgagaaccagtatactaatcaagggaagtcaaacagtcagcagcgattgaaacggctggagaagtctttaaaagaactcggaagcaagatcctgaaggagaatattcccgctaaactttccaagatagacaacaatgccctgcagaacgatcgtttgtacctctattacctgcaaaatggtaaagacatgtataccggcgatgacctagatatcgacagactgtcaaactacgacattgatcatatcattcctcaggcattcctcaaggacaatagcatcgataacaaagttctggtgtcttccgccagtaacaggggaaagagcgacgatttcccatctcttgaagtcgtgaagaaacgcaagacattttggtaccagttgctgaaatccaagttaatatcacagcggaaattcgacaatctcactaaggctgagagagggggcctgcttcccgaggataaggccggttttatccaaaggcagctggtcgaaacccgacagattacaaaacacgtggcacgcctactcgacgagaagttcaacaataaaaaggatgaaaacaatcgggcggttagaaccgtgaaaatcattactctgaagagtacgttggtaagccagtttaggaaggacttcgagctgtataaagtccgtgaaatcaacgattttcatcacgctcatgacgcctacttaaatgcagtgatagcctcggctctcctgaagaaatatccgaaacttgagcctgagttcgtttacggggattatcccaaatacaactcctttcgcgaacggaagtctgccacagagaaagtgtatttctacagcaatattatgaacatctttaagaagtcaatcagtctggcagacggcagagtcattgaaaggccattgatagaggtgaatgaagagaccggagagtccgtatggaacaaagaatctgacctcgctactgtgcgacgggttctgagctaccctcaagtcaatgtggtgaagaaagtcgaggaacagaaccacggcctagatcgcgggaagcccaaaggactgttcaatgccaacctttcctcaaagccaaagcccaacagcaatgagaacctcgttggtgcgaaagaatatctggaccctaagaaatacggcgggtatgccggaatcagtaattctttcgctgtgttggtgaagggcaccattgagaaaggtgcaaagaagaaaatcacaaacgtactggagtttcaggggatttccatcttagatagaataaattacaggaaggacaaactcaacttcctgcttgaaaagggctataaagatatcgagctgattatcgaattgccaaagtacagcctctttgagctgtcggacggatcacggcgaatgctagcctctattctgagtaccaataacaagagaggcgagatccacaaagggaatcaaatattcctttcccagaagtttgtcaaactcctgtatcatgctaagcgcattagcaacactatcaatgaaaaccacaggaaatacgtggagaatcataagaaagagttcgaagaattgttttactatatcttagagttcaacgagaattacgttggagccaagaagaacggcaaactgctcaattctgcatttcagagctggcagaaccactccattgatgaactgtgttcaagtttcatcggtccgacagggagcgagcgtaagggactttttgaactgacgtctcggggctccgcggccgacttcgagtttttgggtgtgaaaatacccagatatagggattacaccccttcaagtctactgaaggacgctactctcattcaccaaagcgtcacaggcctgtatgaaacccgcatcgatcttgccaaattaggggagggatga

SEQ ID NO: 3232 - RNA, 4167 nt, synthetic construct
  misc_feature 1..4167: note = Cas9 variant
  source 1..4167: mol_type = other RNA
atgaccaagccctacagcatcggcctggacattgggacaaactccgtgggatgggccgtcataactgataattataaagttccttctaagaaaatgaaggtgctcggtaacacgagtaaaaagtacatcaagaaaaatcttctgggcgtattgttattcgactcagggattaccgctgagggaagaaggctgaagcggacagcacgccgacgttatactagaaggcggaaccgcatcctatacctccaggaaatttttagcaccgagatggccacactggatgacgcgttctttcaaagacttgatgactccttcctggtgccagatgacaaaagggattctaagtatccgatctttggcaatttggtcgaagagaaggcttaccacgacgagttccccaccatatatcatctccggaagtacctggccgattcgactaagaaagcagacctgcgcctcgtgtacttagccctggctcacatgatcaagtatcgaggtcattttcttattgagggggagttcaacagcaaaaataacgatatccagaagaattttcaggacttcttggacacatacaacgcaatttttgaatcagatctgagtctagaaaattccaaacagctcgaagagatcgttaaggacaaaatatctaagctggagaagaaagataggattcttaagctgttccctggagaaaagaacagcggcatcttttccgagttcttgaaactcattgtgggcaatcaagccgacttcagaaaatgctttaacctggatgaaaaggcttcattacacttcagtaaggagagctatgacgaagatctggagaccctccttgggtacatcggagacgattattctgacgtctttatcaaagccaagaaactgtacgatgcgattttgctatccggtttcctgacggtgactgacaatgagaccgaagcaccactctcaagcgccatgataaagcggtataacgagcataaagaagacctggcccttctgaaggagtacatccgtaacattagtttgaagacatacaatgaagtatttaaagatgacactaagaacggctatgctgggtacatcgatggaaaaaccaatcaggaggacttctatgtttacctcaagaacctgttagcagagtttgaaggcgctgattatttcctggagaaaatagaccgcgaagattttctaagaaagcagaggacattcgacaatggttctattccctaccagatccacctccaagagatgcgggccatcctggataagcaggcgaaattttatcctttccttgccaagaacaaagaacgaattgagaagatcttgacctttcgcattccatactacgtggggcccctggcaagaggaaattccgacttcgcttggagcataaggaaacggaacgagaagatcacgccttggaatttcgaagatgtcattgacaaagagtcgtctgccgaggcttttatcaaccgcatgacttccttcgatctctatctgccagaagagaaggtgcttccgaagcactcactgttgtacgaaacatttaatgtgtataacgagctcaccaaagtcagattcatcgccgaaagtatgagggactaccagtttctggacagcaagcagaaaaaggatattgttcgtttatatttcaaagacaagcggaaggtgactgataaagacataatcgagtacctgcatgcaatttatggctacgatggcatcgaactaaaggggattgagaaacaatttaattcctctctcagcacataccacgacctgcttaacatcataaatgataaggagttcttggacgattcaagtaacgaagccatcattgaggaaatcattcataccctgacgatctttgaggaccgagaaatgataaaacagagactctccaagttcgagaacatttttgataagagcgtactgaaaaagttatctaggcgccactataccggatggggtaaactgtcagctaaacttatcaatggcattcgggacgagaaaagtgggaacacaatcttggattacctcatagacgacggaatcagcaatagaaacttcatgcagctgattcacgatgacgcgctatcctttaagaagaaaatccaaaaggcacagattatcggcgatgaagacaaaggtaatataaaggaggtggtcaaatctctgcccgggtcgcctgccattaagaaaggcatcctccagagcatcaagattgtggatgaactggttaaggtgatgggaggcaggaaaccagagtccatcgtcgtggaaatggctcgcgagaaccagtatactaatcaagggaagtcaaacagtcagcagcgacttaaacggttggagaagtctctgaaagaattaggaagcaagattctcaaggagaatatacccgccaaactgtccaagatcgacaacaatgcacttcagaacgatcgtctgtacttgtattacctccaaaatggtaaagacatgtataccggcgatgacctggatattgacagactatcaaactacgacatcgatcatattatccctcaggccttcctgaaggacaatagcatagataacaaagtactcgtttcttccgctagtaacaggggaaagagcgacgatttcccatctctggaagtggtcaagaaacgcaagacattttggtaccagcttttgaaatccaagctgatctcacagcggaaattcgacaatttaactaaggccgagagagggggcctcctgcccgaggataaggcaggttttattcaaaggcagcttgtggaaacccgacagatcacaaaacacgtcgcgcgcctgctagacgagaagttcaacaataaaaaggatgaaaacaatcgggctgtgagaaccgttaaaattatcactctcaagagtacgctggtgagccagtttaggaaggacttcgagttgtataaagtacgtgaaataaacgattttcatcacgcccatgacgcatacctgaatgccgtcattgcttcggccttactcaagaaatatccgaagctggagcctgagttcgtgtacggggattatcccaaatacaactcctttcgcgaacggaagtctgcaacagagaaagtttatttctacagcaatatcatgaacatctttaagaagtcaattagtcttgctgacggcagagtgatagaaaggccactgatcgaggtcaatgaagagaccggagagtccgtgtggaacaaagaatctgacttggccactgtacgacgggtgctcagctaccctcaagttaatgtcgtgaagaaagtggaggaacagaaccacggcctggatcgcgggaagcccaaaggactattcaatgcgaacctgtcctcaaagccaaagcccaacagcaatgagaaccttgtcggtgccaaagaatatctcgaccctaagaaatacggcgggtatgctggaattagtaattctttcgcagttctggtgaagggcaccatcgagaaaggtgccaagaagaaaattacaaacgtgttggagtttcaggggatctccatactggatagaatcaattacaggaaggacaaattaaacttcctcctggaaaagggctataaagatattgagcttatcattgaactgccaaagtacagcttgtttgagctctcggacggatcacggcgaatgctggcttctatcctaagtaccaataacaagagaggcgagatacacaaagggaatcaaattttcctgtcccagaagtttgtaaaacttctctatcatgccaagcgcatcagcaacactatcaatgaaaaccacaggaaatacgtcgagaatcataagaaagagttcgaagaactgttttactatattttggagttcaacgagaattacgtgggagcaaagaagaacggcaaattactcaattctgcgtttcagagctggcagaaccactccatcgatgaactgtgttcaagtttcataggtccgacagggagcgagcgtaagggactgtttgaacttacgtctcggggctccgccgctgacttcgagtttctgggtgttaaaattcaaagatatagggattacaccccctcaagtttgctaaaggacgccactctgatccaccagagcgtgacaggcctctatgaaacccgcattgatctggcaaaacttggggagggatga

SEQ ID NO: 3233 - RNA, 4167 nt, synthetic construct
  misc_feature 1..4167: note = Cas9 variant
  source 1..4167: mol_type = other RNA
atgaagagaatcctgggcctcgaccttgggaccaacagcattggatgggccctggtgaatgaggctgaaaacgagaaagaaatatccaagatcattaaattgggtgtcagggttaatcccttaacaatcgatgagaagactaacttcgaaaaaggccggcctctgtctacgaatgcagaccgcaccctaaagcgaggggcccgtagaaacctccagaggtacaagctgcggcgcgagaatcttattgagatcctgatagataaccacatcattacaaaagaaactccattgaccgagatcggaaagggcacaacctatcaaactctctcactgagagcgaaagctgtgagggaacggattgacctggaggattttgccaaggtactcttagcaatcaataaaaagcgcggttacaagagtagccgaaaagcctccaacgacgaggaagggcaggctatagatggaatggcaattgccaaggagctgtatgaaagaggcatcacaccgggccagtacgtgcttgagttgctggaaaatgacaggaaatatattcccgatttctaccggtctgacctaaagcaggagtttaacaaaatctggaataaccaaaagaccttctatcctgagatcctcacggatgaactgtttaaagagcttgacgggaagaataagtcgcagacttgggctatttgccagaaaccattcaacataaagggaatcaaacgtattaccaagggtcgcgaaaagacaatcgagaactaccattggagagtcaagggcctgtcagggaagttgaatctcgaaaaactggccataattttacaggagatcaacaatgatatcaaccaaagcagtggatacctgggcggtatttccgacaagtctaaaaagctctatcttaataaagagactgtgggggaatttctgtacaagcagatcgcgaagaacccccacaccagcttgaaaaatcaggttttctataggcatgactacctagatgagtttgaacagatttggaagacacaatccaacttcaatgcaaacctgaccgacgagctcaaacaggaaatacgggatgtgatcatcttttatcagcgaaagattaaatcacaaaagagtctgatcagcttctgtcagtttgagtcttgggagcaggaatacttcgacaaggagacgggaaaaactaagacacgcaccgtcggcagaagggtgattcctaaatcctcaccacttttccaggaatttaagatatggcaaaatctgaaccacttggtattcactaatagcgagacagatgagaaaatcgaaattaaggaggttgaacaggagatccggaaagaactctttgaggagctgaacttacgcggcgacctgaatcccaacgatctactcaagattctgagaagtcagttcaagatcgggaaactttctaactggaagtgcaattttgagaaaatagaaggaaacaggaccaatgccgctttgttcaacatctatcagaagatttccgactttgaaggttacggcatcgattggaataaaagcaacgccaagaagattcgtaaagagctgaaggcaacgttccctgaaatcgggatagacgcttcgattctcgagtttgatgcctacaaaaagcaactgaccaatcagtcttcctatgagctttggcatctgttgtactcagcggaagaggacttcaaaatcagtgaacaggacaagctcatttatggaaacagctccgtgtctctgaagaaaaagttacacctgaaatttggcttcaatccagagtacgccaagatgctagcaaacctcagcctgatgtcagattatggtaatcttagtgctaaagccatcaagaagatattgccgtacctggaagacgggcacctctattccgaggcttgtcggctggccggctacaaccatagcaaatctttaacagcagaggaactggagaagtttgaacccaaagccaaacttgatttgctcaaaaagaactcactgcgaaatcctgtcgtggagaaaatcctaaatcagatggtgaacgtcgttaaccaagtgattgacacttacggaaagccagatggcgtaagaatcgagctggctagggaactcaagaaaagtgcgaaggagcgcgcagaaatgaccaaagggattgccgacggaacacggagaaatgaggaaatcaagaaaataattactcagaagttcggtatccccaaccctaccaagagcgatctggtgaggtatcgcctttggcaggagttggagtcccgaggctacaaagacatcttcacagataagtatatttctccagacaaaatcttttcgagcgaaattgatatagagcacatcattcccaaggctctgttattcgacgattccttttcaaataaaaccctcagtttccggaacgtcaatctgaagaaggccaaccgtactgcacttgactttatcacgcaggactaccaatctaatgtggaagcctataaagagagagttgaaacatggaacaaggataatcatattagcaaagggaagaggaacaaactgttgatgtccctcaaggacatcccggatggattcatagagcgcgacctgagaaattcacagtacatcgctagaaaggccaaaaggatgctatatgaggtgtttcctaacgaagtcctggcaaccagcggctctattactgataagctccgatccgactgggatctgatcaatgtgatgaaagagcttaacttgcccaagtacaaagcgctgggtttaaccgaatacgaggaacgcctcgacaaggggacagaggagctgttcaagcacgaagtaattaaagattggaccaagcggaatgaccacagacatcacgctatggatgcccttgcagttgcctttactacacataaccacatccagtatataaacaatctgaacgctaggaaagacattacgcaagataatcatccaatcatcaagaacattgagaatctaataaccgaagtgaacagtaaaggcaagcgtgtcttcaaagcccctatgagctcttttcgcgagtccgcaaaggagcagatcgaagctattctcgtgtcattcaagaataaaaacaaggtcgtgactaaaaatatcaaccagacaaagaaagagggaggctttaattaccagaacgccaagacaccccgggggcaactgcacaaggaaaccatttatggaaaaagtaagcagccattggagaaacccgttaagatcaataacagattctgcaaaaagcaagtgggtctgataatcaatttcaaggaacaggaggcggtattacaccatctcaaaaagtacgacaacaatgagaaaattgcctttagcaacaagactctgaaatcggaccctatccaggtcaacggctccccacttagggaagtgaagattttcgaggaaatctttaccatacgaaaggatattaatccggacaacttcaaaacgcagaagcacctggataaaatcatcgacaaggggattaaagaggttatgaagaaacggttggaagagtataatggagattttaagaccgctttctctgacctcgataagaaccccatctggctgaatcagagcaaaggcataacaattaagcgcgcaactatctcaggtgtgaccaacgccgagcctctacatcaggctaaagaccacctggggaatattatccttgatgacaacggcaaggaaataccaattgattacgtcagtacaggaaataaccaccatgtggccatctatcaagacgagtccggcaatctccaggaagaggtagtgtctttttacgaagcagttatccggaaaaaccaggaccaacccattatcaagaagaggcaccctaaagggtggaagttcctgtttactatgaaacagaatgagatgttcgtctttagctccgagaacttcaatccatcagaaattgatttgctggacgagaagaacgcggccataatcagccccaacttattccgggtgcagaaaattgctaccaagaattacatgtttcgacatcacctcgaaacggaggtgacaaacaatctggatttcacctatagacattttcaggccactgagtggcttcgcaacctgtgtaaggtcaggatcgaccacatcggacgtattgttcaaataggcgaatactga

SEQ ID NO: 3234 - RNA, 4170 nt, synthetic construct
  misc_feature 1..4170: note = Cas9 variant
  source 1..4170: mol_type = other RNA
atgatcattagaacctacgagctgaagacaataactacgatcgccattctcaaaatgttccagcttctgaccggcgggttgagcatgacaaagttaggaaaaccctatggtatcggcgtggacattgggtccaactctatcggatttgctgcagtcgatgaaaattcacacctgataaggctaaagggcaaaactgttatcggtgccagactcttcgaggaagggaaggcggctgccgaccgccgagcaagtcgtaccacaagaaggcggctgagccgcaacagatggaggctttcctttctgcgggatttctttgagtctcatattacccctactggaccaaatttctttatgcgccaaaagtactcggaaatctcaccgaaagacaaggcccgatataaatacgagaagagattgttcaacgataggacagacgctgagttttatcagcagtaccccaccatgtatcacctccggaatcgtctgctgacggatcctagcaaagcagacgtgcgcgaaatttacttcgccatccatcacatactcaagagtagaggccatttcttaacttccggctacgctaaggatttcaacaccaataaagtagccctgaacgagatttttccagcgcttcaggacgcatatgcccaagtgtaccccgatttggacatcacattcgatgaaaataaggtcaacgagttcaaaactgtgctgctaaatgagaaggctaccccttctgacacacagagggccctcgttaacctgcttctggcagaagacggggataaagacattttgaagcagcagaaacaagtgctcaccgagtttgctaaggccgtcgtgggactgaagacgaaattaaatgtagcgctgggtactgaagttgatagctccgaggccacagtgtggaacttctcactcggccagcttgacgataagtgggcagggatcgaaagtgctatgaccgacgagggaactgagatcctggatcagattcgggacttgtatcgagcccgcctactgaatggcatagtcccagctggtaaaacactcagccaggccaaggtggatgactacgcacaacaccacgaagatctggagctttttaaagactatctgaagcagttggaagacgatgggaccgccaaggctatcagacagctctacgacaggtatattgatggagacgatgcgaaacccttcgtgcgggaggactttgtcaaggcactgacgaaagaagttaccgcccatcctaacgctaagtctccagagttactggagcgcctagcccaaccggatttcatgctcaaacagagaaacaaggcaaatggcgccatccccgtgcagatgcagcaaagggaactggaccagataattaagaaccagtccgtatactacgattggcttgctgcccctaatccagtggagaaacaccgtaagtcaatgccctatcagttggacgaactgctcaactttcggatcccttactatgtcggcccactggtgacagcaaaagagcaaaaggcggctcaagggggagttttcgcctggatggtgcgaaaagatcccgacggtaatatcactccgtacaactttgatgaaaaggtcgacagagaggcaagcgccaataccttcattcagaggatgaagacaactgacacctatcttatcggcgaggatgtgctgcctaaacagagtttgctctaccagcgctatgaagtactgaacgagttaaataacgttcgggtgaataacgaaaagctgtctattgagcagaaacagcaggtcataagagagctatttgaaaggcataattccgtgacaatcaagcaattcgctgagaacctccgcgcccacggggactacgcacacattcccgaaatccgaggactggctgatgagaaacggtttcttagctcgttgtctacctaccgtcagctgaagtccctcctgccagacgccatcgatgaccctgcgaaacaggccgatattgaaaatataatcgcttggtcaactgtcttcgaggacgcagccattttcaagacgaagttaaaagagatcaactggctggatagtcaaacaattaccaaacttagcaacatcagatataggggctggggtcagttttcccataaattcttgaatgggctcactctgggcaacggacacaccataatccaggaactatttctgtctaataacaatctcatgcagattctgacagacgagacccttcaaaagaaaatgactgaattgaacgctgataagctgaaggccgcaaatatcaacgacgcgattgatgacgcctacacaagcccctcaaataaaaaggctttacgccaggtgctccgggttatcgaggacataaaaagagccgcagatggccaggacccaagttggctgtatgtggaaacggctgatgggggaggtacccccggcaagaggactcgagcccgccagcatcaacttcaggagatttacgcaaacgccgctcacgagctgatcgactccgcggtaagaggggaattggaggataaaattgccgacaaggcagatttcaatgaccggctcgtcctgtattttatgcagggaggcagggatatctacacaggtacccctctaaacatagaccagctgagctcttatgatatcgaccatattctcccacaatcactgatcaaggacaatagtcttgataaccgtgtgttggttcacgctattatcaatcgcgaaaagaacgccacattcgccagcactatatacgctcagaagatgaacgcaacctggcggcagtggcacgaggccgggctgatttccggcagaaaattaaggaatctccaaatgcgaccggaccagatcgataagtacgcgtctggatttgtggctcggcagctggtcgaaacgcgccagatcattaaacttaccgagcaaatcgtggccgcacagtatcccgagacaaagattatagccgtaaaggctggcctgtcgcatcagctaagagaggaactcgaatttcctaaaaacagggacgtgaatcactaccatcacgcatttgatgccttcctggcggctcggatcgggacttatttgctgaagcgatttccaaacttacaggccttctttacctacggaaaattcaagaaagcagacgttaagaaactcagaggtttcaattttattcgcgatatcacacacgccgaggacaagattgtcgtgaaggatactggcgaggtgatctgggacaaaaagagggatgtcgacgaactggatcgtatatataacttcaaacggatgcttatcacccatgaggttcactttgaaaaggctgacctgttcaaacaaacggtgtacggggccaaggacagcaaggaggcaggaggcaaaaagcagttgatttccaaaaagaaaggttatcccgtggatatctacgggggctacacacaggaaaccggatcatatctcagtgtagtcagactgactaagaaggctatgtacgccgtggttaaagtgtctacaagggacgcggccaagctagcagtcgctaaaagcatttccgagcagaaggagaatgaaaccctgaacgatatcatagacgagaaactttcaaagattagcaagaatggcaaaatcactcatgaactctttgaggtggttctgcctcgcgtggggcaaaagaccttgttcaaaaactctaagtataatctgtttttagtaaactccgatacatacatgcacaattatcaggaactctggatgccacgagagtaccagaaaatgtggaaggacatcagtctgagcaagtatggagatgcccagacggaggaccaacttgatcagattttcggctttatagtctctcaggtgaactcctacttcaatctgtacgacatcaaccaatttcggaaaaagttgaacgatgctgcagacaaattcgccaccctccccatgcgggatactgacgacatgcagggtaagattgccacaatcgggcagctgctaattggactgcaggctaatgcggcaaggtcagatcttcgcaacctcgacatcaaaaccccgctgggcttgttacaaatacctaatggtatcagtctggatagcgacacatcggtggtctatcagtccccaactggcctcctggaacgtgaggttcatctttctgatctgtga

SEQ ID NO: 3235 - RNA, 4170 nt, synthetic construct
  misc_feature 1..4170: note = Cas9 variant
  source 1..4170: mol_type = other RNA
atggccagagactacagcgtgggcctggatatcgggacctcctctgtcggatgggctgcaattgacaacaagtatcacctcataagggccaaatcaaagaatcttatcggtgttcggctgttcgatagtgcggtgacagctgagaaacgccgaggctaccgtactacgagaaggcggttgagccgcagacattggaggttacggctgctaaacgacatttttgccgggcccctcaccgatttcggagacgaaaattttctggcacgccttaagtattcctgggtacaccctcaggatcaatctaaccaggcccatttcgctgcaggcctgttgtttgactcgaaagagcaggataaggacttctaccgaaagtatccaacaatctaccacctcagactggccctgatgaatgatgaccagaaacatgatctcagggaagtgtatttagctattcaccacctggtcaagtaccggggtcattttcttatcgagggggacgtgaaagccgactcagcgttcgatgttcacacttttgcagacgccatacaacgttacgctgaaagcaacaatagtgatgagaacttgctgggaaagatcgacgagaaaaagctatccgccgcactcaccgataagcatggctctaaaagccagcgcgctgaaacagccgagaccgcgttcgacattctggatcttcagtccaagaaacagatccaagccattctgaagtcagtggtcggcaatcaggcaaacttgatggctatctttgggctcgacagtagcgccatatctaaagatgaacagaagaattataaattctcctttgacgatgctgacattgacgagaagatcgccgattcagaggcactgttaagcgacactgagttcgagttcctgtgcgatctcaaggccgcttttgacggacttacactgaaaatgttgctaggtgatgacaagaccgtgagtgcggcaatggtaagaaggttcaacgaacaccagaaagattgggagtacattaagtctcacatccggaatgccaaaaacgctggcaatgggctgtatgaaaagtccaagaaatttgacggaatcaacgccgcatacctcgccctgcaaagcgataacgaggacgatcgaaagaaagctaagaaaattttccaggacgagatatcgtctgccgatatcccggacgacgttaaggcagattttcttaagaaaattgacgatgaccagttcctgcccatccaacgcacgaagaataacggcactatacctcatcagttgcacagaaatgaactcgagcagattatcgaaaaacagggtatctattacccatttctgaaggatacctatcaagagaactcccatgaattaaataaaattacagcgctgatcaacttcagggtgccctactacgtcgggcctctagtggaggaggaacagaagattgctgacgatggaaagaatataccagaccccactaaccactggatggtgcggaaatcaaatgataccatcacaccttggaacctcagtcaggtcgttgacctggataagagcggccgcagatttattgagaggcttaccggcacggacacttatttgatcggggaaccaacactgccgaaaaattccctcctgtaccagaagttcgatgtgcttcaagagctgaacaatatccgtgtatctggacggcgattggacattagagccaaacaggacgcatttgaacatctcttcaaggtgcagaaaaccgtcagcgccactaacctgaaggattttcttgtgcaggctggttatatatcagaggacacacaaatcgagggcctggccgatgttaatgggaagaacttcaacaatgcactaaccacgtacaactatctcgtgagtgtcctgggaagggagttcgtggagaatccctccaacgaagaacttttggaggaaattaccgagctgcagacagtatttgaagacaaaaaggttctccgccggcagctggatcagttagacggcctgagcgatcacaatagagagaaactttctaggaagcactacactggttgggggcgcatcagtaaaaagttgctcaccacaaagattgtgcaaaacgctgacaaaatcgataatcagactttcgacgtccctcgaatgaaccagtcaataatcgataccctgtataatacaaagatgaacctaatggaaattatcaataacgccgaggacgactttggcgtgcgggcgtggattgataaacaaaataccactgacggagatgagcaggacgtctacagcctgatcgatgaactcgccggcccaaaggagataaaacgtgggattgtgcagtccttcagaatcctggacgatattacgaaggctgttggatacgcacccaagagggtgtatcttgaatttgcccgcaaaacacaggagtctcatttgaccaactcgcggaagaatcaactgagcactttactcaaaaacgctggtctgtccgaacttgtaacccaggtctcacagtacgacgccgcagcgctgcagaacgatagattgtatctctacttcctgcaacagggcaaggacatgtatagtggggagaaactaaatctggataacctctctaattacgacatcgatcacataatccctcaggcctatacaaaggacaacagcctggacaatagggtgcttgtttccaacattaccaatcgacgcaagtcagatagctctaactacttgccagctctgatcgacaaaatgcggcccttttggtccgtgttaagtaagcagggactcctgagcaaacataagttcgccaatcttactagaacaagggattttgacgatatggagaaagaacgtttcattgcacgctctctggtcgagacgcggcaaatcataaagaacgtggcttccctaattgactcacactttggcggtgaaaccaaagccgtagcaatcagaagtagcctcactgccgatatgaggcgatacgtggacatcccgaagaatcgggatattaacgactatcaccatgctttcgatgcgctgttgttttcgacagttgggcagtacaccgaaaattccggcctgatgaagaaaggacagttatctgacagcgccggcaaccaatataatcgctacatcaaggaatggattcacgcagctagactcaacgcccagtcacagagggtcaaccctttcgggttcgtggtgggaagtatgcggaatgccgctcccggtaaactgaacccagagacaggcgagataactcctgaagagaatgcagattggtccatcgccgaccttgactatctgcataaggtcatgaactttcgaaaaattaccgttacgagacgcttgaaggatcagaaggggcaactctacgacgaatctaggtatcccagcgtgctgcacgatgcgaaatccaaggcttcaatcaatttcgacaaacataagccagtggatctatacggaggctttagcagtgccaaacccgcatacgccgctctgattaagttcaagaacaaatttcgtcttgtaaatgtcctccggcagtggacctattctgacaagaactccgaggattacatcctggagcagataagaggtaaatatcctaaggcagaaatggtgttgagccacatcccatacgggcagctggttaaaaaggacggcgccttagtgacaatttcgtcagcgactgagctccacaatttcgaacaactgtggcttccgctggctgattataagttgatcaacaccctcctgaaaacaaaggaggacaatctagtcgatattctgcataacaggcttgacctccccgaaatgactatcgagtctgccttttacaaagcattcgacagtatactgtcctttgccttcaatcgctatgctttgcaccagaacgccttagtgaagctgcaggcacatcgagatgactttaatgctctcaactacgaggataaacagcaaaccctggaaagaattttagacgccctgcacgcgagccctgcctctagcgatttgaagaagatcaatctatcctcaggattcggccggctgttcagtccaagccattttacgctcgcagacacagatgagttcatctttcagtctgttaccgggctgttctccactcagaaaacagtggctcagctttaccaagaaaccaagtga

SEQ ID NO: 3236 - RNA, 4170 nt, synthetic construct
  misc_feature 1..4170: note = Cas9 variant
  source 1..4170: mol_type = other RNA
atgaagaactacaatatcagcctggtgccctccccttctggcgtcgggtatgccgttaccgacgataacctcaatattataaaaccagtgcaccatgtatcaggaatcggtagtagacttttcaacgagggcagctccaagcaggacaggcgcaattctcggtcggctcgacgttcaagacacaggcaacaggggcggattaaagcactgaacagcatcatgaaggatgaaattatcaaagtggacccgacatttttcgatcgcttgtaccagagtgagttatcacccctggacaagaataagaaatatagaaacataatctttgataagccttctgtcgaaagctactattacaaaaagttcccaactatttatcatctagagaaatacctcatcaatacggacggaaaggccgatattaggctgatctactgggcgcttcactccctgttgacccatcggggccacttttataacacaactcccgtgtcacagttcaagcctggtgctctcaatataaaagacaagtttattgaactgaaccaactgaatcaggttaaaaccttcgagtttagtgtggccaacacaccagagatcgaacacattctcaaggatcgctacatcagcaaacagaataagatcaaccagttagcagagctgcttttcgaacaagagcccgagaaagacattcagaaggccaacaccaaggtcgctaaaactatagcaaaggccatcttggggaataaatttcagctggatgaaattatcggactagacgtgaacaagtctgagaaaaaggaatggtccctccagctgtcagaccttaatctggatagcaagatagacgagttgagtgattctctcacagaccaacagctgcgaattttagaaatcctgcaggagatgtatgctgccaccacgctccttgatatcctgcaaggctccgacagcttgctagatgcgaaaattaagtcgtacaacgagtataaacagaatagactcctgttctttgacctgcttaagactctgcctgataaaaaggcacatttgctcaggcagggctacaccctgtatttaaacaatcaccatcgggacctggcctctgctcgtaaggatctagggatcgtagccgcaacaaacttctccaaaactgacctctacgctctgattaagaaaacccttaaggacgaaccagagacaccggaatccaaaaaggttttgggactgatagataagggtgagttcctcaataaacagcgcaccgacctgaacacgtacatcccctatcaacttaatgccctgattttgaacaagatcctcaaaaatcagggcaagcactacccttttctgatcaaagaaaacccagcggagcccgatagaaaggaggccccttatgaaattagtcagttaatgcagttcactataccatactattgcgggcccctggcaacaccggaggaacaaaagaatctacctgagagctccaggtttggatggctcgtgcggaaggaagagggccgaatcaccccctggaacttctacaacaagattaatgtcatcgagactgctaacgcctttattaaacgctctatcggtaaggacacatatctgcttagcgaaccagtgttgcctgataattcactgctctaccagaaatacaaggtgctgaacgagttaagttccataagcctggtcgacgctaataccaaaaaggaaaagaaacttacggccaagatcaaacagttgctctataaggaggggttcaaaaagcacgttaccgtgtctaagacaatggcactgaaaattctaaacgataataacgtacccacttcagacatcctgggactcagtaccggcaagaaatttgataatagcctgtccacatacaactcttggaagaaagccttcccagagcagattgacaatccccattatagacaagatcttgaatacatgatcgagtggtcgactgtgtttaccgacaggaagatattggtcgaaaagctgaaagagattgaatggttacggcctgagcagatcaagttcgtgctcgagcaccgcctgacaggctgggggaaacttagcaagagactgttggttgaactcaaagataacaagggaaaatccaatattgacaacctgtttaataccaagaagaacttcatgcagatcgtgtcacagcaagtctataacactcagatagaggctatcgcgctaaaaacgacaaagaatcagagtctggacaacattctcgaagcagcctacacctctccagctaataggaaagccatccgtcaaactatgaaggtggtaaacgagattgttaccctggcaggtaaaggcacacatccggataagatctttcttaccttccagcggagcaaggaacaggaggggaaattgactacagaccgagcctcctcactgttaaagatatatagaggaattaaagatcccctctgtacgaaggagctggtggacgaacttagcaaaaatgtcagggctaacctgatcaagaccaaggagtacctatactatcagcaactcggccgcgatgccctgactggtgaaatcattgacaaaacagatttgcggaattacgcagtgctgcacatcattcctagatctgtcgtggttgacgattccataaacaatttagtgctcaccaaggtaaagaacgcgaaggagagtatcgtcgtgcagtatgggagcaaaaatatttctgacatctccatgtcagttaaggatttctggaacaggctgcagaaacttggcctgtttagtaaaggaaagttgcgcaatctcacaactgacctgaccgaactaaaccagtacgagaaacaaggcttcattgctcgacagctggtggagacgaatcagatcgtcaaacttctcgccaccatactgcaggggcaatttccacatacaaaaatcattgaagtgcggcaggagcagatcgcaaacattcgttatcaattggatatctacagactgagggacttaaacgtatattaccgcggaatggacgcctacctcgctgccgtggttggtacttatctgtacaccgtctatcccaaggcacggagattctttgtgtacggcaagtatcttaaacaggataagaataacagggaagaggggcagttcaaaacaagcggacactcgtttaatttcctgtggaagttgttttacggcggtgaggacgaaatatatgtgcaggggactaacaatattgctttcaacaaaaaggatctcctgcagaaaatcaaggaggtcaataactacaagtttcaaaatgtttccctagccaccggcacgcgacgctctgacctgttcaaacagacaatctaccctcggcaggaaagagatgtgaagaaaagcaggacccttattactaagaaaaacggactctttacagacatatatggcgggtacaccggaaatgtgaactcatatttcgtactggtccaaactaagtacaagaaagatccagacaagttcaatttgtatggtgtgcccaaccgttacgttgcgatgttagagcagagtaaatccaagggcaattatgaaaccaaactgaaggaggtgatggagccgatcattaagaactctaataaacgcatgatcgggtacaagattctcaaagatcggatcctgtacaaccagataatcgaagacaacggatataagtttttcattacaagctcccagtacagacacaattttaggcaaatgatcctttcagatcagagcaaaaagattctgatggactatgtcttcgaccctaacttttaccgacataagaaaacggaggatgtgaataacgacaaggatgccaaattgatcaaggtttatgacgaaatactataccagattgatcactatctgcagatcttcaccatcggccatcacattgacaaactcaagaaagctcggccactgtttgagaagtgcactcttgcagaaaaggcccaagtgttaaatgatatcctgataattgctggtagtaaccagacagagctcgccttgaaacccctgaagaccacaaaactcactttctctaagcagaattgtcctctgaccaaagacgcaatcttttactaccaatcccccacggggatgattacacgcaaggagagcatcaaggatatacttaaacagaacatttga

SEQ ID NO: 3237 - RNA, 4173 nt, synthetic construct
  misc_feature 1..4173: note = Cas9 variant
  source 1..4173: mol_type = other RNA
atgagcagaaagaacatcgtggaggactacgccatttccctggatataggcaatgcttctgtcgggtgggttgcattcacccccaactataggctcgtgcgggccaaaggacacgaacttatcggtgcgcgcctgtttgagcctgcttcaacagccgaagaacgacgtatggcaagaactacgaggcggcgctacagtagaaggcggtggcgcttgcgaatgttagacagcatgttcgatcaggccctgtccgaagtagacccatcttttctaatgagaaggaagtattcgtgggtgcatccggaggataaaaataacgaggctcactggttcggcggggtcctctttgactcaaatgaacaagataagcggttctacgagaaatatcccaccatttaccatctgcgtaagagccttatggaagacgatgagcgccacgacatcagagaggtgtatctggcaattcatcacatgatgaagtacaggggaaactttttgacagaaggcgagctcgcccctagttccgttttcgatgtggaagactttctgaaactgctcactgagatcttacagtacgctgatgaaggtgagaccgacgaggacctggaacttcaggccgatgcgaatgggttgacagaggcactgtgcaccactaagggatctcggagcatacgagccaaaaacgctatctccattctaaaggaaggcgccgcactctcaaaacgccaggaggctatcattagtgccgtcttcgcgggcctggaagggaataaacttgacctgacaaaggtgtttccaaacaaagagtatacccccgaggataagaaaacgttggccctctacttcaataaggcagactatgatgaaaagagagtagctatcggagacagcggtctgttagaggataacgaatgtgactttctggattgcataaggcggcaatactctgccattgctctcaagcagcttctgggcgacttcacttccatctcagagagcatgtgtgcccgctatgaacagcaccagagaaattgggatttgattaaaaggtactgccgtgaggagagtaacgcagaaaatatcaacaagaactatggggccctagttggatgggagatcgtgggcggtcaacggcgatctattagaggggctaaggactacgaaaataaaaggaaggcggcaaacaaattctttgaggagctgataaagggatccgccctccctgaccaggaaaaagagcgcctgcttcatgatatcgaaaatgacgagctgttcccagtccagcgggatagcggcaacggcgtgattccctaccagttgcacctcaatgaactgaagaagatcatacaaaaacaggggagatattacccttttctgctggagacctatattaaggacggaaaagaggtgaacaagctagaaggtctcctggctttcagggtcccatactatgttggcccgcttgtgtcgcgcgatgacatgcagtcttccgataatcgagagaaccattggatgatccggcgtaaaaagggggtaatcacaccctggaattttgacgaaatggtggataaggacaaatcaggacacgagttcattaagagtttggtcggcactgatagctacctgctcggtgaaaccacactgcctaaaaactcccttctgtatcaagagtttgaggtgttgaatgaactcaacaatgttagactgtctatcaggaccgggaaccactgggccgacaagcgccgggtgagattaggccataatgagaaaaagctgctactcgaggagctgttcgcaaagcaggccacggtcactaaaaaggctgccgaaaaccttttgaggcgaacatacggaaacacctacgagattagcggcctggcagatgagaaaaagtttgtgtcaagtctctccagctatgggaaaatgtgtcgcactctgaaggcgtcttacgtaaattcacacaaagacgttgtggaaaagataatcgagttacagacagtcttcgaagacaagaaaaccctgaagcatcagcttcaattgctcggagagctggctgagacgaactgcgaactactgagtaatacccactatacaggttggggcaaactcagccggaagctgcttacttccaaagtggtcgtgtgtaagattgggaacgattttgccccagcaaagcattctatcatcgagattatgagagaaaccgacaggaatttcatggagataatcacagataaagacttgggagttggcgaatggattaaccagcagaatgtgggtgccgaggatgggaactcgtaccaggacatcattgatgacctgcgtgtaagccccaaggtcaaacgcggcatcaatcaagctatacgggtgatcgatgacatttccaaggccgttggaaaagagccttcaagaatctttttagaactcgcaggcgatgtgcagcagagtgctaggactgtctctcgaaagagccggctgcaggggctttataagtccgccggactgcaaaaagagttccgcgacttggcggaatcactcaacgagtgcagcgataatgacctgagagacgataggctattcctgtactatacccagctcggtaaggacatgtacacaggcgaaccactgaaccttgatcggttgtcttccgactacgatattgaccacatcataccccaggccgtgacccagaatgatagtctggacaaccgagtattagtggctagagttgcaaatgcccgcaaaactgatagctttcaatatctcccggagattgctaacaggatgcgtaacttctggcaggagctgcttgacgccgggctgatctctcgggtcaagtttgatagactaaataggcagaacgacttctcctcacacgaaaaagagcgctttgtgcaacgaagtctcgtggaaacgagacagattatgaagaatgtcgcaacaatcatgcggaagaggtacggaaacagcgcggccgttataggcttaaattcggagttgaccaaagaaatgcgccagtatctgggtttctcccataagaaccgtgacatcaatgattaccaccatgctcaggacgccttatgtctcgggattgcaggccaatttgctgtgaacagaggattctttgccaatggcatggtgtctgatggggcagtaaacagctataatctgtaccttcaggactatctgcggggatacagggagaaaatgtcagccggcgagcgccgaagaaacaaggctttcggttttatcgtcgggagtatgaactcccaggattctgacaaacggattaatcctaagactggagaaatcgcgtgggatgacgaggataaagtgtacttgaggaaggttatgaattatcgcaagatgctcataacccagaaagtgggcgacagcttcggtgccctgtacaacgaaacaagatatggcacctccgcaaaggagggggtcaacggaatcccctttgataaacacaagcaagacactgctctatacggcgggttctcaagcgccaaaacagtgtatgttgtgctgatcgaggccaagaagaaaacgaggcttgtaaatatcaccatgcaggaatacgctgagctcggagatcacccaagtgacgacgcactgcgggccgtcttggcgaagaaaaagcctgaatatggcaaagctcgtattctgttacgccatattcccccaatgcagctcattcgatacggtggggccctggtgactgtgaagtctgcaacagagcttaacaatgcccagcaactgtggttgccctacaaggaatattgcctcttcgatgacgtcatatccagcgctatcgatgttgacgaggcaagactgtgtcagatgctagatgtgattctggacgccatccagaaatactatcctaagcaaaggtttgatgagaccggactttcggcgttccacaacgcttttaatgaagtatcagccgaggacaaaaagcggattgtgggcgaaatggtcggtatgctccatgcagatgccaaaaacgctaatctgaaggccttgggcatgtctgggcgctggggaagaatgagtaaccagtccggctacacattcgcagacagcgatgagtttatcttccagtctccaagcgggttatttgaaaagaggatatccgtgggagagctgaaaaagcggcgagctagatga

SEQ ID NO: 3238 - RNA, 4173 nt, synthetic construct
  misc_feature 1..4173: note = Cas9 variant
  source 1..4173: mol_type = other RNA
atgaaggaggtgaaagactacatcattggcctggatatagggaccaacagctgcggatatgtcgttacagacaagcagaataacatcctcaaacttaagggtaaaactgccattggcgctagactgttcaaggaaggggaggcagccgcggataggcgggcttttcgcacgacccgacgtagattggccaggcggcgctggagattaggactgctagaagagatcttcgacgaagagatggcaaaggtggattcctctttcttcaggcggctcaaagagtcagactacagtcccaaggatagccgcaaacaatttaattccattgtattcgaatcttcggaggccgacaaggatttttatgacaaataccctacaatctatcaccttcgaaacgctcttatgcatgatgaccagaagcacgatctgagagaaatattcttggcagtgcatcacatcgtcaagtacaggggcaattttctccgggaggactcagtgaaagccttcaaggctgccaaatttactctgcagggtgaggacgggattggaccagttgataagctgaacgacctcttaaaagaaatctatattgaggcggcaccggaactggccaccgataatcttagcaagatcgaggaaataattaaagacaagaagttgtacaaacaggataagctgaaacaagtggctacactactcaccaaggaggccgacactaaagataaggcaaagctgaacaaagacgtcgctaaacaggtggccaatgcgttcatgggctacatgatcatttttgatacaatcttcaaccttagtgacgtagattccaaagactataaggttaaattctctgacgccaatatcgatgagaagctggacaccttgacgagcctcctgactgataagcagaccgaatttgtgttagagctgcagaacatttacaatacaatagtcctcaacgaaatcgtgcccgacggcaaatccctttcagagagtatggtgaagaaatatgatgaccataaggaagatctgaaattgttcaaggcatacctaaatagcctgactgacgtcaagaaagttaaggagctcaaagctgcctatgtgctgtacgtaaacaaccgtaaggctaatcttctggccgcaaagaagttgctcgggaaaaaggccgataacatgaataactttgagattttctctaagtttgtggctgacaatctggatgactccgaattagcgaacaaaatccgcgcaagactggatctaggagagttcctccctaagcaaaggaccaatcagaacggtgtcataccatatcagctgcaccaggtggaacttacacaaattttggagaaacagggcaagtactacccctttctgatcgcccctaatccagttgaatcacaccggaacaatgctccctatcgaatcagcgagctcgtgagtttccgcgtcccttactatgtggggccactgattgacccgaacaatgccgagtctgaacaggacaaagcaaactccagctttgcctggatggtaagacaaaagcagggacagatcaccccctggaatttcgaggaaatggttgatacgactgagtcggctaacaagtttattaaaaggatgacaaccaaggacacttaccttctgggcgaggatgtgttgcctgcctcttccctcatatatcagaaattcgtcatcctgaacgaattaaataacattaaggtgaatggtatcaaactgacatcagaggaaaagcatcaaatctttgacgagctattcaaggtccagaaaagtgtgagcctcaagaacctggttaatttccttaccgcacacgggtgtgtggcgccaaacgtaacgggattgtccgatggcaccaaatttaattctagctactcaacatatattgactaccggaagatattcggcgctgaaatcgataacaaagacaagcaggccgattttgagaagatgattgagtggagtactgtcttcgaagaccgcaaaatctttaagagaaaactggaggaaattacctggctcacacccgatcagatcaagcaagtgtccagcaaaaggtactctgggtggggacgtctgtcaaagaaattactgactcagataaccgacgagaatggtgttaacatccttcagcggttgtggaatgaaagtgagaacctcatgcagattctgagcgatcctgtgatcaaggagaagattgtcgcagccaattcctctttcacaaaagctaccgacatggaagacatcctagccgaggcatatacttcgccacaaaacaagaaagctatacgacaggtgatgagagtagtggatgacattatcgccgcggcccatggcaagaaacccagccagattgctatcgaatttgcaagggaggatcaggacaatccgcaaatgacgaagtcccgcaaggcccagctggatcagatatacgctaaaatctcagacgaatttctcgataacgccgttaagaacgagctgaaaaatatgaaggacaacaaacctcttgcaaaggataaggtctttttgtatttcaaacaaatggggcgggacgcgtacacaggagagaagctgagtttagataatctccaggactatgacattgatcacatctacccccagtcttttattaaagacgatagcttcgacaacagagtgctggtgcagagggccgtcaataacggcaagtccgataatgttccagtgcttctgtttggtaacaaacaagctgccgacttggggatgaccatccgccagatgtggaagaagtggctcgaactgggcctaatatcaaaacgaaagttcaataacctgattactgatcctgagaaaatcagctcttatatggcatccggattcgtgaatcggcagctcgtagaaaccagtcaggtcatcaagctggtggctaacattcttcaagccaaattgcccgacacagagatcattgaggttaaggcaagctacaattctatactgcgtaaggaatttaacttatacaaatccagagaggtgaatgattatcaccatgccatcgacgcttacctcaccactattgtcggcaactatctgtaccaggtgtatccaaagctgaggccctacttcgtttatgggcagtttaaaaagttcggaaaagcggaatcaaaggaggatgaccctgtgaaaaagatcaagcagtttaacttcatttaccaactgctatggggtaaagatgacgccatctgcataagtcacacagaccagcaggtatttagccgctcggatatcattaataagctcacgaccgcatacaacttcaaatatatgaatgtctcccaagaagtgtacactaactctaataacgtgtttaagcagacagtcttcccaatcattgagcgggacaccgctaaaagcagatcactgatcccgaagaagttggataggcccacagacatatatggcgggtacagtaataacaatgatgcctatctggccttagttaaagtggacaagaaaaagggatccgagtaccgagtagtgggcattcctatgcgcgctgcagccatgctcaaagcgtctaagaactatgatgaagacctgcggaaggtcatcgagccaatggtgatgcttgataaaaatggtaaggctaaaagagggatcgaaggctttagggttctggtgggaaagatgcccttcaaacaggccgtcttggacggcgataagaagttcatgctcactgggaccaacgacatgcctaatctgaaacagctagtgctgagccaacagaacatgaagtacattcttgattacatagacgacatcgattgtcgtaaacataagtttggaaataaaacgcaggacggtaacaagtgcctcctggaggttttcgatgaaattatccagattgtggacaaacactttgagttgttcgataatcgctcctttcgggagaagctgagaaactcaagggtcaacttcatcaatttagcactcagcaagaaagccgaagctctgcttgcaatactgaacggcttgcatgccaatagtatgcgaaccacaatcaaggagctcaaaatttctgacctggggcggatccaatccagcgtaatttcgccagaagcgcagctaatctatcagtcacccactggactgtttgagcgcagagtgaaggttaaagatctttga

SEQ ID NO: 3239 - RNA, 4176 nt, synthetic construct
  misc_feature 1..4176: note = Cas9 variant
  source 1..4176: mol_type = other RNA
atggagaacaagcagtactatatcggcctggacgtggggaccaatagcgtcggatgggccgttacagatacttcctacaacctccttagagctaaaggtaaggacatgtggggcgcaaggctgttcgaaaaagccaatacggcggctgagcggcgcaccaagcgaacatctcgtagaaggtcagaacgggagaaagcccgcaaggcaatgttgaaggaattatttgccgatgagattaacagagtggaccccagtttctttataaggctggaggaaagcaaattctttctagatgaccggtccgagaataaccgccaacgatatactctcttcaatgatgctacctttacagacaaggattactatgaaaaatacaagaccatcttccacctgagatctgcacttattaactcggacgagaaatttgatgtaaggctggtgttcttggccatcctcaatctgttttcacatcgggggcacttcctgaacgctagcctcaagggagacggcgatattcagggtatggacgtcttttataatgacttagtggagagttgcgaatacttcgagatcgaactgcctcgtataactaacatcgataatttcgagaagattctttcccagaaagggaagtctcgcacaaaaatcttggaggaactgagcgaggaactatccatttcaaagaaagacaagagtaaatacaacctcatcaagctgataagcggacttgaggcctctgttgtggaactgtataatattgaggatatccaggacgaaaacaagaaaattaagatcggctttagagagtccgattacgaggaatcgagcttgaaagtcaaggagatcattggcgacgaatatttcgatctcgtggagagggcgaaaagtgtacatgacatggggctgttatctaacataatcggaaattccaagtacctgtgtgaagcacgggttgaggcctatgagaaccaccataaggatctccttaaaattaaggaactgttgaaaaagtacgacaaaaaggcttataatgatatgtttcgaaagatgaccgacaaaaactacagcgcctacgtgggttcggtcaattctaacatcgcaaaggagcgcagatccgtggacaaaaggaagatagaagatctatataaatacattgaggacacggctctgaagaatatcccagatgacaacaaggataaaatcgagattctcgaaaagatcaaactgggcgagttccttaagaaacaactgactgcctcaaatggggtgattccgaaccagttgcagagtcgggaactccgcgcgatactgaagaaagccgagaattatttaccctttctgaaggaaaagggagagaaaaacctaaccgtcagcgagatgatcattcagcttttcgaatttcaaatcccttactatgttggcccactggacaagaatcccaaaaaggataacaaagcaaattcctgggctaagatcaagcagggtgggaggattcttccttggaacttcgaggacaaagtggatgtaaagggatctagaaaagaatttatagagaagatggtgcgtaaatgcacatacatcagcgacgaacacactttgccaaagcagtcactgctctatgagaagttcatggtcctgaacgagattaataacatcaaaattgatggcgaaaagatcagtgtggaggccaaacagaagatatacaatgacctttttgttaaaggcaagaaggtgtcccaaaaagatatcaagaaagaactgattagcttgaacatcatggacaaggactctgtcctctcagggaccgatacagtgtgtaatgcttacctgagtagcattggaaaattcaccggtgtatttaaggaggaaatcaacaaacagtccatagttgacatgattgaggatatcattttcttaaagacggtgtatggcgacgagaagcggttcgtcaaagaagagatcgtggaaaagtacggggatgagatagacaaagataagatcaaacgaatcctgggatttaagttctctaattggggcaacctatcaaagagctttctcgagctggaaggtgccgacgtcgggactggcgaggtgagatccattattcagtcactttgggaaacaaatttcaacttgatggagctgctcagttctaggtttacctatatggatgaactggagaaacgcgttaagaaattagagaagcccctgagcgaatggactatcgaggaccttgatgacatgtacttgtcctcacctgtgaaacggatgatatggcaaagcatgaagattgtagatgaaatccagacagtcatcggatatgcaccaaagagaattttcgtggagatgaccaggtctgaaggcgagaaagttcgcacgaagtcccgaaaagaccggctcaaggagctgtacaatgggatcaaagaagacagtaagcagtgggtgaaggagctagatagcaaagacgaatcttattttcgttccaagaaaatgtacctgtactatctccagaagggaagatgcatgtactcaggtgaggtcattgaactggataaacttatggacgataacttgtatgacatagatcacatctacccgaggagtttcgtgaaggacgatagcctggacaatttagtactcgtgaagaaagagattaacaatcgcaagcaaaacgatcccatcacccctcagattcaggcctcgtgtcagggcttttggaaaatcctgcatgaccaagggttcatgtccaacgagaagtattctcggcttacaagaaaaactcaggaatttagcgacgaggaaaagctgtcattcataaataggcagatcgttgagaccggacaggctacaaaatgcatggcgcaaattttgcagaagagtatgggcgaggatgtcgacgtggtgttttccaaggcacgactcgtctctgagttccgccacaaattcgaactgtttaagagccggctaatcaacgatttccatcacgccaatgacgcttacctgaacattgttgtgggtaattcctattttgtgaaattcactagaaacccagccaattttatcaaggatgcaaggaaaaaccccgacaatcctgtatacaagtaccacatggatcgtttctttgaacgcgacgtcaagtcaaaaagcgaggtggcctggatagggcagagtgaaggcaactctggaaccattgttatcgtgaagaaaacaatggctaaaaattccccactcatcaccaagaaggtcgaggagggccatgggagcattactaaggaaacgatagtgggagttaaagagatcaagttcggtcggaacaaagtggaaaaggccgataaaacacccaagaagccgaatctgcaggcatatagacctattaaaacctcggacgagaggctttgtaacatcttgcgatacggcgggcggacttcaatttctatcagtggatattgcctggtagaatacgtcaagaaacgcaagaccataagatccttagaggcgatccccgtgtatctcggcaggaaagatagcctgtctgaggaaaagctcctgaattactttcggtataacctaaacgacggtgggaaagatagcgtgtccgacattcgactctgtctgccattcatctcaacaaatagtttggtcaagattgacggctacctgtactatttaggaggcaagaacgatgacagaatccaactctacaatgcttatcagctgaaaatgaagaaagaggaagttgagtacatacgcaagattgaaaaagccgtgagcatgtctaagtttgatgagatcgacagggagaagaaccctgtacttaccgaagagaaaaatatcgaactgtataacaagattcaggataaattcgagaatactgtgttctccaagcgtatgtcattggtcaaatacaacaagaaggacctcagttttggggatttcctgaaaaataagaaaagcaagtttgaggaaatcgacctagagaaacaatgcaaggtgctgtataacataattttcaatctttccaacctcaaggaagttgatctgtctgacatcggaggctcgaaaagcacaggtaagtgtcggtgcaaaaagaatattacgaactacaaagagtttaagttgatccagcagtcaataaccgggctgtactcctgcgaaaaagatttaatgactatttga

SEQ ID NO: 3240 - RNA, 4176 nt, synthetic construct
  misc_feature 1..4176: note = Cas9 variant
  source 1..4176: mol_type = other RNA
atgaaggagatcaaagactacattataggcctggatatcgggaccaacagctgcggatatgtggtcacagacaagcagaataacattctcaaacttaagggtaaaactgccatcggcgctagactgttcaaggaaggggaggcagccgcggataggcgggcttttcgcacgacccgacgtagattggccaggcggcgctggagattatccctgctagaagagattttcgacgaagagatgaataaggttgatcccagctttttcaggcggctcaaagagtcagactacagtcctaaggatcgccgaaaacaatttaacagcatcgtgttcgaatcctctgaggcagacaaggccttttatgaaaaatacccaacaatatatcacctgagaaatgctcttatgcatgataaccagaagcacgacctgagggagatcttcttggcagtacatcacattgtgaagtaccggggaaattttctccgtgaggattcggtcaaagccttcaaggctgccaaatttactctgcagggcgaagacggtatcgggccggtggataagctgaacgacctcttaaaagagatttatatcgaagcggcacccgagctggccaccgacaatctttcaaagatagaagatattatcaaagacaagaagttgtacaaacaggataagctgaaacaaattgctaacctactccctaaggccgttgacagcaaagataaggcaaagctgaataaagacatcgctaaacaggtggccaacgcgcttatgggatacatgttccgcctggatacattgtttagtttcaccgacgtcgatgtgaaagactataagctcaaattctccgatgccaatatcgacgagtctctggacgcattaactagcctgctcacagatgctcagattgagtttgtacttgaactgcagtccatatacaacaccatcgttttgaatgagattgtgccagacggcatgtcactaagtgaaagcatggtcaagaagtatgatgaccataaaaaggatctgaaactctacaaggagtatatcgactctctgtccgatcaaaagaaggccaagcagcttgaagctgcctacgcactgtatgtgaactacagaaaagccgacttgctcgctgcgaagaaactgttcgagaagaaaaagataggcgataaaaagtttgtggacgtcatttcaaacttcgaggtttttgggaagttcgtgagcgataatttagacgatagtgaactggcaaacaaaatcaaggccaggctagacctcggagagtttctgcccaaacagcggacgaatcagaacggtgtaatcccttaccaacttcaccaggtggaattgactcagattctggagaagcaaggcaaatattacccattcctcatcacccccaatcctgtcgaatctcaccgaaacaatgctccatatgagatttccgagctggtgagctttcgcgttccgtactatgtggggccccttatagacaaccagtcgatcaaggataagcagaataaaaacaagttcgcctggatggtcagacagaaacaaggacagattacaccttggaattttgaagagatggtggacactaccgaatctgcaaaccagttcatcaagaggatgacacggaaagatacctacctgttggccgaggacgtactcccaaagtcctcactgatctatcagaagtttatgattttagatgagctgaatcgcataaaaatcgacggcaagaaactaacgagtaagctcaaacatgatattttcgaaaagctgttcaagaaacaaaagagcatcaaccttgacaatttgaaaaactacctgctcgctgagggtaacattcccgggctgatcgaaggattatccgatggcataaattttaacaattctttcagcacttacatcgactatagaaacatttttggcgatgagatcgacaatcctaacaagcaggccgatttcgagaaaatgattgaatggtcaacagtttttgaggacaggaagatcttcaaacgtaagctgaaggaaataacctggcttactccagagcagattaaacaggtgagttccaagcggtacagcgggtggggacgattgtctaaaaagctcctgacacaaatcaccgacgaaaatggtgtcaacattctacagagactgtggaatgagcccgaaacgctcaccgaggtgctggcaaacccggtcatcaaaaggaagatatcagaggcgaatagtctttttgtgcagatcaacaaggttgaaaatattttggatgacgcttatacaagccctcagaacaaaaaggccatccgccaagtgattcgggtagtcgatgacatcatagcagccgctcacggcaaaaagccctcccagattgccatcgagttcgcaagatcttcgcagaataaagctaaggtgccagatactaggaagaaacaactggacaagatctacaacaaaattagctccgaaatcttagattcaagtattaagaacgagctcaaaaatctgaagtctaacaagtatcttagcaaagacaagctgtttttgtacttcaaacagatggggcgcgatgcctataccggagacaagctctccctggatcagctacagaattacgacatagaccatatctttcctcgatcattcattaaagatgacagcctggataaccgggttctcacacaaaagcccatcaatgcgaagaaatctgactacggcattccagccctggaatttggtaacaagtatgtgcccgatcttgggatcactgtcaaagagatgtggaagttgtggcaggagaatggcctgatatccaaaagtaagttaatcaacctctgtaccaatcctaaaaagattggaagcaagcgtgcttctggcttcatcaacagacagctggtggaaacatcccaggtaattaaacttgtggcaatcatactgcaagccgagttcccagacaccgaaattatcgaggttaaggctctacagaatactacgctcagggagtcatttcacctgtacaaaaaccgcagtgtcaatgattatcaccatgccatcgacgcatacttgacaaccattgtggggaactatctgtaccaggtgtatccgaagttacggccctacttcgtctacggacagtttaaaaagttcaatcaagaaaagaacatagatatcctcaaaagactgaagaactttaatttccttaggcagctgatttttaacactgacgataatatctatattagcggtaccaaagagatcgttttcaacaagaaagacataatccacaagttggaaacagcgtacggctataagtacatgaatatttcgcgagagtgctatcaggaaacctcctctctctttaaccaaactctgtacgcccataatagctcagtgaaaaacagtctaatccctaagaaaaaggggctgccaacagagatttatggaggctactccggtaataaagattctttctttgtgcttgtaaagatcgtcaagaaacgcacgaacctctaccggatagtggggattcccaccagagagctggctaagttgaatagctccaacaattataaccaggccctgaataaaatcgttgaatcaaagttatgtctcaaagagactgaatctttcaagatcctgattaaaaggcttctgtacggcacattgatcgtggacaacggacagaagttccgtataggcagttttaaggagaaacacaatgtccagcaactcgtgctgcagctaaagtctatgaaatatattaagttctacatcgacgggggacagaactattttaccgatgttgaacgcaaaaagctggagaagcaggaccgggataaatgccttctctacgtgttcgacgatattatgaacgtagtcaataagagatttacactgttcgacatgtccaaatatgagaaggatggtgacagcttgagggaaaaatttaactgtttagatttcaatgacaaggtgtcgatcctgtcagatctcctgaaggcatttcatgctaactctgaccgaaccagtataactaaacttaagattacgaatctgggccggcaccaagccgggaaaaacggaatcaccttgacaactaatgcacagatcatttaccagtcccctaccggcctattcgagcgcagaatcaagattaaagatctgtga

SEQ ID NO: 3241 - RNA, 4176 nt, synthetic construct
  misc_feature 1..4176: note = Cas9 variant
  source 1..4176: mol_type = other RNA
atgaagaaaatcctgggcctcgaccttgggaccaacagcattggatgggccctggtgaatgaggctgaacacgagcatgaacagtcctctatagtcaagttgggtgttagagtgaaccccttatcagtagatgagaaaacaaatttcgaaaagggcaggcctctgagtatcaacgcagaccggactagcaaacgctccgcccgacgtaatctacaaagatttaagctcaggcggaagaacctgattaatcttctgttgaaacaccatatcatttctaacgagacgatcctcaccgaggtggggaagaatacaactcaccagaccctgaaactgcgctcgaaggcgacacaggaaaagatatcactcgaggaatttgctagaatcttactgagcattaacaagaagaggggatacaaaagttcccggaaggagaaaaatgaggatgaaggcttcaccatcgacggtatggccattgcaaaggagctttatgataaccagttgactccagggcaatacgtctataatatcctgcaggacggaaagaactacataccggatttctatcgctctgacctacaggccgaatttgatgacgtgtggcagttccaaaagaaattttacagctccattctcacagatgagttctatctgaaacttaagggccagggcaaagaaaatacccgaaagctgtttttggctatccatcaggtttacacggcagagaacaaagggaagagagacgccgtgaaactccagtactataagtggaggtcagaggctgtcaagaaacaactgagtattgaagaggtggcctacgtattagttgaaatcaacaataacatcaataagagctctggatatctgggtgcgatttccgatcggtcaaaagcactctacttcaacaatgagactgtgggcgaatatctttacgggcagctggtcaagaaccgtcacaatagcttgcgcaaccaggtgttttatagacaagactacctagacgagttcgagaaaatatgggaaacccaggccaagttttacgatgagctgacaaatgaactcaagcaggagatcagggacgtggtcattttctatcagcggaaactgaagagtcaaaaacaccttatctctgattgcctgttcgaaaagcatcacaaagctatacccaagtccagccctttgtttcaggagttcaagatttggcagaacctcaattacctggagtttgttcatactcagtcgaaagaaaagatcttcttttctgagttagacgatgaaacccgacaattcgtgtttgccgagctgaacatccgcggaacactaaaaattaaggagatcaaaaagctcattggcctggaaaccccagtatattggaaatccaatttcgacgagatagaaggtaacagaacgaatcaggtgctttacaacgtctatcagaacatcgcagatgacttggggtacggatttgattggtcaaagaagcacgctttcgagattaatgccgaactgcaggcgatctttaaagacgtgggcatcgatactgccattctcaacttcgacgcaagtatagaggagaatgactttgataagcagaaaagctatcaactgtggcaccttctgtactccgctgaagacacagataaggccaccgaggaagacaaattgatctacggcaacattaatactaagctcaagaaacagctgcatcagaagtatgggttcgaggctaaatacggaaacttactggccaatatctctctacaacaggattatggtaacctcagcgcaaaggccattaaaaagatcctgccctaccttgaatcaggcaatagtttctatgaggcttgtacaatagttgggtacaacccttccaatagcttgaccaaggagcagcaacagaacaggaaactgaaggacaaactcgaactgttaccaaagaactctctgcggaatcccgtggtcgagaaaatccttaatcagaaggtgaacttgattaaccagctcatcgatgaatatggaaagcctgacgaggtacgcattgaactggcgagagagctgaaaaagtcagcaaaacaaagggccgatctgagtaagcacatcaatgacgctacgctcaaaaaccagaatatacgtaagaccctgcagaaagattttggcattcagaacccaagcaagaatgacgttatccggtacaaactttacgatgagttgaaagacaacggttataagacactgttcactaataaatacattccgaaggaacaattattttccaaagacgtggatatcgagcatataatccccaaggccattctcttcgacgattctttttcgaacaagaccctggcatatcgaaatgtcaaccttgccaaagctgacgccacagcattcgattttatcagctccaagcacctggacgatttggacaattacaaagcgagagtggaaactctcttccagtcaaagaggattagtaaagggaagtataagaaactgctaatgacccgccagaacctgcctgaggattttatcgagcgggacctcagaaattctcagtacatagctaagaaagccacagcaatgctgaaggaagtcttcaggagcgtggttccaacctccggccgcattactgataaacttcgagaggactgggatttggtgaacgtaatgaaggaactgaatttacccaagtatcggacgctcggactgacagagtttatcgaacgtaaaaacggcaacaagatcgagcaaattatcgactggaccaaaagaaatgaccataggcaccacgccatggatgctcttactgtcgccttcaccacacataaccacattcagtacctgaataacctaaatgtgacccatgggctcaacggagttgacactgatcacgagaagtcacgcctgtacgcaataaaacaggctatcacaaaggtgtatattgtcggtaagacgaaaaagcggaaatttatccctccaatggaaaatttcagaagccacgccaagaaccatttggagggcattctgatctctttcaaaaataagaacaaagtggtaaccaagaataagaacaggactaaaacaaagaccaaaggggtgtttaatgaaaagatacaattaacaccccgaggacagctccacaaagagactatctacggccatgcgaagaaggttattgtcaccaaagaaaaggtgtccagtaaattcacgcacgagaagatcctacaggtgaccaaaccggcctatcgcgaggcacttctgaagcggttggctagctttaagaacgaccctaaaaaggccttctctggtaaaaatgctctctccaagaaccccctgtactttgatattacatcagggaaaaaggtcccagacactgttaagctaagttatttcgaaaatagctacgtgatcagaaaagaggtgaactcggataactttaagaatgaaaaatccctgcagaaggtacttgacgtcggcataaggcgtattctcgagaaacgcctggccgattataacggaaatgcaaaggaagcgttctctaacttggagaaaaatcctatctggaaggacaaggagaaaggcgtgtgcatcaagaaagttcggattgaagccctgaagaacgctgagcccttacatgtgaaaaaggatcacctcgggaagataatcctggacgacgaaaataaaagcaccccagtcgattttatttcaacaggaaacaatcaccatgtggccatctacgaggacaaggatggtaaacttcacgacaaggttgtgagtttctacgaggtagtctccagagtgaacctgggcttgcccattatcgataaatcttttaatagccatctcgactggaagttcctgttctccatgaagcaaaacgaaatgtttgtgttcccttcagaggattttaatccaaaagaaatagacatcgggaacccgaagaataacgagctaattagcaaatatctgttcagggtccagaagtttagtaaagttacttacggaaactctgcagtgcgagattatgtattccggcaccatcttgaaaccgagctcatcgacaagaaggagctgaaaggcattacgtactatcagttgaagtccatcggtatgttagaaaaactggtgaaggtccgcataaatcacattgggaaaatcgtgcacatcggcgagtactga

SEQ ID NO: 3242 - RNA, 4176 nt, synthetic construct
  misc_feature 1..4176: note = Cas9 variant
  source 1..4176: mol_type = other RNA
atgaagaccatcctgggcctcgaccttgggacaaacagcattggatgggccctggtgaaagaggctgaaaatgagaacgaagtctccgatataatcaagttgggtgttagagtgaatcccttaactgtagacgagctgacgaacttcgaaggcgggaaagcatactctaataacgccgagaggaccctaaagcggggagcgcgccgaaatctccagcgttataaactgagaagggagaaccttattgaaatcctgttgaagaatggcctcattaacaaggatacagctctgactgaggtgggtaaagaaaccacacaccaaaccctgaagctccggtcaaaaagtgccaatgagaaggtcagcttagaggacctggcaaaaatccttttgtccataaacaagaagcgcgggtacaaatcttcgagaaaggtgaatgccgaagatgacggagttgctatcgatggcatggaggtggcaaaactgctatatgacgaaaacatgactcctggcgagtacgtcctcaggctgcttgaatcagggaagaaacatctgccagatttttatcggagcgacttgcaggaggagttcaatctcgtgtggaagaaacagagtgaattttacccgctgattttaacaaaggagctgttctttgaactccacggaaagaacaaatcccagacctgggccatctgcaaggagccccttggtattgtaggcgttaaactgaaggggtctgctaaagaacaaaagttcgcccgctatcgattgagaaaggaggcgctaacgcagcagatcgagctggaacatctcgcaatagtgctgcaggatattaacaatgacagcaacaaatcctcaggataccttggcgccatcagtgataggagcaaggagctgtttttcaataaagaaactgtcggtcaataccagtataagcagttgcagaaagaccctaacacctctctcaagaatcaagtgttttaccggcaggactatctggatgagttcgaagtgatttggcgtaaccaggctaagttttacccacaattaacaaatgagctgaaacaggagatccgcgacgtcgttatcttctatcagagaaagctaaaatcccagaagaacctcatttcattttgtcaattcgaaagcactcagcagaattacgtggagaaagaaaccgggaagacaaagataaggaccatcggacggcgagtaattccccgcagttctcctctgttccaggagtttaaaatctggcaatcccttaacaatttgaagttcgtgaacagcgagtcgaatcagataattcagtttatcgaactggaggatgacgtcaaaaaggtggttttcgatgaactcaacctgagaggcgaccttaaaccaaatcaggtgctgaagatcttgtctaaatatatgaagattggcaagctcacgcaatggaaatgcaacctggaggaaatcgaggggaacaggactaattccgccttatacaacgtctttcagatgattgcagaggaagagggatacggtttcaattggggcaagaaatcagctctggaaataaagagtgagctaaaagccatctttagctccattgggatcaacgattctatcctcgacttcgattttagcaagaagctggaccagcagctttcatatcaattgtggcatctgctctacagtgcggaagagggaaattccaaaattacagaggaagataagttcacctatggcaacactggtgtggccctgaaaaagaaattacacctgaagtttgggttcaagcccgagtacagcacacttatatctaatttgcggtttacctcagactatggcaacctcagtagcaaagcaatctccaagattctgcctttcctacgcgacggatctgattactcgaaggcttgtcagtatgccggctacaatcacagcaactccctgtcagctgacgaactcgataatagagagctgaagccaaaacttgaattgctgaagaagaacagtttaaggaatccggtagttgagaaaatcctcaaccagatggtgaatgtcgtgaaccaagtcattgacaactacgggaagcccgatgaggtgcgtatcgaactggcccgggagcttaaaaagtctgcaaaagaacgaagccagatgacgaagaatatatccgacgccaccagaaggaacgctgagatcaaaaagtatctgtcaaaggagttcggtattcctaatccaacaaaaggagatgttatccgctaccggttgtgggaagaactcgcgagcaacggctataaggacctgtttagagataaatacattcccaaggaaaaactattctctaatgagatcgacatagaacacattatccctaaggcactgctctttgatgactccttcagtaacaagactctggcctttaaagtggataatcttaagaaagctgacaggaccgccttcgactttatgagcacagatttctctaaggacgtagattcctatattgggcgcatcgagactttgcataaagacggaaagatatcaagtagcaagtacaaaaagctgatgatcccaaaatcgaagttagtcgatggctttattgagcgagacctccggaacacccagtatatcgcaaaacaggcccgtaagatgctgcttgaagtgttcaagacagttgtgcccaccactggtaaaattacggataagctgagagaggactgggatctaatcaatgtcatgaaagaactcaactttccgaagtacaaagctctggggttgacaaagaagatagagaggttcgacgtgggctccgaaaagattaagtctatcaatgtaatcgagggatggagcaaacgcaacgatcaccggcatcacgccatggacgcactggcggtggcttttaccactcacaatcatattcaatacttaaactatctcaatgccagaaaggatatccaccatgagatgcacggcaccattaaatcaatagaaaaccagatcattgggaaggacgttatgggaaaaaggcgattcatccctcccattagtgacctgcgcatgaaggcaaaacttcagatcgagtccatactgatctctttcaaaaacaagaataaagtcgtgacatggagcgtgaacaagaccaaattgaagggtaaggataattacaacaaacggagacagctcactccaaggggccaactgcataaggaaacagtctatgggaaaattaagctaatcgaccctaaacccctgaaacttaataacaagtttacgctcgttcgtgcctccatgattgtggataaagtgcaccgcgagatcgtactgcagcacttgtcaaagtacgacaataacagcgaagtcgctttcgatagtaaaaccataaagattgacccaatcctgatcgagggaattggcttaaaagaggtggtttgctatgaagatgtgtttaagatacggaagaaaatctctggtgacaatttcaagaacgagaaacatctcgaaaaggtcattgatgagaaagtgaagcagatcctgaaagacagagttattaagtttcaggggaatttcaaggaggccttttccaaccttgaagagaatcccatctggctgaacaaaagcaagggcatagcagtgaaatcggtagctatcaagggagtcaataacgccgaatcattgcacgagggcaaagatcatttcggggaccaaattctcgacaagaataagaaacagatccctgtggattttgtgtctactggaaacaaccaccacgtcggcatttacgaagacaaggatggtaatctgcaggagagggttgtgagtttctttgaggcggtaacacgagtgaacgaagggctaccaatcatagacaaaacctataattccgatattggatggaagttcaaattcacaatgaagcaaaacgagatgtttgtcttcccgagcgacgattttgaccccaatgagttcgatctgactgacggcaagaacgccgctaaaatctctcctaatctttaccgggtgcagaagatcgcaaccaaaaactacatgtttcgccatcacctcgagacggttgtgaccaatgatctggagttcacatataagagcattagatccactggttggttgaggaacttagtcaaagtgcggatcaatcatctgggcgaaatagtttacgtgggggagtattga

SEQ ID NO: 3243 - RNA, 4176 nt, synthetic construct
  misc_feature 1..4176: note = Cas9 variant
  source 1..4176: mol_type = other RNA
atgaagaaaatcctgggcctcgaccttgggaccacaagcattggatgggccctggtgaacgagaaggaaaataacgaggaattgtcctctataatcagattaggtgtcagggttaatcccctgactgtggatgagaaatcaaacttcgaaaagggcaaagacattacgaccaatgctgatcggacaaagtgccgcagtgcacgacgtaacctacagagatttaagctcaggcgggaggccctggcggactgtcttaaacgccacgggctgatgactgatgagacccctttgtgcgaaacaaataacagcatcattttcaagacctactccaatagagctaaagccgtatgtgagaagatcgcactcgacgattttgtgagggtcctgttcatgataaacaaaaagcggggatataagtcttcgcgcaaactgaatactgacgatgaaggcacactcgtggacggtatggatgttgccaagttactgtacaacgagcaaatcaccccaggggagtatcttttgcgactgtttaaaaagggcaaaaagacgagaccggacttctacctatcagatctcaaagctgaactggagaggatttgggactttcagcggactttctatcccgaaatcctttgcaatgcactgaaggaggacttgaagggaaaaagccgtacccagagttccgccatcttttacgctaagtataaagtgtctacagccaagattgcgggcaaagataagcgcctccaggaactgacttggagaaccgacgcattaaggaagcaactgacaatagatgaggtcgcctacgtgatttgtagcatcaacggggaggtaaatggatcctcacagcggctcagtatgattagcgaccgatctaaacttctgtacttcaaccatcagaccatcggtcagtatttgatgcaacgcctagaagagaaccctaatgctggcctgaagaacatcatattttacagacaggattatgaagacgagttcaatgatatttggaactcccaggccacgtaccacaaagaactcactccagagctgaagaaagaggttaaggacatcatcttttatcagagggggcttaagtcatgcaaatggctgattaattactgtgaattggagcatgaagagatagaagtgaagacacccgagggaaaactccggaagattaccatcggcagcaaaacttgccctaagagttctccactgttccaagagttcaagatctggcaggtcttaaacaatctacaggtgagccccctgaactcccgcagaaaagcaaagaggaaaaaggatgaggaaccttcgctcttttctgacgaagatatgaatacagcttgtcgttatctgaacgaggaggaaaaacttaccttgttcaaggagctgtccattaaaaaggaactcaagaaaaaggacgccctgaaacttctgtttgagaattacaaggaattggacctcaactacaaagtgatctcaggtaatgtcacgatggcgaacctgtatcgggccttccaagatattataagtttaaccgggaatggagagtttgacttccaggcaatgccagctgaggaagccgagaagacagttgaagagatctttggcggcctggggtacaagactgctttcctacactttgatgccagcctccatgacaaagagttcgaacgacagccggcatatagactgtggcaccttttgtactcctatgccggagatcagtctaagaccggtattgaggctctggtgaaaaggatccaagaactctgcggctttgagcccgaatacgcgcgcatcctggcaaacattagcttcatacctgactatgggaacttatcaagtaaggccatgcggaaaatcctgccatacatgcaggatggatacgagtattccgaagcatgtagcaaggccggctacagacactctgcatcaagtcttacaaaggaggagattaataaaaagaactataaaactcatttggacgaaatcaagaggaatagcctccgcaaccccattgtagagaaaatcctgaatcagatggtgaacgtcgttaattccgtgatagatacctactctaacatcgacgaaattcgaatcgagatggcccgggagctaaagaagtcgaaacctgaacgtgaggatatgagctttgctatttccaaggccacaaaagaaaccgagagaatcaagggtatactggaacaggagttcaaaattcaacacgtgactaggaatgacatcattcgctatcggctctacgaggaactgaagccaaacgggtataaaacgctttactcaaatacatacatccccagagaggatttgttcagtaagaagtttgacatagaacatatcattccgaaagcaaggctgttcgacgattcttatagcaacaagaccttagagctccgagacatcaatattgaaaaaggcaaccagactgcgtacgattttgtcctgtccaagtatggagaggagggcctttacaaatatgaacagcgcgtggaggagttcaagaagaataacgaacaggctgggaccaaatgccggaagctgttgatgagagaagccgacatcccttcagattttctcaacagggacctgaatgatagccaatacatagctaaaaaggcccacgagctactgcgtgagattgtacccacagttaccgctactacaggatctatcacgaaccgcctccgggaagactggaaactggtgaatgtcatgaaggagcttaactgggaaaagtatgataaattgggtctgaccgaggagtacaaggacaaagatggcaatactgtgagacacatcaaggactggacaaaaaggaacgatcatcgacaccatgccatggacgcattaaccattgctttcacaaagccatcctttatccagtacctcaataacctgaatgcccggagtaaccgcgggggaagcatttatggcatagaacagaaggagcttgaaagagagaataacaaactggtcttcatccctcccattgacccaaagatctttaggaaacaggcgaaggaacacctatctaatattctcatctccataaaagccaagaacaaggtggttactaaaaatgtgaacaagaccaaatcaaagagtggtacgaaccggaaagtacaactgacaccccgagggcagttgcatctggagaccgtctacggcaagatcagaacttataaaaccgaggaaattaaggtgggaacaaagttaactgaggaactcatcgctaaagttgcagataagaaaattcgcgaggccctgatgcagaggcttagcgaatacggcgggaatatcaagaaggctttccaaaacatatcgaaacaccctatttggctgaatggatcccacaccaagcatgtgccagagaaagtcaagatcgtgtttttcgaggacgtatttacgatccgtaaagccattacaccggatataaagatcgacaaagtgattgattctaagatccggagaattttgcaggaaaggctcaacgagttcggtggcgaagcaagcaaggcgttctcaaatctggacgagaaccccatctggtttaatcgcgataaagggatagccatcaagagtgttaaaattcgaggaatcgctaagggcaccgccattagagtcaaaaaggacatccacggtaagactataattgggaacaatggctatcctgtggcaaacgattacgtgaatacaggaaacaatcatcacgtcgctatcttccgggacaaagatggcaacctacaggaacacatcgtttccttttatgaggccaccgcaagggccattcagaatctgccaatcgtggaccgcaactacaattctgagaaggactggaaattcctttttagcatgaagcaaaacgaatacttcgtgtttcccaaccctaatactgggttcaacccatccgagatatcactcaaagatgaaaagaattatgctctgattagccccaacttgtttcgtgtacagaaactgagtcattactattacgtcttcagacaccatttagagaccaatgtggacacaaacctccagctgaaggatatcacgtggaagcggattaccgcggttaataaccttactggagccgtgaaagtcaggatcgaccacctgggccgcatagtggatgttggtgagtataagtga

SEQ ID NO: 3244 - RNA, 4176 nt, synthetic construct
  misc_feature 1..4176: note = Cas9 variant
  source 1..4176: mol_type = other RNA
atgaagaactaccacatcggcctggacattgggaccagctccgtgggattcgccgctagagatgacgataataacctcataagggtcaaaggtaagaatgttatcggcgcacggcttttctctgaggggcagacagcccaagaacgccgaatggcgcgtacttcaagaaggcggtataaccgcagaaaatggaggctgcggttgttagacgagattttccatgatgaaatcattcacaaggacgctgagtttttcaatcgcctgaaacagagttttctaagccccaaggatgaacgaaagcagtacttcggatccctcctgtttcctgagacgggcgactctgagtattaccataacggtaatcagaccatctatcaccttagacataggctgataacacaagatgaaaaagccgacatccgggagatttacttggcactccgtcacatcattaagtatcgcgggaacttcctggatgacactccagtgtcgtcatttgaagccagcgatctgaaactcgctagtttcgtaccgaccatcaatgacttatttgagacaatagacgtgaactacgagttctccatggataatattaacgaaatcgaggacattctgcttaataacaagttgagaaattctgataaaagcaagcagctgaccgacctactcactgaacccatcgtcaacatcgatgacaagtccctggagaaacagtttaacaaggaaaggacagatatttcaaaagagatagcaaagagtgtggttggaagcaaaatgaatgtgaacaaacttctgtctttcgagtcctcagaaggcagcaaaatcgccttcagtttttctgacgcttccagcgaggataagatgatggaattgtcggacattctcgatgactctcggatgaatatcctgaacatattaaaggtcatttactcccgagtgcgcctgaatcagatcatcccttcaggcatggggctcagtgagagcatggtagccgcgtatgactcccacaaacaacagcttaaggatctgaaaaccttgctaaacgttctgccattcaatgaaagatacgcagtgaagattgcctatgctgcctacatcggaaacattgacaaacagaagtttacgaagtctgagataaaagcaatcgataagctcaaagaaaagagcgctattatgaatgtcctggacttcaaatcaggtcatatcactaacgaggagcttagtaatgtgatcaaggccgtgattgtcgataagtatctgaacgacgaagattttgagtaccacggcatagttgaaaagatcaatcaggacatttccaacgggagctatttgctcaagcaaaggaataaccagaacggaaatatcccccatcagctgcaccaaatggagttagatcagattatcgagaaccagtctaaatactaccacttcctgggcgaactaaatcctaactcaaatcggaaccatatagcgaagtataaaatcagtgagctcgtggcctttcgcgtaccatactatgtgggtcccctgattacccctgaggagcaggagaagacaagcggggcatccttcgcttggatgaagagaaagaaggacggagccatcactccatggaattttgaagagaaagtcgataaggaagagaccgcttctaggttcattaaacgtcttacagtgaaggacacctacttgctgaacgaagatgttctcccggacaattcgctgctttatgagaaatttaaggtgctgaacgagttgaatgtcgtgaaggccaacaataaacggctcacggtagaagagaagcaaggcgcattcgacaacctgtttaaaaagatgaaaactgttacagccaagcgattaaagaattacctggtgagcaaccacaaccatatcaattccgtcgaaataaccggcctatcagatggggacaaattcaacaatagtctctctacttatattgatttcaagaaaatctttggagacaagattgataaccccggtctgcttgacgatttcgaggacatcatagaatggagcacagtgtttgaggatagaaaaatcttcgaggaaaaggtcaggaaggacatttcctggatctcagagagcgaaattaaatctgtggtttccaagcgctacagtggctgggggcggttgagcaaaaagctgctcaattgcatcaccaacaatgagggaagaaacataattgatgaactgtgggaggagtctgaaacgtttatggaggctgtgtccaaacctgaagtaaaggagcagatcgacggcatcaattcagatttcattaagaacaccgacatcgagagtgtcttagcggacgcatacacaagcccacagaataaaaaggccattagggaaactcacaaactggtgaaggatatacagaaagctatgggtgggcaagcccccgcatcgatctccattgagtttacccgcaaccctcaggacaagggccagcttacacgatctcggcatagcgaagtttcacgtaaatataaggagatcagtaaggaaatttccaaaactttgaatgatgagctcaagtctaaaaagaacagcatggacgtggataaatactatctgtacttcatgcagatgggaatcgacctatatgatggctcctcaatagacatcgatgacctgaataactaccaaattgatcacatcattccacagagcttttataaggacgacagtttcgataacagagtcctcacccactactctaataaccagaagaaagggaataacacacccctgaatggacttaacatcaatgacaagaccagggccatatggaaccatttgcgcgatctgggtttaattactaaaaagaaatacaatggcctcacgctgaaggggatggaccagctttccaagtatacaaaacacggatttatccggagacaactggtggagaccagccaggtaatcaagttggtggctaacattctctcggatgaattttcaactgacgataccaaaataatcgaggttaaggccaaaatgaactctcagattaggcaagtctttaatctgtacaaggtgcgagaactaaatgactatcatcacgcagtggatgcgtacctgacaaccttcatcggcggttatctctacaaccgctatccgaatctgcggaacatgttcgtctacggggactttaagaaattcagtgctgatgttgacaatcttaagacttttaacttcttgcacgagattacaaacccttccgataaatttgaagacagaatcttcgacgaaaagagcggcgagctgatattagataggaaacatgccatcgaaacgattaagaagatctaccagtataaatacatgctcattacccgtgaggtgtctactaagaatggacagctgagcgaccagacagtgtattccgcaaaacgcatcaacaatgtaaaggcccccataccagtcaaaaaggattttaaccctgaactttacggcttccggaccgggaatgtggaccaccatatggttattgtgaaatatcccaagaaggattcatacgactataaagtcgtgggaatcccactgagatttgttcaaaagctaaaagagacaaaggataacaaagactacgaaaatctcctgaaccagatcgtgcagatgaagttgaataggaagaaacaggatttcattgtagtcgtggacaacgtgatgtacggtcaactgatccaggatggcgggcagaagtttactttaggaagtagcacctatcgatacaatgctaaacagctcgtcatagacaacggctatctgaaacttattgccgatgagcggtacaaaaattctctgacggacgaggaaaagtccaaccaatatatcaccttgtacaatgagattctcaaggttgtgaacggtcgcttcgacgtattcgatgtgaactcatttaggaaaaagctgaataacggggtcgacaaattcatcaagctaaatacagtggataaaagaataattatcatgaagatcctgagtggccttcactgtggacccagcattgttcctctcaaggaactgggcttgactaccccactggggcagttacagtccacatctggaatctcgctcagcgagaacactattataatctatcaatcaccgtccggcctgtttgagcggaaagtgcgacttggtgacctgtga

SEQ ID NO: 3245 - RNA, 4176 nt, synthetic construct
  misc_feature 1..4176: note = Cas9 variant
  source 1..4176: mol_type = other RNA
atgaagaactaccacatcggcctggacattgggaccagctccgtgggattcgccgctagagatgacgataataacctcataagggtcaaaggtaagaatgttatcggcgcacggctgttttctgaggggaaaacagcccaggaacgccgaatttcacgtacttcaagaaggcggtataaccgcagaaagtggaggcttcggttgttagacgagatcttccatgatgcgattgtgcacaaagacgctgaatttttcaatcgcctgaagcaaagctccctatctcccaaggatgagcgaaaacagtactttggatcgctcctgttccctgaagtaggcgacggtgattattttagagacgggaaccagacgatctaccatcttaggcaccggctgatgacccaggatgagaaggccgacatacgtgaggtgtatttggcactccgccatatcattaaatacagaggaaatttcctggatgacacaccagtcagtagctttgaagccagtgacctgaagctcgcttccttcgtgccgactttaaacgatctgtttgagaccatcaatgttaactatgaactttctattgacaatgtgaaccaaatcgagaatatattgctgaacaataaactaaggaacagcgataagtccaagcagctcacagacctgattgcagagcccgtcaccaacatcgatgacaaatcacttaagaaacagttcgataaggaacggaaagacattagtaaggagatcgccaaagctgtggtaggcagcaagatgaatgttaacaagctgttgtcttttgaatcctcagatggcagcaaaatcagtttctctttctccgacgccagctcggaggataagatgctcgaactgtctgacattttagacgattcccgaatgaatatactgaacgtgctcaaagtcatctactcacgcgtgagacttaatcagattatccctagtgggatgggactgagcgagtccatgatagcggcatacgacttgcacaagcaacagctaaaagatctgaagactctcctggacgtggtcccatttaacgagaagtatgccgttaaaattgcttacgccgcatatatcggtaatatcgataagcagaggttcacaaaagctgaagtgaagaccattgacaaacttcgggataagaagtctatcacgagcgtactggactttaaatcaggccacattactaacgaggaattgaataacgtgataaaggaggtcatcgtggataaatacctcaatgacgaaaccttcgagtatcatgatattgttgagaagatcaaccaggacatcagtaatgggaactacctgttaaaacaacgcaataaccagaacggaaatattccccaccagctgcatcaaatggaactagatcagataatcgagaagcagtccaagtattacccttttctcggcaaactgaacccaaatagcaagagatctcacattgccaaatacaagatctcagaacttgtggcgttcagggtcccctattacgtgggtcctttgattacaccagaggaacaggagaaaaccagtggggccagctttgcatggatgaagcgtaaagaggacggagctatcaccccgtggaacttcgaaaagatggtagacaaggagtccacagcctctcggtttataaaacgactgaccgttaaggatacgtatctcctgaatgaagacgtgcttcccgataactcgctgttgtacgagaaattcaaggtcctcaatgagctgaacgtggtcaaagctaataacaagagattaactgtggaagagaagcaaggcgcctttgacaatctgttcaaacagatgaagacagttaccgcaaaaaggctaaagaactatctcgtgagcaatcacaaccatatcaattccgtaaaaattactggcctgtcagatggggaaaagtttaacaacagtctttctgtctacatcgacttcaagaaaattttcggagataagatcgacgatagcaaattgtttgacgatttcgagaatataattgaatggtccacagtgtttgaggaccgcgatatcttcgaggaaaaggttcggaaagacatttcatggatcagcgagtctgaaataaacgccgtggtctccaagagatatagtggttggggcaggctgagcaagaaactcctgaatgggatcaccaacgacgagggacgcaatattatcgatgaattatgggaggagtctgaaacgtttatggaggctgtgtccaagcctgaagtaaaagagaagattgacgaaatcaactcaaatttcataaagaacaccgatattgagagtgtgctggcggacgcatacacaagcccacagaataagaaagccatccgagagacttacaaacttgttaaggatatccagaaagctatgggcggtcaagccccctcgtccatttctatcgaatttacccggaaccctcaggacaagggggagttgacacgtagcagacactcagaaattgccaaaaagtataaagagctcagtaaggaggtctccaagaaactgaatgatgaactaaagtctaaaaagaacagcatggacgtggataaatactatctgtacttcatgcagatgggcatagacctctatgatggaacttccatcgacattgacgatctgaataactaccagatcgaccatattgtgccacaatcattttataaggatgacagcttcgataatagggtccttacccactacagtaacaaccagaagaaaggcaataacacacccttgaatgggctgaacatcgactctaatacccgcgaggtttggaaccatttaataggactcggtctgatcactaagcggaaatacaataaccttacgctgaagggcatggatcagttgtccaaatatacaaagcacgggtttattagaaggcagctcgtggaaaccagccaagtgatcaagctggtagcaaatattctatcggacgagtactcaaaagatgacactaagatcatagaagtcaaagctaagctgaactctcagattcgacaggtgttcaatctctataaaatccgcgagctgaacgattaccaccatgcccttgacgcatatttgaccacatttatcggaggctacctgtataatcggtacccgaacttaagaaatatgttcgtttacggtgatttcaagaagtttagtgcgaaaattgacaacctcgagaccttcaattttctgcacgacataactaacccttccgataagttcgaagacaggatcattgatgagaaaagcggggaagtgatccttgaccgtcgccatgctattgagacaatcaagaaaatatatcaatacaactatatgctgatcacgcgggaagtctctaccaagaatggccagctaagcgatcagactgtgtactccgccagaaggattaacaaagttaattcacccatcccagtgaagaaggacagtaaccctgagctctatggatttcgaacaggcaatgtagatcaccacatggtcattgtgaaatacctgaacaaggacaaatatgattacaagatcatagggattcccttgcggttcgtgcaggtcctgaaaaatagcaacgacaataccgagtacaagaacatcttaaataagatcgttcaatctaaactcaagggaaaatccacagattttcgcgtgattctggacaacgtaatgtatggtcagcttatccaggatggcgggcagaagttcactctgggatcaagtacctacaaatataatgcaaagcaattggtgataaacatggacgacattagaatcctcgtcgataataggtactttaacagcctgtccgacgatgacgcctctggcgagttcattaagatctataacgaaatactaaaagtgattaatgctcggtttgatctgttcgacatcaacaagttccgagaaaaacttaataacggtaaggagtactttgaaaatctctcgatcgatgagaaaaaccaggttctgttgaagatgctgagcgggttacattgcggctcagccaatgtgccaattaaggagctcggactgacgactccccttggcaaactgcagatcccttccgggattgtcttgagtgaagacgcaatagtgatctatcagtctccaagcggactcttcgagagaaagattcgcctgaaagatatctga

SEQ ID NO: 3246 - RNA, 4176 nt, synthetic construct
  misc_feature 1..4176: note = Cas9 variant
  source 1..4176: mol_type = other RNA
atgaacctgagaaattaccccggcgagtatagcatcgggctcgacatgggaaccggttccgtgggctggtctgtcgttgatgaaaaggggaaccttctgcacttcaaaaagaaacctacatggggatcaaggttgtttgacagtgtgatgccagccagcgaggctcgggtacatcgcggccagcgacgtagatacgaaaggcggcgctggagattagatctgctacaaggtctcttcaagaatgagatgaacaaagtggacccggaatttttcatgaggctgaatcagtcccggactattgagggggatcccatatttacgaagtctttcaccaaggcagactattacgatcgctttcctacaatctatcaccttcgagcctacctgatggagtcgaacgaaccagcggacttgagactcatttatctggctatgcataatatcattaaacacaggggaaacttcctgcgggaggaagagaagtcactcagcgccaaacatgcagatagtaagaaagccgtcactcagtttgtggacgctttaaaggagtggtgcttctcccgtggctacgaatttggcaaggatcccgcaaaatctatcgagaagtgtctgagcgactccaaatcaagtcgcagccagcttgcctctgaaatagctaaggccttggcggtttccaccgatgcagccgctgccgacaaaaagctggcagacaatctagctaaagccatggtggggctccaatgcgagttcaagtacgtctttggagaatttgattgtgagtcaacaaagctggcgcttagcgacgatgagaaactggaattgctcagagccgcatgccctgacgatagtgtggagctgttagacgctctgtgtgccgtatattctgcttacgttctccagggtcttctgtcctatgccccaggccagaccatcagccacaacatgattgcaaagtacgatttgtataaaactgacctaaagacactgagggccctcgtgcgggaatacgctcccggggcgtatgatgagttctttcgaggagcaacctaccacgacgccaatcctgatgactcgtctaaagactactcctatgctgatgccgaaggctacacggcatataacctgcataagttgtcatacgacgatttcgccaaggctgtcaaaaagctgttgggtgggactgacgccgtgaccgatgagcgctatctcaatatgatggagagatttgaaaaacagcaattcctgaggcggttaaagacaagtgacaacggagcaatctactatcagctgcacctagaggaactcactgcgattatcaaaaatcagggccgcttttacagcttcctgaaggagtacgaaggcaagtttgagtcccttgtgtctttcagaataccatattacgtcgggccgttgaccagcgttaacgctgcccaggattcacataaccacaataggtttcaatggagtgagcgtaaacccggaatggaacgggaggtgattacaccttggaactgggacaccatcattgataagaataaatccgcagaaaacttcatcatgcgaatgacgggtgactgcacttatctggccggcgagaaggtactcccaaaacagagcctgctttacgaggaattttgtgtgctgaatgagttgaacggggtcagatggtctgatgacggagatgactggcagaggttcgacgctgcccaacgcgaaggcatcgtgcgggagctctttcacaagtatagaagggttacatacaagatgctggaagattggttagtgcgcgagggtgacgcaaatcatcccattgtcaaagggggccagggagagaccggcctggaatcaaagatggggagttatctattcttcgctaaaggaatatttggtctcggcgagctgagccctgccgaatacccagcgatcgagaagatgattaaatggaacactcttttcgaagatcgatccatcttgaaggagaaactggaggacgaatttggggagcggggaaatggcatgctcgatgcctctcagataaaggctatttgcaagaaacgtttcacaggttgggggagactgtcggaacagtttttaaccggcctgaaggtggagagccccgcaggaagggccgtatccatcatggacgttcttcgcgaaggcaacccgtgttcagagcggagacaaggggagacggtggtcatgatggaagctcttagggatgagggactcggtttccagaaaaagatcgacgaacacaatcgaaactactatggccagcatgggaaagatctgggagtgaatgagctacctggcagtcccgccattcgccggtctctgaaccaggcaatcagaattgtcgaggaaatagcgagcatcgccggtcacgctccagccaatatttttatcgaggtgacccgtggggaagacgcaggcaagaagggaaaaaggacagttaagcgctgggataaaatcggcgaggctctcaagaaactgaaggaagagggggtggccgtagaggtcatggacgatttcaaggaacaaaaagcaattaacgccaaccttgacgagcggttgtccctgtacttaatgcagaatggaaagtgcctctattcaggcaaagctataaacctggaaaaacttctggcgggtagcggggagtacgaagtggaccatatcattcctagagcctatatcaaggatgactctattgagaataaggcattggttctcagggaggaaaaccagcacaagactgatcagctgctaatcgacaaatccatacgatggaagatgcgggagacctggagtcaactgcacgatgctggactcatcggcgacaaaaagtaccataatctgcttcgcagcaacattaatgaaaaccagttgagaggttttatcgccaggcagctggtggagacatctcagatggtcaaattagcccaagctctcctggaagcacggttcgccaatgaggagactcgaattgtgcccgtaaaggcgtccatgtcacacaaccttagagaagctgccgatctggcaaaatgtcgcgaggccaatgactttcatcacgctcacgatgcattcctagccagtaggatcggcctctttgtgcagatgcgtcatccagggatatatgaaaaccccattggatacagccacgttatcaagaagtacgtccaggagcaatcggaggtgttcaaaaagacccatcggatgcctggctccgcggggttcgtgattaattcttttatgagctcaggattcgacaaagatacaggcgaagtctttaaggacagttgggacgctgaggccgaagttgatggtatcagaaaagcactgaactataggcagtgctacatatcccgcatgccacagcaggacaccggggccttctggaatgctactgtgtattctccgcgagatcccaagatgggacctaagttggccctgagcacgaaacaaggcttagacccaaagctctacggtggcttttcctcacagcagttcgcatatttcttcatctacgaggctaaaaagaaagggaagcccacatttagattcagccaggtgcctgtatggctggccgcgcggattgaagccaacccacttgcactggaggagtatgctaggggattggccaagggcgaagggctcgagtttgtcagtatccaacgccccaaaatttacaagaaacagctgatcgaagtgaacggagataagctaataattaccggcgctaaagaggttcgttctggtgcagaactggccttcaatcaggacgagatctccgccatcagcatgtgctcgaaacttagagctgcggaggcagggctcgatggagccttctcagaagaggtgtctgctatttggaaccggatcagtaatgccccggtccagtcctgtggcaggctgttgcgccaactgactttacctaagtaccagagcaactttgactctagctccaatgaagagaaggcagccgtggttctcggtctgattgcgcttctgaacggcaataaccgaatagtggatttgtcaggggtaggaggcagtagccacgctggggccatgatgatgtcttatccaaagctcctggacgatcccaaagtccctttctttatcattgaccagtccgtgaccggaatgttcgaaagaaagacacgggtgggcctatga

SEQ ID NO: 3247 - RNA, 4176 nt, synthetic construct
  misc_feature 1..4176: note = Cas9 variant
  source 1..4176: mol_type = other RNA
atgaagaaaatcctgggcctcgaccttgggaccacaagcattggatgggccctggtgaacgagaaggaaaataacgaggaacagtcctctataatcagattgggtgtcagggttaatcccttaactgtggatgagaaatcaaacttcgaaaagggcaaagacattacgaccaatgctgatcggacaaagtgccgcagtgcacgacgtaacctgcaaagatttaagctaaggcgggaggccctcgcggactgtctgaaacgccacgggcttatgactgatgagacccctctgtgcgaaacaaataacagcatcattttcaagacctactccaatagagctaaagccgtatgtgagaagatcgcattggacgattttgtgagggtcctcttcatgataaacaaaaagcggggatataagtcttcgcgcaaactgaatactgacgatgaaggcacactggtggacggtatggatgttgccaagctcttatacaacgagcagatcaccccaggggagtatctgcttcgattgtttaaaaagggaaagaagacgagaccggacttctacctgtcagatctaaaagctgaactcgagaggatttgggactttcagcggactttctatcccgaaatcctgtgcgacgcacttaaggaggatctgaagggcaaaagccgtacccagagttccgccatattttacgctaagtataaagtgtctacagccaagatcgcgggcaaagacaagcgcttgcaagaactcacttggagaaccgatgcactgaggaagcagttaacaatagacgaggtcgcctacgtgatttgtagcatcaatggggagattaacggatcctcacagcggctgagtatgatcagcgatcgatctaaactcctttacttcaatcatcagaccatcggtcaatatctgatgcagcgcttggaagagaaccctaacgctggcctaaagaatattatattttacagacaggactatgaagatgagttcaacgacatctggaactcccaggccacgtaccacaaagaactgactccagagctcaagaaagagctgaaggatattatcttttatcaaagggggcttaagtcatgcaaatggctgataaattactgtgaattggagcatgaagagattgaagtaaagacacccgagggaaaactccggaagatcaccatcggcagcaaaacttgccctaagagttctccactgttccaggagttcaagatttggcaggttttaaataacctgcaagtgagccccctaaattcccgcagaaaagcaaagaggaaaaaggacgaggaaccttcgctcttttctgatgaagacatgaacacagcttgtcgttatctgaatgaggaggaaaaacttaccttgttcaaggagctgtccatcaaaaaggaactcaagaaaaaggacgccctgaaacttctgtttgagaactacaaggaattggatctcaattacaaagtcatttcaggtaacgtgacgatggcgagtctgtatcgggccttccaggacataatcagcttaaccgggaatggagagtttgatttccaggcaatgccagctgaggaagccgagaagacagtggaagagatttttggcggcctggggtacaagactgctttcctacactttgacgcctccctccatggaaaagagttcgaacgacagccggcatatagactgtggcaccttttgtactcttatgccggtgatcaaagcaagaccggcatcgaggctctggtcaaaaggatccaggaactctgcgggtttgagcccgaatacgcgcgcattctggcaaacatatcattcatccctgactatggaaatttaagttccaaggccatgcggaaaattctgccatacatgcaggatggctacgagtatagcgaagcatgttctaaggccggttacagacactcagcaagtagccttacaaaggaggagatcaacaaaaagacttataaaacccatttggacgaaattaagaggaactccctccgcaatcccatcgttgagaaaatactgaaccagatggtgaatgtagtgaactctgtcatcgatacatacgggtcgattgacgaaatccgaattgagatggcccgggagctaaagaaaagcaaacctgaacgtgaggatatgtcctttgctatcaataaggccaccaaagaaactgagagaataaagggcattctggaacaagagttcaaaatccagcacgtgacgaggaacgacattatccgctatcggctctacgaggaactgaagccaaatggatataaaacactttactcaaacacctacatacccagagaggatttgttcagtaagaagtttgacatcgaacatattatcccgaaagcaaggctgttcgacgattcttatagcaataagactttagagctccgagacattaacatcgaaaaaggcaatcagaccgcgtacgattttgttctgtccaagtatggggaggagggactttacaaatatgaacagcgcgtggaggagttcaagaagaacaatgaacaagctggttcaaaatgccggaagctgttgatgagagaagccgacatacctagcgattttctcaacagggacctgaatgattctcagtacattgctaaaaaggcccacgagctactgcgtgagatcgtccccacagtgaccgctactacaggctccatcacgaaccgcctccgggaagactggaaactggtaaacgttatgaaggagcttaattgggaaaagtatgataaattggggctgaccgaggagtacaaggacaaagatggaaacactgtgagacacattaaggactggacaaaaaggaatgatcatcgacaccatgccatggacgcattaaccatcgctttcacaaagccaagttttattcagtacctcaacaatctgaacgcccggagcaataagggcggttctatatatgggatcgaacagaaagagcttgaacgcgagaacaataagctggtcttcattcctcccatcgacccaaaaatttttagaaagcaagcgaaagaacacctatccaacatcctcatatcaatcaaggccaagaataaagtggtcactaagaacgtgaataaaaccaagagtaaaagcggcacgaacaggaaggttcagctgacaccccggggacagttgcatctggagaccgtgtacggcaaaattcgaacttataagaccgaggaaatcaaggtagggacaaaattaactgaggaactcattgctaaggtcgcagataaaaagatcagagaggccctgatgcaacgcctttcggaatacggaggtaatattaaaaaggctttccagaacatttccaagcaccctatctggctgaactctagccacaccaaacatgtgccagagaaggttaaaatcgtgtttttcgaggacgtctttacgattaggaaggccataacaccggatatcaaaattgacaaggtgatcaattcaaagattcgtaacatcttgcaggaacggctcaatgagttcggcggggaagcagcgaaagccttcagtaacctggatcagaatcccatatggtttaacaaggacaaaggaatcgctattaagtccgtaaaaatcagaggcattgccaatggtaccgcaatcagggtgaagaaggatatacacgggaacactattatcggcaataacggatatcctatcccaaatgactacgttaacacaggcaataaccatcacgtcgctattttccgcgatcgagacgggaatctacaagagcacatcgtgtctttttatgaagccaccgcaagagccatacagaacctgcccattgtggatcggaattacaacagcgagaaagactgggagttcctcttttccatgaagcagaacgaatacttcgtctttcctaatccaaacactggattcaatccccttgagatcgacctgaggaacgaagagaattatgctttgatttcaccgaacctgtttcgcgttcagaaattaagccattactattacgtgttccgtcaccatctcgagaccaatgtggatacaaacctgcaacttaaggacatcacgtggaaaagaataaaggcgattaataacctgaccggcgtagtcaaagtgcggatcgatcacttgggtaggatcgttgacgtgggggaatataagtga

SEQ ID NO: 3248 - RNA, 4176 nt, synthetic construct
  misc_feature 1..4176: note = Cas9 variant
  source 1..4176: mol_type = other RNA
atgaagaaaagaatcgacgattacattctgggcctcgacatagggaccaacagctgcggatgggccgtgacagataagaaaaataaccttctgaagttgaggggtaaaactgctatcggctcccacttattcgaggaagggcatacggcagccgaccggcgcggatttcgaaccacacgtagaaggctgaagcggcgcaagtggagactaaggctcctggaggaaattttcgcggagcccatggctgaagtcgatcctggctttttcgttcggcttcaccagtcttgggtgtcaccactggacaaaagtcgcaagaaatatcaagccatcgtatttccgactgcaaaggaggatcaggagtactatcagaaataccccaccatttatcatttgcgagacgccctcatgacacaggatagacaattcgacctgagggaaatctttctggctatacaccatatcgtgaagtaccggggtaatttcctccaggataccgcagtcaaggactttgaggccagcaaaattgaagtggggcctatcttaactaacattaataacgctttcgccgataagatcgttgagggacaggacctgatagagcttaatgtggcgaacgcagccgaaattgaggctgtcatccgtggcaaagacgccgataagacattgtataaaatggacaaggtgaaaaagattgcaaagctgctaaccgattccacggctaaagaacagaagaatgtagccaaacaaatcgcgaacgccatcatgggctacaagactcagctcgagaccattctggggaaagaaatagacaagaatgataaggcacagtgggagtttaaactttctgacgctgatgacaagctggatgccttgctcccagacctggatgagtcggaccagacagttgtggctgaaatcgagaaattattctcagccattactctgagcaccatcgtcgacgaaaacaagagtctctcccaatctatggtggagaaatacaataagcaccaccaggattataaacttctgaaagcatacatagagagcttgcccgaccgcgcccaggctaagaaactactgctcgcgtatgatctgtacgtgaacaatagacatggacaccttctggaagcaaagacagagtttaaacaagactccaccttgacgaaggaagatttctataagactgtcaaagacaacctcgatgactcagagctggcccataagattgctcaggaaatcgccgcagataacttcatgcctaaacagaggacaaatagtaacggtgttatcccatttcagttacaccaaattgagctggacaagatcattgccaatcagagcaaatactatcccttcctagctgccgaaaaccctgtggaggatcaccggaagcaggcaccatacaaactcgacgagctggtacgatttcgcgtgccgtactatgtcggccccatgataaccgcggatgaacaggagaagacttctgggaagtccttcgcttggatggtgagaaaagaacaaggacagatcacaccttggaattttgagcagaaggttgacaggcaggagtcagccaacaaattcattaagcggatgaccatcaaagacacgtaccttttgggcgaagatgtgctgccagcaaatagcctcctgtatcaacgctttgaggtccttaacgaactgaataacatcagagtgaatggtagtaggatttctgtagacttgaagcagcagatattcaacgatctctttgaggaaaagaaaaccgttacagagaaggccctgatctcctacttaaaacagaatctgcatctacccactgtggagattaaggggctcgctgaccctaccaaattcaacagctcgctggcctcttattaccaccttaagaatttgcatgtctttgataaggaactggcagacccacaatatcagaaagagttcgaaaagatcattgagtactcctcaatctttgaagataaaaagatattccaggacaaactccacgctgagttcaagtggctgacacccgcccaatttaaggcgatcagtacttggcgtttacagggatggggccggctgagccgaaaacttttggtggagctccatgataccaacggccagaacattatcgaacagctgtgggactcccaaaagaatttcatgcagattgtcacagagccggattttaaagaagccatcgctaaggagaaccagaatataacccaggaaaacggggtggaggagattctagcagacgcctacacttctcctgctaataaaaaggccatcagacaagttgtgaaagtagtcgcagatgtggttaaggcggccagcggaaaggctcccgcccagttcgcaattgaatttacgagggacccagacaaaaaccctcagctgtcacacatccgcggtacaaagctcctgaaggcttatcaggagaccgccggcgaacttgtggatcaaaatttgactaacagtctgaaggaggcaatgacctcccggaaattactcaaggacaagtacttcctgtattttatgcagacagggagagatgcctacaccggcaaaaagataaatatcgacgaggtcagcactaactatcagattgatcacatccttccccaatctttcattaaagacgattcatttgacaatagggtgctgacagctacgccattgaacgcggaaaagagtgatgacgtaccctacaaacgcttcgccaataactatgtgagcgatctcaagatgaccgttggagagatgtggaagcattggcagaaagcaggtatcataaataagcacaaactggggaacctactgctcgaccctgaccgactgtccaagtttcagaaatctggcttcattaaccggcagcttgtcgaaacttcgcaaatcgtgaagttggtgagcgtcatcctgcagaataagtacccagatgctgagattatcacagttaaagccggagacaactccgccttacgtcagagactcgatctgtacaagtcaagggacgtgaatgattatcatcacgctattgacgcataccttagtatagtgtgtggcaactttctgtatcaggtatacccgaaatatcgcccctacttcgtctatgggcaattcaagaaattttctcaggatcctgacctacagaaggatctcatcaagcacttcaaaggatttaccttcatgtggccactgttgcagaaggacaatagcgaacggaaagccctggaggagattaaggaaaacaattccgatagaatcgtgttttacaaacatcccgacattttcgataagttaaggaaagcgtacaactataagtacatgctcgtttcacgagagacaagcactgaatcttccagtatgtttaatatgaccatctatcctcgcggtgagcgggacagaaagaaaacgaggaagctgataccaaaaggcaacgggcttgaccccaagatctacggaggctatagcggtaataccgatgcttacatggtgattgtcaaaatcgaaaaggccaaggagtctatttataaagtgatcgggataccgatgcgtgcactggccggcttgaagcaagctaaaaaccagggaaattacaaggaggaactccacaaagttgtggagcctcagattatgctggacaagaacggcaagccaaaacgcggggtagaaggattccgggtcgtgaaggatcatgtgccctttaaacaggtcgttctagacggtgataagaaattcatgctgtactccgcaaagtatgagacaaatgccaagcaacttactctctcacaggaaaccatgagaatcgtgacagacaacctgaaaaagagtgaggatcaggacaaattgctggtaaaggcgtacgatgagatcttacaaaaagtggaccagtatctccctctgtttgatgtcaacaagttcaggaatagccttcacctgggccgagctaaattcttggacctcgccgtgaacgataagaagattactctgtcgaatatactaaacgggctgcatgacaatcttgttgtgcccaacctcaaaaatatcggaattaagaccccatttggcctgatgcagtccccttctggtatcacgttgagctcaaacgcaattttaatcttccagagtcccacagggctgtttgaaaaacgggtccgcatagccgacctctga

SEQ ID NO: 3249 - RNA, 4176 nt, synthetic construct
  misc_feature 1..4176: note = Cas9 variant
  source 1..4176: mol_type = other RNA
atggagaacaagcagtactatatcggcctggacgtggggaccaatagcgtcggatgggccgttacagatacttcctacaacctccttagagctaaaggtaaggacatgtggggcgcaaggctgttcgatgaagccaaaacggcggtggagcggcgcaccaagcgaacatctcgtagaaggtcagaacgggagaaagctcgcaaggccatgttgaaggaattatttgcagacgagattaataaagtagatcccaacttctttataagactggaggaaagtaagttctttctagacgataggagcgagaataaccggcaacgctatactctcttcaatgacgccaaatttaccgataaggactactatgaaaaatacaagacaatcttccatctgcgatccgctcttattaactctgatgagaagtttgacgtgagactggtcttcttggcaatcctcaatctgttttcgcacagggggcacttcctgaacgcctcactcaaaggagatggcgagattcagggtgtggacatcttttataatgacttatacgaagtttgcgaggagttcgagatagatctgcctcagatcagcaacattgacaatttcgaaaagatccttagtcagaaagggaagtcccggaccaaaattttggaggagctgtctgaagaactaagcatctccaagaaagaaaagataaagtactcactcctgaaacttatttgtggaatgaagatcaaagtggtcgatatttatgctgacgaggatatccaagaagacgataagaaaaaggacctgggctttcgtgagagtgattacgagaaaagctctttggaagtgaaagagatcattggcgacgatcatttcgaactcatagagcgcgccaaggcggtacacgacatcgggctgttagcaaacattatcggaaattccaaatatctgtgcgaagccagagttgaggcttacgacaaccatcacaaggatctccagaaaataaaggagcttctgaagaaatatgacattaaggcctacactgatatgtttaggaaaatgacagacaagaactattcagcatacgtgggtagcgtcaatagtaacatcgctaaagaacggcgatctgtggataatcgcaagatcgaggacttgtacgaatatattaagaaaatcgccctaaagaacatttccgatgacaatgaggataaaatagagatcctgaagaaaattgaaaccggcgagttcctcaagaaacagctgacggcgagcaacggggtgatcccaaatcagcttcaatcgagagaactgagggccatcttgaagaaggcagagaactacctcccgtttctgaaagaaaagggagagaaaaatttaactgtctctgagatgattatacagctgttcgaatttcagatcccctattacgttggccctctagacaagaacccaaagaaggataagaatgctaactcctgggccgtgattccctcaggtgggcggatcctcccttggaatttcgaggacaaagtagatgtgaagggaagtcgcaaagaatttattgagaagatggtcagaaaatgtacctatctgagcgaagaacacacacttccaaagcagtccttgctgtacgagaagttcatggtgctcaacgaaatcaataacataaaaatcgacggcgagaagatttctgttgaagctaaacaaaagatctataacgacctgtttatgaaaggcaagaaggtgagccagaaagccattaagcaggagcttatctcactgaatataatgagtaaagattccgtcttgagcgggattgacactgtgtgcaacgcatacctctcttcaatcgccaagttcaggggagtatttgatgaaaatgttaacaatcaaagtaccattgacatgatcgaggatataatcttcctgaaaacagtgtacagcgacgagaagcgtttcgtcaaagaagagattgtggaaaagtatggtgatgagatcgacaaggataaaattaagcggatcttaggctttaaattctccaactgggggaatatatctaagtcgtttctggagctagaaggagctgacgtcggcaccggtgagattcgaagcatcatccagtccctctgggaaacgaacttcaatctgatggagcttttgtcaagtagatttacttacatggatgaactggagaaaagggtgaagaagctcgagaaacccctgtctgaatggacaattgaggacttagatgacatgtatctgagctcccctgttaagcgcatgatctggcagtcaatgaaaattgtggacgaaatacagaccgtaatcgggtacgcgccaaagcggattttcgtcgagatgactagaagcgaaggcgagaaagtgaggacaaagtctcgcaaggatcgacttaaagagttgtattccgcaatcaaggaagacagtaaacaatgggttaaggagctcgatgccaaagacgaaagctactttcggtctaagaagatgtatctgtactacctacagaaaggacgttgtatgtattccggcgaggtgattgaactggataagctcatggacgataacctgtacgacatcgatcatatatatccgagatcattcgtcaaagacgatagtcttgacaatttggtgctggtaaagaaagagatcaacaataggaagcagaacgaccccattacccctcagatccaagctagctgccaggggttttggaaggtgttacacgagcagggattcatttcgaatgaaaaatactcccgcctcacgcggaagacccaggagttttctgatgaagagaaactgagcttcatcaacagacaaatagttgagacaggtcaggccactaagtgtatggcacagattcttcagaaatcaatgggcgaagacgtcgatgtggtgtttagtaaggccaggctggtctccgagttccgacataaattcgaattgtttaagtctcgcctcatcaacgacttccaccacgctaatgatgcctatctgaacatcgttgtggggaatagctactttgtgaagttcacccggaacccagcaaattttattaaagacgcgagaaagaaccccgataatcctgcttataaataccatatggacaggttctttgagcgtgatgtaaagtccaaatcagaagtcgcctggataggacaaagcgagggcaacgcaggtacaatcgccattgtgaagaagactatgagtaaaaattctccactaatcaccaagaaagttgaggaagggcacggctccattacaaaggagaccatcgtgggagtcaaagaaataaagttcggccgcaacaaggtggagaaagctgacaagactcccaaaaaggccaatctgcaggcataccggccgatcaaaacgagcgatgaaagactctgcaacattctgaggtatgggggacgaacatcgatctcaatttctggttactgtcttgttgagtatgtgaagaagcggaaaaccatccgcagtttggaggctatacctgtatacctgggcagaaaggactccttaagcgaagagaaactcctgaattattttaggtacaaccttaatgatgggggaaaggactctgtcagcgacattcggctgtgcctacccttcatctccactaactcactcgtgaaaatcgatggctatctgtactacttgggtgggaagaacgacgatcgaatccagctgtataatgcctaccaattaaaaatgaagaaggaagaggtggaatatattagaaaaatagagaaggcggtcagtatgagcaaatttgacgagattgatcgcgaaaagaacccagttctcaccgaggagaaaaatatcgagctgtacaacaagattcaggacaagttcgagaatacagtgttctctaaaaggatgtcccttgtaaagtataacaaaaaggatctgtcatttggcgacttcttgaaaaataagaagagtaaatttgaagagatcgatctcgaaaagcagtgtaaagtgctgtacaacataattttcaatctaagcaacctgaaggaggtcgacctttccgatatcggaggctctaaatcgaccgggaagtgccgttgcaagaaaaatatcactaactataaggaatttaaactcattcagcaaagcatcacaggactgtactcatgtgagaaggacttgatgacgatttga

SEQ ID NO: 3250 - RNA, 4176 nt, synthetic construct
  misc_feature 1..4176: note = Cas9 variant
  source 1..4176: mol_type = other RNA
atgaagagaaacaatgactactatatcggcctggatatggggaccaacagcgtgggatgggccacaactaatccccagggtaggctccttcggttcaacaaaaaggacatgtggggctcccgcctgtttgaggaagctaaaacggcagccaagacccgaacattccgtacttctagaaggcggtacgatcgcgtcagacaaaggattgagtttttgcaggacatattcgcgcctatcattgctaaaaaggattttgagttctttatgcggttaaaggagtcaaaattccacctggaagacaagaaaaccgatgggaagtttgccctattcaatgacgcagattttacagacgttgagtatttcgatcgctacccaaccatctatcatctccgagccgctctgattaaaccgaaccacatcactgaccccagacttctgtacttggcaatacatcacatcattaagaataggggacattttctcttcgccggcacagatatggagagtatccggagcttccagattgtgtatacccagctgtccgaacacctgaagtctatcaacctcgactttgagttacctgtagacgctcaagataaattcgccgcgatactgcttaatgaaaagttgaacaaacgtgacaagaaaaagcagctgaaagagctatgcccacacaaggataagcgcctcgagtacgcatttaatgccattatcggtgggaaaacgaagctgaaagacattttcggagtggaagagtacgatgaaggcactaagaaagctgtcgactttgagaaggccgattatgacgaagataaggacgagatcgagtcggtgatcaaagaaaacattcatgttcttaatgcactgaaggctgtgtacgattggaccatattgacaaacatcctcggcgactatgcctacatttcagagagccaggtcgcgctgtatgaagcccacaaaaaggacttaagaatcctgaaaagtctcataaagaagtacgcaaaatcccagtatgctgatgccttcaggcatgagaatgtgaaggggaactacgctaactacgtaggatctactaattatgacaacaaacaacccgttattgataatcctagcgtgacccaggaagacatcaacaagtactttgccgatatccttctgtccattacaccagacgagtcagatcgggagagttatcagtacatcaccgaacgattgcacaaaggtgaggcactacccaagctgcgcacgaaggccaatagcgtcctccctcaccagattcataaaatagaactggagaagatccttgctaacgcggccaaaaatttcccatttctgcaagaaaaggactcttccggctatactgcagctcagaaaattgtgaagatcatgatgttcagaatcgagtactatgtggggccgttgaacacataccaccatgtcgatcagggaggccacgcctggatggttaggaaagcagagggtaagattaccccctggaattttgacgaaaaggtggataaagaggcctcagctgaaaagttcatacggaacatgactaataaatgtacatacctcatcgggaaggacgtaattcctaaacaaagcctgttatatagtcgctacaaggtgctgaacgagctaaataacctcaaggtcaatggagccccaatctctgtggcactgaaacagaagatttatgaggaactttttaaaaagcaggttaacgtgaccttcaaccagttgaaaacgttcctgaagacccaaggcgaggatgcggacgaaatcatactctccggcgtcgacgaggctgcccataagtttacaaataacctgcagacttaccacaaattcagagcaatccttagggataagattgaatttgagccccagcgtagcatggtggaggacatcattcggtggaaatgcctgatgggggatgacatcaccatgtggaagcacaaaatagaaaaggagtatggagatcagttgtcggaagaacaactcaagaaaattacacgactgaatttcaacggttggtctagattatcccaggaatttctgactgacgtacctggcgttgatatcgagtcaggggaggtgtacagtggaattatggacgccctatggaggaccaatgaaaacatcatgcagctcctgagctcccgcttcacatttgctgccgaggtcaagaaacagaatcaaggcaccggtcggatagaaaagatcacttatgatgaggtgatgaaagacacgtacctttctccagcagtcaagagaagcgtgtggcaggctattacattggttgaagagatcaggaaaattcgcaaggccgatcccaagcgaatcttcgtggagatgacccggcagccggacgcgaaaaaggaacgtaaactgtcaagaaggactcagctcctgaacgcctaccgcgctatagggaatgatattgcagagtatgaaaaggagcatgtaagtaccttaatcacacaactggagtccaaaaaggacgaagaccttcggagaaagaaattgtacctctattttacccagatgggaaggtgtatgtacactggcgagcgaatcgatctgagctctctactgcgcgacacaaactcaaatatttatgatatcgaccacatttaccctcggagtctcacgaaggatgacagcctggataacaccgtcctttgcaaaaaggaaataaatttgaaaaagggcaacaagtatatccatagagtgttcactgacaaagagctgaagaaacagtacgggtactggaaggccttaaaagaaaagaagctcatttccgagaggaaattttctcgtctgatgcgcacaaccgatcttacagctgacgagctggccggattcatctcgcggcaattggttgaaactagccagatggtgaaggcaaccgcggatattctcgagaaaatctatcccaatgtcacgatagtgtacgtaaaggccagaaccgtgtccgactttaggcacgactatgaactgccaaaagttcgagctctaaacgattgtcaccatgcccacgacgcatacctgaacatcgtcgtgggtaatgtgtattacgagaagttcacaaagtcacctttccggtttattgctaaccagaaaggcaagggggatatcaaatataatctctaccgcctgttcgacaaggatgtcaaagttggagacagaattatctggaacgccaaggaagatcttgcaagggtgaaagccactttggagcgggacaccgtgaatgtagtccgaatgcccgtggagcagagaggccaatttttcgatgctacaatacagaagaagggtactaccaaaaacatgctggttttaccactcaaggggagtgacgaacgcctgcaggatacgtctaaatacggctattacgtgaggcccagcggaatgtcctttatggtcgtgcagcatgaggttaagggcaaatcacgtgtgacaattgaacctgcgcttctggtatataagaataagctaaaaagcgaggacgattacgccaagtattgcgaagacgtcctcaaactgcaaaagccaaaagtgttgttcaagaacatcaagtttgggtctaaaatcctgttcgacggatacccgtttttactcaagggtcggaccgagaatagaattataatggcagatgctcagtccctgttccttggcaaccaggagctgaaaatcttgaagagggtgactaaaattagtgacgatatcgaccacaaggtcgaaagccgcattaagatcacagatgaggaatggaccactctctggaaatctgttgtggagcagatagtaaccgggaagtttcgaaatagactgggaacactaaacggcatcctgcaaggtcggaaaattaagctgtccaaagacgaggaagccaggctcaatgagctggattcaaaggaccaggaaacgttcttgagtcagatcctgttagagcgcttcctccaatttagcaccgaagagaaaactcgtctgcttcttcaggtgatttcgttctccgggaacacaaccggcgtcgatttgagactcatcggaggctctagcgggacaggaactataaagaccaataagaacattacggaccattcagtgatcctgatcaacgagagtcccacaggcctatttaccaatcggactgttctgaaccagccttga

SEQ ID NO: 3251 - RNA, 4176 nt, synthetic construct
  misc_feature 1..4176: note = Cas9 variant
  source 1..4176: mol_type = other RNA
atgaagagaaacaatgactactatatcggcctggatatggggaccaacagcgtgggatgggccacaactaatccccagggtaggctccttcggttcaacaaaaaggacatgtggggctcccgcctgtttgaggaagctaaaacggcagccaagacccgaacattccgtacttctagaaggcggtacgatcgcgtcagacaaaggattgagtttttgcaggacatattcgcgcctatcattgctaaaaaggattttgagttctttatgcggttaaaggagtcaaaattccacctggaagacaagaaaaccgatgggaagtttgccctattcaatgacgcagattttacagacgttgagtatttcgatcgctacccaaccatctatcatctccgagccgctctgattaaaccgaaccacatcactgaccccagacttctgtacttggcaatacatcacatcattaagaataggggacattttctcttcgccggcacagatatggagagtatccggagcttccagattgtgtatacccagctgtccgaacacctgaagtctatcaacctcgactttgagttacctgtagacgctcaagataaattcgccgcgatactgcttaatgaaaagttgaacaaacgtgacaagaaaaagcagctgaaagagctatgcccacacaaggataagcgcctcgagtacgcatttaatgccattatcggtgggaaaacgaagctgaaagacattttcggagtggaagagtacgatgaaggcactaagaaagctgtcgactttgagaaggccgattatgacgaagataaggacgagatcgagtcggtgatcaaagaaaacattcatgttcttaatgcactgaaggctgtgtacgattggaccatattgacaaacatcctcggcgactatgcctacatttcagagagccaggtcgcgctgtatgaagcccacaaaaaggacttaagaatcctgaaaagtctcataaagaagtacgcaaaatcccagtatgctgatgccttcaggcatgagaatgtgaaggggaactacgctaactacgtaggatctactaattatgacaacaaacaacccgttattgataatcctagcgtgacccaggaagacatcaacaagtactttgccgatatccttctgtccattacaccagacgagtcagatcgggagagttatcagtacatcaccgaacgattgcacaaaggtgaggcactacccaagctgcgcacgaaggccaatagcgtcctccctcaccagattcataaaatagaactggagaagatccttgctaacgcggctaaaaatttcccatttctgcaagaaaaggactcttccggctatactgccgctcagaaaattgtgaagatcatgatgttcagaatcgagtactatgtggggccgttgaacacataccaccatgtcgatcagggaggccacgcctggatggttaggaaagcagagggtaagattaccccctggaattttgacgaaaaggtggataaagaggcctcagctgaaaagttcatacggaacatgactaataaatgtacatacctcatcgggaaggacgtaattcctaaacaaagcctgttatatagtcgctacaaggtgctgaacgagctaaataacctcaaggtcaatggagtgccaatctctgttgccctgaaacagaagatttatgaggaactttttaaaaagcaagtgaacgtcaccttcaaccagttgaaaacgttcctgaagacccagggcgaggatgcagacgaaatcatactctccggcgtggacgaggcggctcataagtttacaaataacctgcagacttaccacaaattcagagccatccttagggataagattgaatttgagccccagcgtagcatggtagaggacatcattcggtggaaatgcctgatgggggatgacatcaccatgtggaagcacaaaatagaaaaggagtatggagatcagttgtcggaagaacaactcaagaaaattacacgactgaatttcaacggttggtctagattatcccaggaatttctgactgacgttcctggcgtggatatcgagtcaggggaggtctacagtggaattatggacgcactatggaggaccaatgaaaacatcatgcagctcctgagctcccgcttcacatttgccgctgaggtgaagaaacagaatcaaggcaccggtcggatagaaaagatcacttatgatgaggtcatgaaagacacgtacctttctccagccgtgaagagaagcgtttggcaggcaattacattggtggaagagatcaggaaaattcgcaaggctgatcccaagcgaatcttcgtagagatgacccggcagccggacgccaaaaaggaacgtaaactgtcaagaaggactcagctcctgaacgcgtaccgcgccatagggaatgatattgctgagtatgaaaaggagcatgtcagtaccttaatcacacaactggagtccaaaaaggacgaagaccttcggagaaagaaattgtacctctattttacccagatgggaaggtgtatgtacactggcgagcgaatcgatctgagctctctactgcgcgacacaaactcaaatatttatgatatcgaccacatttaccctcggagtctcacgaaggatgacagcctggataacaccgtgctttgcaaaaaggaaataaatttgaaaaagggcaacaagtatatccatagagttttcactgacaaagagctgaagaaacagtacgggtactggaaggcattaaaagaaaagaagctcatttccgagaggaaattttctcgtctgatgcgcacaaccgatcttacagccgacgagctggctggattcatctcgcggcaattggtggaaactagccagatggtcaaggccaccgcagatattctcgagaaaatctatcccaatgtgacgatagtatacgtgaaggcgagaaccgtttccgactttaggcacgactatgaactgccaaaagtccgagccctaaacgattgtcaccatgctcacgacgcctacctgaacatcgtggtgggtaatgtctattacgagaagttcacaaagtcacctttccggtttattgcaaaccagaaaggcaagggggatatcaaatataatctctaccgcctgttcgacaaggatgttaaagtgggagacagaattatctggaacgctaaggaagatcttgccagggtgaaagcaactttggagcgggacaccgtaaatgtcgtgcgaatgcccgttgagcagagaggccaatttttcgatgccacaatacagaagaagggtactaccaaaaacatgctggtgttaccactcaaggggagtgacgaacgcctgcaggatacgtctaaatacggctattacgtcaggcccagcggaatgtcctttatggtggttcagcatgaggtgaagggcaaatcacgtgtaacaattgaacctgcacttctggtctataagaataagctaaaaagcgaggacgattacgcgaagtattgcgaagacgtgctcaaactgcaaaagccaaaagtgttgttcaagaacatcaagtttgggtctaaaatcctgttcgacggatacccgtttttactcaagggtcggaccgagaatagaattataatggccgatgcacagtccctgttccttggcaaccaggagctgaaaatcttgaagagggtcactaaaattagtgacgatatcgaccacaaggttgaaagccgcattaagatcacagatgaggaatggaccactctctggaaatctgtggtagagcagatagtgaccgggaagtttcgaaatagactgggaacactaaacggcatcctgcaaggtcggaaaattaaactttccaaggacgaggaagctaggctcaatgagctggattcaaaggaccaggaaacgttcttgagtcagatcctgttagagcgcttcctccaatttagcaccgaagagaaaactcgtctgcttctgcaggtcatttcgttctccgggaacacaaccggcgtggatttgagactcatcggaggctctagcgggacaggaactataaagaccaataagaacattacggaccattcagttatcctgatcaacgagagtcccacaggcctatttaccaatcggactgtgctgaaccagccttga

SEQ ID NO: 3252 - RNA, 4179 nt, synthetic construct
  misc_feature 1..4179: note = Cas9 variant
  source 1..4179: mol_type = other RNA
atgaaaagcatcctgggcctcgaccttgggaccacatccattggatgggccctggtgaaagagtctgaaaacgataatgagaagtcagaaatagtcaaattgggtgttagattagtgcccctgactacggacgagaggaccgatttcgaaaagggcaaaagtatcacaactaacgctgaccggaccagcaagcgctccatgcgacgtaatctacagagatacaagctcaggcgggaggcactggtatctgagcttaaaaaggaacactggattgatgaggggtatcgcttttcggaagacggacctggctcaacattcagcaccctgagattgagggccaaagcggctgaggaggaaatcagtctccaagatctggccaaggtgctgctccagattaacaaaaagcggggttacaagtcctctcgcaaattaaatagcgcagaggacgggcaggccatcgatggaatgtccgtcgctaaggtgctgtatgaccgaggccttactccaggcgaatacgtttatcagagaatgttggatgggcaatacgcaataccggagttttataaatcagacctgcaggccgaatttgataagatctggaacctacagaaaagttactaccccgagctcacagctgagctgtatgacaaacttaccgacaaaaataagagccagacgtgggccatttgcagggatgaactgggagtgcaaggttttaagtcttccttcactggcaaagagcggttgaaggaagcgtactttaaccgtcagcaggcatcaaaacagaaggtcgacctcgaggtgctgacctgtgtattacaagatatcaatgggcagaaagccagcctgagtggactcctttctgctatttccgaccgcagcaaggaactgtatttcaacagaatgacagttggccagatgttggtgaggcaaatccaggaggatcctaatcggtcgctacgaaacactgtcttttaccgccaggactatatagatgagttcgaaaagatttggtctgtgcagtccagatttcatccagagctgacccaagaaaggaaaaagaaactcaaggacatcattatcttctaccagcggcccctgaaatcacagaagggtcttatcagtctgtgcgagtttgaaagccgcgaggtggatatttccgtcgacggggttataaagaaaaagaaaatcggacctagagtgtgtccaaggtctagccccttgttccaggagttcaaggtatatcaaacagtgaataacattctcgtcaatggcgaacctctggatgacaacgaccgtgagaaattagtgggcgaactggcctttcgggagaagatgaaggggcaggatgttctaaaactcctgtacaagacctcaaaaggaatgcgaatcaacttcgaggaagtggagggtaatagaacgatggcaactatacttaaggcttgcgaaaagattgtcgagggcttggggtacgacacaagggatctgagtaagatcaccgcctccgaaaaagtgagccgcatcgaggagatttttgcgaaggaaggattcaagtctgactttctccacttcgattcaagtctgccaagcccggagtttgaatcccaggcctcttattcgctttggcatctgttgtacagctatgagaacgacaaatccgtatcaggcaatgaaagtctcgttgagaagatcaaaaagctgtgttctatggatgaggcaagcgctaaaattttatccggttgcactttcctgtcagactacgggagcctatctgcccgggctatgagaaagatactcccctatatgaaggatggcctggaatactccgccgcatgtgccatggctggatataggcacagtaaacgcagccttacaaaggaggaattggactctcgagtgtacgtcgatcggctggagctcctgcctaaaaactccttacgtaatccagtggtcgaaaagatcctgaaccagatgattaatgtggttaactcagtggtagacacctacggcaaacccgatgagatcagaatcgagatggcgagggaacttaagaagagtgcaagcgagcgcgaaaaagcccaaaaggacattgctgccgcatcgaaagtcaatgagtccatagtggccacgttgaaggggtctcctttcttcatcgacagcccatcacggaacgatattatcagatataggctctgggaggaactgaaacccaatggatacaagaccctatatagtggtacatacattccgaaggagcgactgttttccaaagacttcgatatcgaacatataatccctcaggctctcctgtttgacgattctttcgccaacaagactattgagagccgccagtgcaatatcgaaaaatccaaccggaccgcaatggactatgttaagtcaaaatacgatagcttcggcgtgcaggcgtatattgacagagtcaaggggcttacaggagtgagtaaaactaagatcaccaggttgctgatggagtctaaggatatacccgaggactttattaatcgtgaattacgcgattcccaatacatcgctcggaaagccagagagattctcgaaagcatggtaaagttcgtggttccaacaaccggctcggtcactgcaaggctgcgagaggactggcagcttgtgaacgtgatgcgggaactgaactgggataaatacgagaagttgggtctcacgtcatttcgcgaggacagagacgggagggaaatccctgtcatagaggattggacaaaacggaatgaccaccgacaccatgccatggatgctctgaccatcgccttcactagacgccagtttattcaatatctaaaccacctgaatgcaaagatcgacaccgttgataagacagacattgatctcagggactacaacctggaagatatctctttcgacggccttcgtgatggagacaaatttggcatagtgaaggctttgcagaaaaagtatctgtacaaagacgataagcagaagtatcggttcgtgcccccaatgcccttagacgagtttagaattgaagccaaaaggcagatcgaggatgtactcgtcagtttcaaggcgaaaaataaggtgtgtaccaaaaacgttaatactacaaaggtgcgcgggggacaacagcgaaagatccagctgacgcctagaggtccacttcatgaggacaccatttacggcaaacggctgcagtatgtcactaaggaagagaaagttgggggatcctttgatgaagccaagatcgctagcgtgtgcaaaaagtcttacagggaggcactaatgcgccgtctcatggagtgtggcggtgacccgaagaaagccttcacagggaagaacagcctggaaaagaatcccgtgtgggtagatgagtttcactccggcgaagtccctttgagagtgcggaccgtgtcaatggctagtgtctacacagttcgcaagagcgtgggacaatctctgaacattgagaaagtattagacaagcacataaaagaaatcctcagggcccgactggaggagtatggcgggaatgcatccaaggcgttctcaaaccttgatgaaaatccaatttggctgaacaaggagaaaggaatcgccgtgaagagagtcactattgacagtggcaaaaatcccatccctttgcggagcaagctcgataaagacggtcagataatctacggggaaggacagaacccacaggagtccgatttcgtggttcccggcggtaaccatcacgctgccatttataggaccccgtctggcaagctgcaagacgtggtcgtgtcgttttacgaagcagttagccgcaagaatctagggctggaggtgatcgacagaaacttcaaaaaggatgagggatgggaatttcttttcacgctcaaacagaatgagtattttgtcttccctaacccagctaccggcttttcacccgaagactacgatctgacagaccctgccaataacgcaattatctcccccaatttgtatagggtacagactgtgagtgttggggattaccggttccgtcatcacctggagaccacagtggaagacaacgagaagttacgcgatatagcctggaaacgaattggaccatctggcctcgtcggtgctgtgaaggtaagaatcgacaatctggggaggatccttgcggtgggagagtacgattga

SEQ ID NO: 3253 - RNA, 4179 nt, synthetic construct
  misc_feature 1..4179: note = Cas9 variant
  source 1..4179: mol_type = other RNA
atggagaacaagaattacagcatcggcctggacattgggaccaactccgtgggatgggccgtcataacagatgactataaagttccctctaagaaaatgaaggtgttcggtaatactgataaacactttatcaagaagaacctcattggcgcccttctgttcgacgaaggggcaacggccgaggatagaaggttgaaacggaccgcgcgccgacgttacacaagaaggaagaatcggttacgctatctgcaggaaatcttttcagaggaaattagtaaactagacagctccttctttcatagactcgatgactctttcctggtacctaaggataaaaggggatcgaagtacccaatctttgctactcttgaggaggaaaaggagtatcacaaaaagttcccgaccatataccatctgcggaaacacttggccgactcaaaggaaaagacagatctccgcctgatctatctggcactcgcccatatgattaagtaccgaggccactttttatacgaggagagcttcgacatcaaaaacaatgatattcaaaagatctttaacgagttcataagtatttatgacaatacctttgaaggttcctctctgagcgggcagaacgctcaggtggaagcaatcttcactgacaagatttccaaatcagccaagagagagagggtccttaaattgttcagtgatgaaaagagcacatctctgttttccgagttcctaaaactcatcgtgggaaatcaggctgactttaagaagcacttcgatctggaggaaaaagctccccttcaattttcaaaggacacctacgatgaggacctggaaaacttgctcggccagatcggcgatgggttcacggacctgtttttagttgcgaaaaagctgtatgatgcaattctccttagcggaatactgactgtgaccgaccctagtacaaaagccccattgtctgcttccatgatcgagcggtacgaaagccatcagaaggatctagccgcactgaagcagttcattaaaaataacctccccaagcgttataatgaggtcttttcggaccaatctaaagacggttacgctggctatatcgatgggaagactacccaggaggccttctacaaatacataaagaacctgctttccaagtttgaaggagcggactatttcctggataaaattgagcgcgaagactttttgagaaagcagaggacattcgataacggctcaatccctcaccagatccatctccaagagatgaatgccattctgcggcgacagggtgaacactacccattcttaaaagagaaccgcgagaagatcgagaaaattctgacctttagaataccctattacgtggggcctctagcaaggggaaatcgggacttcgcttggctcacgcgcaacagtgatcaggccatcagaccatggaattttgaagaaattgtagacaaggctagctccgccgaggagttcatcaacaaaatgactaattatgatctgtaccttccggaagagaaggttttgcccaagcactctctgctctatgaaacatttgcagtgtacaacgagctgaccaaagtcaagttcatcgccgaaggccttagggactaccaatttctggatagcggccagaaaaagcagattgtgaatcagttgttcaaagagaagcgtaaggtgactgagaaagacataatccattatctccacaacgtcgatgggtacgacggaattgaactgaagggtatcgagaaacaatttaatgcttcattaagtacatatcatgacctgctaaagattatcaaagataaggagttcatggacgatcctaagaacgaagaaatactcgagaatatcgttcacaccctgacgatttttgaggaccgggaaatgatcaaacagcgacttgcgcagtacgattccattttcgacgagaaggtgatcaaagcattgaccagaaggcattatacaggctgggggaagctgagcgccaaactcataaacggaatttgcgataagcagactggcgacaccatcctggattacttaattgacgatggtaagatcaatcgcaactttatgcaactgataaacgacgatgggctttctttcaaagaaatcattcagaaggctcaggtagtgggcaaaacagacgacgtcaaacaggtggttcaagagttgccaggatcacccgccatcaaaaagggcattctccagagtatcaaaatagtggatgaactggtcaaggtgatggggtatgcacctgagagcattgtaatcgagatggcccgggaaaatcagactaccgctagaggaaagaaaaactcccagcaaaggtacaagcgcatcgaggactctctgaaaaatctagccccaggtctcgattcgaacattctgaaggaaaatcccacagacaacatccagcttcagaatgatcgattgttcctgtactatttacaaaacggcaaagacatgtacaccgggaagccgctcgatattgaccagctgagctcctatgatatagaccacatcattcctcaggcatttatcaaggatgactcaattgacaatcgggttcttacgagttctaaagataaccgtggaaagagcgacaatgtgccctccctggaggtcgtgcagaaaagaaaggcgttctggcaacagttgctcgattcaaaactgatcagcgagaggaagtttaacaatctaactaaggctgaacgcggcggtctggacgagcgggataaagtcgggttcataagaaggcagctcgtggaaacacgacagatcaccaagcacgttgcccaaattctggacgcatcttttaacactgaggtgaatgagaaaaaccagaagatccgcaccgtaaaaattatcacacttaagtccaacttggtcagtaatttccggaaggaatttgagctgtacaaagtgagagaaataaacgattatcatcacgcccatgacgcttacttaaatgccgttgtggcaaaggctattctcaaaaagtatccaaaactggagcctgagttcgtctacggcgattaccagaagtatgaccttaagaggtacatcagccgttttaaaccctctaaggaaatcgaaaaagccaccgagaagtatttcttttactccaacctgctaaatttcttcaaagaggaagtgcactatgcggatggaattatagtaaagcgcgagaacatcgaatactcaaaagacactggcgagattgcctggaataaggaaaaggattttgctacaatcaaaaaggtgctcagttatccacaggttaacattgtcaaaaagacggagatccaaacccacgggctggaccggggaaaacccaagggtttgttcaatagcaacccttcgccaaagccgtccgaggactctaaagaaaatctggtgcccataaagcagggcttagatcctagaaaatacgggggatacgcaggcatcagcaactcatatgccgtgctcgtcaaggctattgttgagaaaggtgccaagaagcagcagaaaactatcctggaatttcaagggattagtatccttgacaagataaatttcgagaacaataaagagaactacctgttgaagaaaaggtatattgaaatcctctccacaatcaccctgccaaagtactctctatttgagttccccgatggcacacgacggcgcctggcaagcattctttccactaacaataagagaggagaaatccataaaggcaacgagctcgtgctgcctgggaagtataccacgttgctgtaccacgcgaaaaatataaacaagaaattagaaccagagcatctcgagtatgtggaaaagcacaggaatgactttgccaaactgcttgagtgtgtactgaacttcaatgataagtacgtcggagctttgaagaacggcgaacggattcgacaggcctttaccgactgggagacagtggatatcgaaaaactctgcttctcatttattggtcccgagaatagcaagaacgcagggctgttcgagctaaccagtcagggatctgcttccgactttgagttcctgggcgttaaaatcccgagataccgcgattatgcccctagctcgcttctcaaggcaactctgatacatcaatcaattacaggtttgtacgaaactaggatcgacttatctaaactgggcgaagattga

SEQ ID NO: 3254 - RNA, 4179 nt, synthetic construct
  misc_feature 1..4179: note = Cas9 variant
  source 1..4179: mol_type = other RNA
atgaacaataacaattacagcatcggcctggacattgggaccaactccgtgggatgggccgtcataacagatgactataaggttccctctaaaaagatgaaagtgctcggtaatactgataagcacttcatcaaaaagaaccttattggcgctctgttgtttgacgagggggcaacggccgaagatagaaggttcaagcggaccgcgcgccgacgttacacaagaaggaaaaatcggttacgctatctgcaggagatcttttcagaagagatgagtaaggtagacagctccttctttcatagactagatgactctttcctcgtgcctgaagataaaaggggatcgaagtacccaatttttgctactctggccgaggagaaagaatatcacaagaagttcccgaccatctaccatcttcggaaacacctggcagactcaaaggagaaaacagatttgcgcctcatatatctggccctggctcatatgatcaagtaccgaggccactttctctacgaagagagcttcgacattaaaaacaatgatatccaaaagatttttagtgagttcatctccatatatgacaacacctttgaaggttctagcttatccgggcagaatgcacaggtcgaggccattttcactgacaaaatctcaaagagtgctaagagagaaaggattctgaaacttttcgcctacgaaaagagcacagatttgttttctgaatttctgaaactaatcgtgggaaaccaggcggactttaagaaacacttcgatctcgaggagaaggcacccctgcaattttccaaggacacctatgatgaagaccttgagaatctgttgggccagatcggcgatgacttcgccgatctctttctggttgctaaaaagttatacgacgccattctgctctcagggatacttacggtgactgatagcagtaccaaagcacctctgtctgcttccatgatcgaacggtatgagaaccatcagaaggacttggccgcgctaaaacagttcattcaaaataacctgcaggaaaagtacgacgaggtctttagcgatcagtcgaaggacggatatgcccgttacatcaacggtaaaacaactcaggaggcattctacaagtatataaagaatctcctgtctaagtttgaaggctccgattacttccttgacaaaattgagcgcgaagattttctgagaaagcaaaggaccttcgacaacgggtcaatcccacaccagatccatttgcaggagatgaatgctattatccggcgacaaggagaacactatcccttcctcaaggagtacaaagagaagattgaaacaatactgacctttcgcatcccttattacgtgggcccattagccagaggtaacaggaatttcgcttggctgacgcggaacagtgatcaggccattcgcccctggaattttgaggaaatcgtagaccaggcaagctccgccgaggagttcatcaacaaaatgactaattatgatctatacctccctgaagagaaggttctgccaaaacactctcttttgtacgaaacatttgctgtgtataacgagctgaccaaggtcaaattcattagcgaagggctcagagactaccagtttctggattcaggacaaaagaagcagatagtgaatcagcttttcaaagagaagaggaaagtgactgagaaggacatcattcagtatctgcataacgtcgatggctacgacggcatcgaattgaaagggattgagaagcaatttaatgcgagtctctccacatatcacgacctgttaaagatcataaaagataaggagttcatggacgatccgaaaaacgaggaaatcctggagaatattgttcataccctaacgatctttgaggaccgtgaaatgattaagcagcggctcgcacagtacgccagcatcttcgataaaaaggtgataaaggctctgacccgaagacactatacaggatggggtaaactttctgccaagttgattaacggcatctgcgacaaaaagactgggaaaaccattctggattacctcatcgacgatggatactcaaacaggaattttatgcagctgataaacgacgatggcttaagtttcaaggacatcattcaaaaggcacaggtagtgggtaaaacaaatgatgtcaaacaggtggttcaggagctgcccgggagccctgccatcaaaaagggcattcttcaatccatcaaattggtggacgaactcgtcaaggtgatgggacatgctccagagtctatagtaattgaaatcgcccgcgagaaccagactaccgcacggggcaaaaagaactcgcagcaaagatataagaggatcgaggacgcgctgaaaaatctagctcccgggctggatagcaatattctcaaggaacaccctacagacaacatccagctgcagaatgatcgccttttcttgtactatctgcagaacggaaaagacatgtacaccggtgaggccttagatattaatcaactctcctcatatgacatagatcacatcgttccacaggcatttattaaggacgatagtctggacaaccgagtgcttacttctagcaaagataatcggggcaagtccgacaacgtcccctcactggaagtggtccagaagcgtaaagccttctggcagcaattgctcgacagcaagctgatctctgagcataaatttaataacctaacgaaggctgagagagggggactggatgaaagggacaaagtgggcttcattcgccggcagctcgttgagacaagacagatcaccaagcacgtggcccagatactggatgcaaggtttaacactgaagtaaatgagaaggacaaaaagaaccgaaccgtcaaaatcattacacttaagtccaatttggtgagtaacttccgcaaagaatttaagctgtacaaggttcgggagatcaatgattatcatcacgctcacgacgcctacttaaacgcggtggtcgccaaagctattctcaagaaatacccgaagctggagcctggtttcgtgtatggggattaccaaaaatatgacatcaagagatacataagcaggtctaaggatcccaaagaagtagagaaggcaaccgaaaaatatttcttctactccaatcttctgaactttttcaaggaggaagtgcattatgccgacggcactattgttaaacgtgagaatatcgagtactcaaaggatacaggagaaatcgcttggaacaaagagaaggacttcgccacgattaagaaagtcctaagtctcccacaggtgaatatagtgaagaaaaccgaaatccagactcacggcctggatcgcgggaagcctcggggattgtttaacagcaatccctcgccaaaaccctccgaggacagaaaggaaaacctggtccctattaagcaaggtttagacccaaggaaatacggcgggtatgcaggaatctctaatagctacgcggttctcgtgaaggccattatcgagaaaggcgctaagaaacagcagaagacagtgctggagttccagggtatatcaatccttgataagattaactttgagaaaaacaaggaaaattatctgttggaaaaagggtacatcaagattctcagtaccatcacactgccgaaatattccctattcgagtttcccgacggcactcgacggcgcctggcctctatacttagcaccaacaataagagaggagagattcataagggcaacgaactcgtaatccctgagaaatacacgaccctgttgtatcacgcaaagaatatcaacaaaacactggaaccagagcatttagaatacgtcgagaagcacaggaatgatttcgctaaactcctggagtacgtgcttaactttaatgacaagtatgttggggccctgaaaaacggagaacggattcgacaagcattcatcgattgggagactgtggacatagaaaagttgtgtttttccttcattggccccagaaattcaaagaacgccggtctctttgagctgaccagccaggggagtgcttctgatttcgaatttctaggagtcaaaatccctcgctacagggactatacaccatccagcctgcttaatgcgactctcattcaccagtcgatcaccggcctgtacgagacgcgtatagatttgtcaaagttaggtgaggactga

SEQ ID NO: 3255 - RNA, 4179 nt, synthetic construct
  misc_feature 1..4179: note = Cas9 variant
  source 1..4179: mol_type = other RNA
atgaagaactaccacatcggcctggacattgggaccagctccgtgggattcgccgctagagatgacgagaataacctcataagggtcaaaggtaagaatgttatcggcgcacggctttttgccgaagggaaaacagcgcaggagcgccgaatggctcgtacttctagaaggcggtataaccgcagaaagtggaggctgcggttgttaaatgatattttccatgacgaaatcgtgcacaaagataaggactttttcaaccgcctgaagcaatcaagtattagccccaaagatgaccgaaagaaatactttggatccctactcttccctgagctgtctgattcggaattttatcataatggcaaccagacgatctaccaccttagacataggctgatgacctcaaatgagaaggccgacatacgggagatctatttggcactccgtcacattgtaaaataccgcggtaacttcctggatgacacaccagtgagcagttttgaagcctccgatctgaagctcgggtctttcatcccgactttaaatgacctgtttgagaccattgacgtcaactatgtgttcaatagcgaaaacacaaatcagatcgagtccatacttttgaacaacgatctgagaaattcagacaagagtaaacagctagttgatctcctgtacaggaacgtgagcgacgtcgatgacaagtctcttgagaaacaatttaataagttccggaaagatatttccaaggaaatcgctaaatcattcgtgggaagcaagtttaacgtaaataagctgttggcatacgagaccgacgatggcagtaaaatttctctctccttcagcgacgcctcgtctgatgacaagatgctggaattagctgacaacctggatgacgagcgaatcaatatcctcaacgcccttaaagttatttattcccgcgtgagactgaatcagataatccccaacggcatggggttgtcagaaagtatgattgcgagctacgagctacacaagaaacagctgaatgatctcaagaagctgcttaacgtcctgccttttcatgagaaatatgcagtgaaggtggcctacgctgcctatatcggaaatatggacgcacagaaattcactcaagctgaattgtccacaatagagtctctcaaggaaaaagatagcattaagaaggtcatcgactgcaaaaccggtcacatcacgaacgagtcactgattagtgttatcaatcagattgtggtaaacccatacttagaaaactccgattttgagctgatagacatcgtgaagaaaattgatcaggacatcaagaatggcgagtatctactcaaacagaggaacaatcaaaacgggaatatcccccatcagctgcaccagatggaaatggatcaaattatagagaagcagagcaagtactaccctttccttggagaattgaacccaaatgagaaccggcgccacatcgccaaatataagatttctgaactggtcgcgtttagagtgccctactatgttggccctctcatcactccagaggagcaggccaaaacctcaggtgcaagtttcgcttggatgaagaggaaagaagacggggagattacaccgtggaattttgatcagaaggtggaccgtgaagccactgctagccggttcatcaaacgactgaccgtcaaggacacatacctttttaacgaggatgtgctgcccgacaattccttgctctatcaacagttcaaggtactgaacgagttaaatgttgtgaaagtcaacaataagagactgtctcaggccgaaaaacagggagcatttaacgatctattcaaggtgaccaaaacggtcactgccaagaggctcaagaactacctggtgtcgaatttcaaccatcttgacacaatagagatcaccggcttgagcgatggcgaaaaatttaataacgggctgacttcctatgttgacttccaaaagatttttggagataaaatcaataacctcgagctgatggacgatttcgaatcattaattgagtggagtacagtgtttgaggaccgccacatcttcgaagagaaggtacggaatgaaataaactggatttctgagagcgaactgaaacagcttgtcgctaagagatactccggttggggcaggttgtcaagcaagctcctggtggggatcaataacgatgagggacgcaatattatcgagcagctatttgaaacctctgagacgttcatggaagcgatatcccgacctgaggttaaaaagcagatcgacgaaattaacagtgattttatcaaaaataccgacattgagagcgtgctggcagacgcctacacatctccacaaaacaagaaagctatccgggagacttataagatagtcaaggatattcagaaagccatgggcggtaaggcacccgaatccatctcaatcgagttcacccgtaatcctgaagacaaaggggagctcacaagaagtaggcatagcgagatttcgcgcaagtacaaagaactgtccaaggagatctctaaagaacttaacgatgagttgaaaagcaagaaaaactcaatggacattgataagtattacctgtattttatgcagatgggcaaagacttatacgatggaaagagtatagacatcgatgacctcaataactatcagattgatcacatcgtgccacaatccttctacaaagacgactcttttgataatcgggtactgacttactataccaacaatcagaagaagggcaacaatacaccccttaacgggctgaatattagcaacgaaaccagaaaattgtggtcccatctccacgacctgggactaatctcaaagaggaaatacctgaatctcactatgcagggtctggatagccttagtaagtatacgaaacacggcttcatacgacgccaattggtggagacatctcaggttatcaagctggtcgccaacattttatccgacgagttcagcgctgataataccaagatcattgaagtgaaagccaagatgaactcgcagatgcggcattcatttaatctctacaaaatcagagagctgaacgactatcaccatgcacttgatgcgtacctgactaccttcatagggggatatctatacaataggtacccgaagctccgtggcatgtttgtgtatggtgacttcaaaaagtttgatgtcaacgacgctaacaatgttaagacactgaacttcttgcacgatattaccaatccttctgacaaatttgtgaaccagatctacgatgaacaaagtggggagctgatcttagaccgcaagcacgccattgaaactataaagaagatctatcagtacaaattcatgctcattacacgggaggtgtccacgaaggacgataagctgagcgaccagaccgtatattctgcaaaaagaatcaataacgtcgccagccccattccagtgaagaaagattccaatcctgagctttacggctttaggactggaaacgttgaccatcacatggtgatcgtcaagtatcccaaaaaggattcattcgtgtacaaagttgtgggcataccaatccgatttatgcaggaactgcggagtagcaagaatcaatctgagtacgaaaacacattgaatcagattgtacaggctaagctcaaccgcaaaaagttcgacttcagagtcgtggtggataatgtcatgtatgggcagctgatccaagacggaggtcagaaatttaccctaggctcctcaacatacaggtataacgccaagcagctggttcttgatatggacagtctccggattctgagcgatgagaaataccgaaattccttgactgacgatgaaaagaactctgagttcatcaacatatatcaacaggtgctgaatgtagtgaacgagaagtttgacgtcttcgacgtgagagggacccgcgataaattaacgaagggactcgacaaatttctgaatattacctcgaacgataaggaaatcgttcttctgaaaatcttgagcggcctccattgtaatgcagctagggtgaagattaacgagatcggtataaatacatcattcggggaactgcagactacccacggcattgtcctatccgagaacagttacatcatttatcagtctcccagcggactgtttgagcgtaaggtgcggcttaaagacctctga

SEQ ID NO: 3256 - RNA, 4179 nt, synthetic construct
  misc_feature 1..4179: note = Cas9 variant
  source 1..4179: mol_type = other RNA
atggccaacaagacctggtacctgggcctcgacatcgggagcgcttccgtgggatgggcagccacagatactggttataaaattataagaaagaataaaaagaggctttggggcgtccggctgttcgaggaagcgaaaacggctgaggaccgccgagggtaccgttcttcaagaaggcggttggcccgcagaaagtggaggttaaacctgctagaggagctctttaccagtgaagttaagaaagtggatgagaatttctttctgcggcttaaggagagccagtatcactacgaagacaaaacacataaggtaccctatgcaatcttcaacgataaagactacactgataaggactattacaaggattaccctaccatttatcatctgcgctccaaattgatgacagaggaaaatccagacatccgaaaggtgtttctcgccattcaccacatcataaagaacagaggacatttcctgctgcaaggccagtcttttaaggatggtaatctcaacaatttaatcaaagagctgcttgagttggacattctgcacgtcgggttcgaagtgaccgaggaagttgtggataagatcgctgacatttcgctagagaaaaagacttcaaaggacaaactcaacgatatcaaggaactgtacccgaaagagaagcagcttctggaggtctttaggttgatattcggaggcaaaacaagcctcgacaagctgtttgcaattgatgaatataaggagttagacgccgctatcaaaagtgtgtccttcaaggagaaaatttacgaagaagtacggcacgattatgagcaggttctgtctaattacatcgagctccttgacctggccaagttggtgtatgatagcatcattctatccgacattaaaaaggaaggcaagaccctgtcagagagtaaagtcgaactctttgagaagcatcgtgatgacctgcttaaactgaagaacttggtgaaaaatgatagcaagctctctgaagacaagaaagtggagctgtacgcgttaatcttcaaggaggacaaagataaggggacgaactacgtcaattatattcgcaaatccgaagagggaaagggttgcaactacgaagacttcaaaaagtttctggttaaggagctagcaaaactcgaggaatcaagcgtgaagactgagatcataaaagatctggaacttgagcaattcttgcccctgcagagaaccaaggacaacagtgtagtgccttatcagattcacaaagaggaactcgtcaagatcctggataatgccgctaggtaccattcttttcttaacgagaaggacgaatccggctataatgtgcgggagaaagttatccagctgttggagttccgaataccatactatgtggggcccctcaacagctcgaagaaagccaaggaaggaggctttgcatggtctgtccgcaatacaggttacgaaaacactcctgtgaccccatggaattactccaaagtaatcgatgagtcagctagtgccgagaagttcattacaaacctgaccaataagtgtacgtatttaaaaggggaagacgttctgcccaagagctccctactctactctgagtttgcgctgcttaacgaattgaatgccctgaaatatgatggaaacagaataagcctcgaggcaaggaatactatcattgaaaagctgttcaaacaacagggcaagaaggtgacaaaaacctcaatcaagaacttactgaaagctgagggctacatcgacgggaagggagagattactggtatagatatcacagtcaaaaatgaccttaagagttatcgggattttaaaaagattttgggcaacaagttcaactccgaacacgtggagaatatcattctctggatcaccctgtacggggaaagccgcaaactaataaaggccaaaatcgagtctgtctatggagaggtgtactcaaaggacgaaattacgaaaatgagtagactggtttacaaggactggggcaggtttagccgtaagctcctgaccgagcttgtgtccaaaaagttgtataacgaagagacaggtgaatgcctgaatatcattggggctatgcggcagaacaatatcttattcatggagctcctggccgatcgatttgactactctaaacagatagtagagttcaacaaggaacttcaagaggatgtcactgaaattgcacctgagatcctggacgatttgtatgtgtcgccagccgttaaaagaagcatttggcagaccgtgaggatcgtcgaggaactcaagaagataatcggctgtgctccggcgaaaattttcgtggagacaactcgctccaatcaggaaaagaaaaagcccaccgactcacggaaaaagcaactggagctagcatacaaggccgttaaaaaggatgtgaaagaactggagaaggaaatcggaacaattaactttgacgttctcaatgatagactgagttctgtcgagcctagcaaacttaaggctaagaaattgtatctgtactatacccagttagggaggtgcatgtactccgaggaaccaatcaacatatcagaactcttcgacaataacaagtacgatattgaccacatctatccccagagcaaaatcaaggatgactcttttactaatacggtgctggtgaaacgcgaatccaacgccgcaaagacagaccgataccctcttggcagtgatattcagaccccaagcaatcggcgtttctggaaatttctgaaggagaagggactaatctctgacgagaaatataacagactcgtcaggactgaagagttctccgatgaggaactgtcaggttttattgcccgccaattggttgaaaccagtcagagcgtgaaggctgtggcctcgatactgggcgagttaaaccccgagacatccatctgttactctaaagcagaaaatgtaagctcattccggcagaactttgggaagattaaaaagggagacagagatagtaagaataacgaccagctcatcaaagtcagggagattaatgattatcatcacgcgaaggacgcttacctgaacgtggttgtgggcaatgtctatgataccaaattcactcgaaacgtgtttaatttcatcaaggacaaaaaggatggtcgcaagtactcccttaacaaagtattttacgaaaatgtgtctgacagcaagacagtagcctgggagatggacaaaacgatacatcaagtcgaaaaggtgatgaacaataacaatatcatggtgacccggagaacttccgagcagaaagggggcctgttcgatgcaacagtctataaggccaaggttgctgccaaagcaaaggacggagtgtactatccgttgaaaacctcaaacagcgtagtgaaggatgtcgctaaatacggcgggtatacaagtattggaatcgcctactattctattttcgagtacactatcgtgaacaagaaaggtgaagagaagataaccaggattatccctatccccatttacatatcccagaatatcaaggacagcacggcgctcattgaatttggcaaatcgcagatcttctgccgtgcctatgagaagattaaagattttaagctgctataccgcaaactgtgtatcgggtcaaagataaacatcaataactatcaatactatattggaggcaagtctgacgaacggttctactatgatagtgctatccaggttacccttgacaaaaagtccgagaaatacctcaagattctgagcaaataccagaattggaagaaggagaacaaagatggtgaattgtgggagaatatcacaaaggaaaacaatatagagctgtataacaaattagtggagaagatgaactctgaaatttttactaaaaagaaaagcaataaatacaatgagctcaactccgaagagatcagaaataacttcatcaagatttcagtcgaggaacaggcaaaagtgctgcttgagatcctgaatttgctcaccaacaagaaaagtatatttgacctaaagagcattgatatcaaagccgctagggggaagatttctttcaacctgacatccctgatccaattttcaataattgaacagagtatcactggcttctatgagaaggaaatcaccattatcggagacaaaggcaatgatatggagaacaataacagctga

SEQ ID NO: 3257 - RNA, 4179 nt, synthetic construct
  misc_feature 1..4179: note = Cas9 variant
  source 1..4179: mol_type = other RNA
atgaacaataacaattacagcatcggcctggacattgggaccaactccgtgggatgggccgtcataacagatgactataaggttccctctaaaaagatgaaagtgctcggtaatactgataagcacttcatcaaaaagaaccttattggcgctctgttgtttgacgaggggacgaccgcagaagatagaaggttaaagcggacagcccgccgacgttacactagaaggaaaaatcggctgcgctatctacaggagatcttctcacctgaaattagtaaggtagacagctcctttttccatagactcgatgactcttttctggtgccagaggataaaaggggatcgaagtacccgatcttcgcgacccttgctgaagagaaagagtatcacaagaactttcccacaatataccatctgcggaagcaattggccgactcaaaagaaaaggcagatctccgcctgatctatctggccctcgctcacatgattaaataccgaggccatttcttatacgaggagagctttgacatcaagaataacgatattcagaaaatcttcaatgaatttataagtatttatgacaacaccttcgagggttcctctctgagcgggcagaatgcacaggtcgaagccatctttactgacaagatttccaaatcagctaagagagagagggtgcttaagttgttccctgatgaaaaatcaacaggactgttcagcgagtttctaaagctcatcgttggcaaccaagccgagttcaaaaagcactttgacctggaagagaaagcgccacttcagttctctaaggatacctacgacgatgacctggaaaatttgctcggccagatcggggatggatttgcagagctgttcgtggccgctaagaaattatatgacgccattctgctctccggtatacttacggtcactgatccctcaaccaaggcacctctgagcgctagtatgatcgaacggtacgagaaccaccagaaagacttggccgcgctaaagcaatttattcagaacaatctgcaggaaaaatatgatgaggtgttctctgaccagtccaaggacggctacgccgggtatatcaacggaaagacaactcaagaggcattttacaaatacataaagaatctcctgagcaaattcgaaggctcggattattttcttgacaagattgagcgtgaagatttcctgaaaaagcagcgcacctttgacaacggttctatcccacatcagatccacttgcaagagatgaatgctattatcagaaggcagggggaacattaccccttcctccaggagaacaaggagaaaattaagaaaatactgacattccggatcccttattacgtaggaccattagcccgaggcaatggcgattttgcttggctgacccgcaactccgaccaggccattagaccgtggaatttcgaagagatcgttgatcaagcatcaagtgccgaagactttatcaacaagatgacgaattatgatctatacctccccgaggagaaagtgctgcctaagcacagccttttgtatgaaactttcgctgtctacaacgagctgacaaaagtgaagtttattgcggaagggctcagggactaccagttcctggattccggacagaagaaacagatagtgaatcaactttttaaggagaaacggaaggtcaccgaaaaagacatcactcagtatctgcacaacgttgatggttacgacggcattgagttgaaggggatcgagaagcagttcaatgcatctctcagcacatatcatgacctgttaaaaattatcaaggataaagcctttatggacgatgctgaaaacgaggccaccctggaaaacataatccacacgctaaccattttcgaggaccgcgaaatgatcaagcagagactcgcacaatacgattcactgtttgacgagaaagtgattaaggcccttatcaggcgtcattatacaggatggggcaagttgagtgctaaactgataaatggtatttgcgataagaaaactgggaagaccatcctcgactacctgattgatgacggctattccaaccggaatttcatgcagttaatcaacgatgacggactgagctttaaagatataatccagaaggcccaggtagtgggccgaacaaatgacgtcaagcaaattgtgcacgagcttccagggtctcccgcaatcaaaaagggaattttgcagtcaatcaaaatagttgacgaactcgtgaagattatgggtcatactcctgagagtatcgtcatcgaaatggcgagagagaaccagaccacagctaggggcaaaaagaatagccaacagcgctacaaacggattgaagatgccctgaagaacctagcaccagggctggactccaatatcctcaaggagtaccccaccgataacattcagctgcagaatgacagacttttcttgtattacctgcaaaacggaaaagatatgtatactggcgagccgttagacataaatcagctctcttcgtacgatatcgaccacattgtgcctcaggccttcatcaaggatgacagcctggataacagggtacttacgtcctcaaaagacaatcgcggtaagagtgacaacgttccctctctggaagtggtccagaaacgaaaggctttttggcaacagttgctcgatagcaagctgatttccgagcggaaattcaacaatctaacaaaggccgaacgtgggggcctggacgagagagataaagtgggatttatcaggcgccagctcgtcgagacccggcagataactaagcacgtggcacaaatcctggacgctagattcaacaccgaagttacagagaaagataagaagaataggaacgtgaaaattatcacccttaagtcaaatttggtaagcaactttcgaaaagagttcaagctgtataaagtccgcgaaattaatgactaccatcacgcccatgatgcgtatttaaacgccgtggttgctaaggcaatcctcaagaaatacccaaagctggaacctgagtttgtgtacggcgactatcagaaatacgatcttaagcggtatatatctagatccaaagaccccaaggatgtcgagaaggccactgaaaaatacttcttttatagtaatctgctaaacttctttaaggaggaagtgcactacgctgacgggacaattgtaaaaagggagaatatcgaatatagcaaggatacgggagagatcgcctggaacaaagagaaggacttcgcaaccattaaaaaggtgctctctctgccacaggttaatatagtcaagaaaactgaaatccaaacacacggtttggaccgtggcaagccccgcgggctgttcaactccaatccttcaccaaaaccgagtgaggatagcaaggaaaacttagtgcccattaaacagggactcgaccctcggaagtacggcggttacgcggggatctcgaactcctatgccgtgctggtcaaggctattatcgagaaaggcgccaagaaacagcagaagaccgttcttgaatttcaaggaatatctatcctggataaaattaatttcgagaagaacaaggagaattacttgctcgaaaaaggctatatcaagattctgagcacaatcactctaccaaaatactcactgtttgagttccccgacgggaccagaaggcgacttgcaagtatactctccacgaacaataagcggggagaaattcataaaggcaacgagctggtgatctctgagaagtataccacattgctgtaccacgctaagaatatcaacaaaactttagaacctgagcatctcgaatatgtggagaagcaccgcaatgattttgccaaactgcttgaaagcgtactggacttcaacgataagtacgtcggtgcattgaaaaatggggagagaattaggcaggcctttatcgactgggagaccgtggatatagaaaagctctgtttctcctttattggaccacggaacagtaaaaatgctggcctgttcgagctaacaagccagggtagtgcgtctgactttgagttcctgggcgttaagatcccccgatacagagattatactccgtccagccttctcaacgccaccctgattcatcagtcgatcacggggttgtacgaaacacgcatagacttatcaaagctgggagaagattga

SEQ ID NO: 3258 - RNA, 4179 nt, synthetic construct
  misc_feature 1..4179: note = Cas9 variant
  source 1..4179: mol_type = other RNA
atgaacaataacaattacagcatcggcctggacattgggaccaactccgtgggatgggccgtcataacagatgactataaggttccctctaaaaagatgaaagtgctcggtaatactgataagcacttcatcaaaaagaaccttattggcgctctgttgtttgacgagggggcaacggccgaagatagaaggttcaagcggaccgcgcgccgacgttacacaagaaggaaaaatcggttacgctatctgcaggagatcttttcagaagagatgagtaaggtagacagctccttctttcatagactagatgactctttcctcgtgcctgaagataaaaggggatcgaagtacccaatttttgctactctggccgaggagaaagaatatcacaagaagttcccgaccatctaccatcttcggaaacacctggcagactcaaaggagaaaacagatttgcgcctcatatatctggccctggctcatatgatcaagtaccgaggccactttctctacgaagagagcttcgacattaaaaacaatgatatccaaaagatttttagtgagttcatctccatatatgacaacacctttgaaggttctagcttatccgggcagaatgcacaggtcgaggccattttcactgacaaaatctcaaagagtgctaagagagaaaggattctgaaacttttcgcctacgaaaagagcacagatttgttttctgaatttctgaaactaatcgtgggaaaccaggcggactttaagaaacacttcgatctcgaggagaaggcacccctgcaattttccaaggacacctatgatgaagaccttgagaatctgttgggccagatcggcgatgacttcgccgatctctttctggttgctaaaaagttatacgacgccattctgctctcagggatacttacggtgactgatagcagtaccaaagcacctctgtctgcttccatgatcgaacggtatgagaaccatcagaaggacttggccgcgctaaaacagttcattcaaaataacctgcaggaaaagtacgacgaggtctttagcgatcagtcgaaggacggatatgcccgttacatcaacggtaaaacaactcaggaggcattctacaagtatataaagaatctcctgtctaagtttgaaggctccgattacttccttgacaaaattgagcgcgaagattttctgagaaagcaaaggaccttcgacaacgggtcaatcccacaccagatccatttgcaggagatgaatgctattatccggcgacaaggagaacactatcccttcctcaaggagtacaaagagaagattgaaacaatactgacctttcgcatcccttattacgtgggcccattagccagaggtaacaggaatttcgcttggctgacgcggaacagtgatcaggccattcgcccctggaattttgaggaaatcgtagaccaggcaagctccgccgaggagttcatcaacaaaatgactaattatgatctatacctccctgaagagaaggttctgccaaaacactctcttttgtacgaaacatttgctgtgtataacgagctgaccaaggtcaaattcattagcgaagggctcagagactaccagtttctggattcaggacaaaagaagcagatagtgaatcagcttttcaaagagaagaggaaagtgactgagaaggacatcattcagtatctgcataacgtcgatggctacgacggcatcgaattgaaagggattgagaagcaatttaatgcgagtctctccacatatcacgacctgttaaagatcataaaagataaggaatttatggacgatccgaaaaacgaggaaatcctggagaatattgttcataccctaacgatcttcgaggaccgtgaaatgattaagcagcggctcgcacagtacgccagcatcttcgataaaaaggtgataaaggctctgacccgaagacactatacaggatggggtaaactttctgccaagttgattaacggcatctgcgacaaaaagactgggaaaaccattctggattacctcatcgacgatggatactcaaacaggaattttatgcagctgataaacgacgatggcttaagtttcaaggacatcattcaaaaggcacaggtagtgggtaaaacaaatgatgtcaaacaggtggttcaggagctgcccgggagccctgccatcaaaaagggcattcttcaatccatcaaattggtggacgaactcgtcaaggtgatgggacatgctccagagtctatagtaattgaaatcgcccgcgagaaccagactaccgcacggggcaaaaagaactcgcagcaaagatataagaggatcgaggacgcgctgaaaaatctagctcccgggctggatagcaatattctcaaggaacaccctacagacaacatccagctgcagaatgatcgccttttcttgtactatctgcagaacggaaaagacatgtacaccggtgaggccttagatattaatcaactctcctcatatgacatagatcacatcgttccacaggcatttattaaggacgatagtctggacaaccgagtgcttacttctagcaaagataatcggggcaagtccgacaacgtcccctcactggaagtggtccagaagcgtaaagccttctggcagcaattgctcgacagcaagctgatctctgagcataaatttaataacctaacgaaggctgagagagggggactggatgaaagggacaaagtgggcttcattcgccggcagctcgttgagacaagacagatcaccaagcacgtggcccagatactggatgcaaggtttaacactgaagtaaatgagaaggacaaaaagaaccgaaccgtcaaaatcattacacttaagtccaatttggtgagtaacttccgcaaagaatttaagctgtacaaggttcgggagatcaatgattatcatcacgctcacgacgcctacttaaacgcggtggtcgccaaagctattctcaagaaatacccgaagctggagcctgaatttgtgtatggtgattaccaaaaatatgacatcaagagatacataagcaggtctaaggatcccaaagaggtagaaaaggcaaccgagaaatatttcttctactccaatcttctgaacttcttcaaggaagaggtgcattatgccgacgggactattgttaaacgtgagaatatcgaatactcaaaggatacaggcgagatcgcttggaacaaagaaaaggacttcgccacgattaagaaagtcctaagtctcccacaggtgaatatagtgaagaaaaccgagatccagactcacggactggatcgcggcaagcctcgggggttgtttaacagcaatccctcgccaaaaccctccgaagacagaaaggagaacctggtccctattaagcaaggattagacccaaggaaatacggtggctatgcagggatctctaatagctacgcggttctcgtgaaggccattatcgagaaaggagctaagaaacagcagaagacagtgctggagttccagggcatatcaatccttgataagattaactttgagaaaaacaaggaaaattatctgttggagaaaggttacatcaagattctcagtaccatcacactgccgaaatattccctattcgagtttcccgacgggactcgacggcgcctggcctctatacttagcaccaacaataagagaggcgaaattcataagggaaacgagctcgtaatccctgaaaaatacacgaccctgttgtatcacgcaaagaatatcaacaaaacactggagccagaacatttagagtacgtcgagaagcacaggaatgatttcgctaaactcctggaatacgtgcttaactttaatgacaagtatgttggcgccctgaaaaacggggagcggattcgacaagcattcatcgattgggaaactgtggacatagagaagttgtgtttttccttcattggacccagaaattcaaagaacgccggcctctttgaactgaccagccagggtagtgcttctgatttcgagtttctaggggtcaaaatccctcgctacagggactatacaccatccagcctgcttaatgcgactctcattcaccagtcgatcaccggactgtacgagacgcgtatagatttgtcaaagttaggcgaagactga

SEQ ID NO: 3259 - RNA, 4182 nt, synthetic construct
  misc_feature 1..4182: note = Cas9 variant
  source 1..4182: mol_type = other RNA
atgaagagagtgaccgaagactacatcctgggcctcgatattgggacaaacagctgcggatgggccgtcactgacaaaaagaataaccttctgaaattgaggggtaagacggctataggctcccacttattcgaagaggggcataccgcagccgatcggcgcggatttcgaacaactcgtagaaggctgaaacggcgcaagtggagactaaggctcctggaagagatcttcgcggaacccatggctaaggttgaccctggctttttcgtgcggcttcaccagtcttgggtatcaccactggataaaagtcgcaagaaatatcatgccattgtgtttccgaccgcaaaggaggacaaagccttctaccaaaagtatcccacaatctaccacttgcgagatgctctcatgacccaggacagacagtttgatctgagggagattttcctggcaatccatcacatagtcaagtttcggggtaatttcctccaggacactcctgtgaaagattttgaagccagcaagatcgaggttgggccaattttatccaaaatcaacggagctttcgccgaaaagattgtggaggaccaagatcccatcgagctgaatgtcgcgaacgcagccgaaatagaggctgtgattcgtggcaaagacgccgacaagacactttataaaatggataaggtaaagaaaatcgcaaagttgctgaccgactctacggctaaagaagagaagaatgttgccaaacagattgcgaacgccgtgatgggctacaagactcagtttgaaaccatcctagggaaggagatcgataaatcggacaaggcacagtgggagttcaaactcacagatggagacgctgatgacaagctggaagcccttctgcctgatttggacgagaatgatcaaactattatagctgaaatcaaaaagctattctcagccattaccctgagcacaatcgtcgacgagaacaagagtttatcccagtctatggtggcaaaatataataagcaccatcaggactacaaactgctcaaggcctacatagatacccttcaggaccgcagcattgctaaaaagctgttgctagcgtatgatctgtacgtgaacaatagacacggtaggctcctggaagcaaagacggagtttaaacaagacggcactcttacaaaggaggatttctataaaaccgtcaaggacaacctggatgactccgaattggcccggaaaatcgctcagaagatcgccgcagataattttatgccaaaacagcgaactaactcaaacggggttattcccttccaactccatcagatcgagctggacaagattatagccaatcagagtaagtactatcctttcttagctgccgaaaacccagtggaggatcaccgcaaacaggcaccgtacaagctggacgaactcgtaagattcagggtgccctattacgtcggacctatgatcacaccagatgagcaagagaaaaccagcggcaagtcttttgcgtggatggtgcggaaagaagacggtcagattacgccctggaatttcgagcagaaggttgaccgccaggaatccgctaacaagtttatcaaaagaatgaccatcaaggatacatacctcctgggggaggacgtgcttcctgccaattcattgctgtatcaaaggttcgaggtcctcaacgaactgaataacattcgtataaatggaagccggatcagtattgatcttaaacagcagatctttaacgacctgttcgaggaaaagaaaactgtgaccgagaagtctttgacatcctacctcaagcagaatctgcacttaccaactgtagaaattaaaggcctggcagatcccaccaagtttaacagctcgctagcctcttattaccatctcaaatccctgcacgttttcgacaaggagcttgctgatccgcaatatcagaaagacttcgagaagatcatagaatactcaagtatctttgaggataagaaaatttatcaggacaagttgcatgccgaatttaaatggctgacacctgagcagtttaaggcaatcagcacctggcgactccaaggctgggggagactgtcctgtaggttactggtggaacttcacgatactaatggacagaacattatggagcagttgtgggactctcagaaaaatttcatgcaaatcgtcacggagcccgattttaaggacgctatagccaaagaaaaccagaacgtgacacaggtcaatggtgtggaggaaattctcgcggacgcctacaccagcccagctaacaagaaggcaatccgccaagttgtgaaagtagtcgccgatgtggttaaggctgccggcgggaaaaagcctgcacagttcgcgattgagtttactcgggaccccgataaaaatccacagctgtcacatatcagaggaaccaagctactgaaggcctaccaggaaacagctggcgagctcgtggaccaaaaactgaccgatagtcttaaggaggccatgacttccaggaaattgctgaaggacaaatatttcttatactttatgcagacaggtcgcgatgcatatacggggaagaagataaacatcgacgaagtcaccactaattaccagattgatcacatcctcccccagagcttcattaaagacgattcttttgacaaccgagtgctgacagctacccctcttaatgccgagaagtcagacgatgtaccatataaacggttcgcaaacaattacgtgagtgacctgaagatgacagttggcgaaatgtggaaacactggcaaaaggccggaatcataaacaagcataaattgggcaatctcctgctagatccggaccgtctgaacaagtttcagaaaagcgggttcattaatagacagctcgtcgagacttcccaaatcgtgaagctggtgtctgtcatccttcagaacaaatatcccgatgctgagattatcaccgttaaggcgggagacaattcggccttgaggcagcgcctgaacttatacaagagccgggatgtgaacgactaccaccatgcaattgatgcttatctctccataatctgcggtaatttcctgtaccaggtgtatcctaaatacagaccatattttgtatacggcaagtataaaaagttctcacaagaccccgatcttcagaaagacctgattaagcactttaaagggttcacgtttatgtggcctctactccagaaggataacagtgaaaggaaggccccagaggaaatcaaagagaataactctgaacgaattgtcttctacaagcaccccgacatctttgacaaactgcgcaaggcctacaattataaatacatgttggtgagccgggagaccacaactgagtcctcaagcatgttcaagatgaccatatttccgagaggagaaagggatcgtaagaaaacacgcaagctgatccctaaaggcaacggtttagacccaaagatttatgggggctactctggaaatactgatgcttatatggttatcgtgaaaattgacaaggcaaaggagtccatctacaaagtcataggcgtgcccatgcgggccctcaccagactgaaccaggcgaagaaacaagggaattatcaggaggaacttcatcaggttctggaacctcagattatgttggataagaacggaaaacccaagaggggtgtgaagggcttccgagtaatcaaagaccacgtcccatttaagcaagtggtgctcgatggggacaaaaagttcatgctgtacagtgctcagtacaaaacgaatgccaagcagctagcactgagccaggagacaatgcggatcgtcaccgataaccttaaaaagggagaggaccaagataagctcctggttaaagcctatgacgaaattttgcagaaggtggattgttacctgtctttattcgacacttccaattttcgcaacggcctccatctgggtagaaataaattcatagaccttgaggtaaacgataagaaaatcacactgtcaaacattttgaatgggctccacgacaacatggtgctgggcaatctaaagaacatcggaattggcacccctctggggcagatgcaagaaaagagtggaatcactcttagccccgaggctgtcctcatatttcagtcgccaaccggcctgttcgagaaaagggtgaagatcgcagatttgtga

SEQ ID NO: 3260 - RNA, 4188 nt, synthetic construct
  misc_feature 1..4188: note = Cas9 variant
  source 1..4188: mol_type = other RNA
atgaagaaagaaatcaaggactacttcctgggcctcgatgtggggaccggaagcgtcggttgggccgttacagacactgattataaacttctgaaggctaacagaaaagacttgtggggcatgaggtgctttgaaacggcagagaccgccgaagtgcggcgcttacaccgaggggcgcgtagaaggattgagcggcgcaagaagagaataaaactgctacaggaactcttctcccaagagatcgctaagattgatgagggatttttccagaggatgaaagaatctcccttttacgccgaggacaagacaatcctgcaggaaaatgcacttttcaacgataaagactttactgataagacctatcataaggcctaccctacaattaatcacctgatcaaggcttggatagagaacaaggtaaaaccagacccgcggttgctctatctggcatgtcataatatcattaagaaacgcggccacttcctgtttgagggtgatttcgactcagaaaaccagtttgataccagtatccaagccctcttcgagtacttacgagaagacatggaggtggacattgatgctgacagccagaaggtcaaagaaatcctgaaggattcctctcttaaaaattcggagaaacagtcaagattgaacaagatactggggctaaaacccagcgacaagcagaaaaaggccattactaatctcatcagtggaaacaagattaattttgcggatctgtatgacaaccctgatcttaaagacgcagagaaaaattccatctctttcagcaaagatgacttcgatgccctgtccgacgacttggcttcaatcctcggcgatagttttgaactgttactgaaggccaaagcagtgtacaactgcagcgttctctctaaggtgattggcgacgagcaatacctttccttcgctaaggtcaaaatatatgaaaagcataaaacagatctgaccaagttgaaagccgtgatcaagaagcactttccaaataactacaaaaaggtattcgggtataaccaggacaatgagtcaaagaacaattacagcggatatgttggtgtgtgtaagacgaaaaacaagaaactggtcattaataacagtgtgaatcaggaagatttttacaagttcctgaagcccatcctctctgcgaaatccgagataaaggaggtgaacgacattctggccgaaatcgagactggcaattttcttcctaaacagatcagcaagtcgaacgcagaaattccatatcaactgaggaaaatggagttggaaaagatcctctctaatgctgagaagcacttctcctttctgaaacagaaggatgagaaagggttatcacatagtgaaaagattataatgctgctaaccttcaaaatcccctactacattggacctatcaacgacaatcacaaaaagagctttccagatcggtgctgggtcgttaaaaaggagaaatccccgtctggcaagacaactccctggaacttctttgaccatatcgataaagaaaagaccgccgaggagttcattacaagccgtaccaatttctgtacgtatctcataggtgaatcagtgctgcctaagaacagtcttttgtactccgagtatactgtactgaacgaaatcaataacctccagattatcattgacgggaaaaatatctgcgatacaaagctgaaacaaaagatatacgaggacctttttaaaaagtataaaaagatcacccagaagcagattagcactttcatcaaacacgaaggaatttgtaacaagacagacgaggtgatcatactgggcattgataaagagtgcacctcttcattgaagagttacatcgaactcaaaaatatttttggcaagcaggtcgacgagatcagcacgaagaacatgctggaagagataatccgctgggctaccatttatgatgaaggggagggaaaaacaatcttaaagactaaaattaaggccgagtacggtaaatactgttccgacgaacaaatcaagaagatactgaatctaaaattctctggctgggggagactctcgaggaagtttctggagaccgtgacaagcgaaatgccaggattctccgagcccgttaacattatcactgcaatgcgggaaacccagaataaccttatggagttgctgtcaagtgagtttaaattcacagaaaatatcaagaaaattaactctggctttgaggatgccgaaaagcagttcagctatgacggtctcgtgaagcctctgtttttatccccatcagtcaaaaagatgctgtggcagacccttaaattggtgaaggagatcagccacattactcaagctcccccgaaaaagatattcatcgagatggcgaagggggcagaactcgagcctgcccgaacgaaaacacgcctgaagattctacaggatctgtactcttcctgcaaaaatgacgctgatgcctttagtagcgaaatccagtatctctctggcaagattgagaacgaagacaatctgagacttaggtccgataaattgtacctgtattacacccagttaggaaagtgtatgtattgcggcaaacccatcgagatagggcatgtattcgacacttcaaactacgatatcgaccacatttacccacaaagtaagatcaaggacgatagcatttcgaaccgggttctcgtgtgctcctcttgtaataaaaacaaggaggacaaatatcctctaaagagcgaaatccagtcaaaacagcgcggattctggaattttcttcagagaaacaatttcataagtctggagaagttgaacaggctcacccgtacaacccccatttccgatgacgaaactgcaaagtttatcgcccggcaactggtcgagacacgacaggctacgaaagtggccgcaaaggtcctagaaaagatgttcccagagaccaagatcgtgtactctaaagcggagactgttagcatgtttagaaataagttcgatattataaagtgcagggaaatcaacgactttcatcacgctcatgatgcctatctgaatattgtggtaggtaacgtctacaatacaaaattcaccaacaatccctggaactttatcaaggagaaacgcgacaatcctaagattgcagatacatataactactataaagtgttcgactacgatgttaagcggaacaatatcactgcctgggaaaagggcaaaaccataatcacggtgaaggacatgctcaaaagaaacaccccaatttacacaaggcaggctgcctgtaagaaagggggactgtttgaccaaactatcatgaagaaaggccttggtcagcacccgttgaagaaggaggggcccttctccaatatttcaaaatatggcggatacaacaaggtcagcgcagcttattacaccctgatcgaatatgaggagaaaggcaataagatacgcagtttagaaacaattcctctctacctggtgaaagatatccagaaggaccaggatgtacttaagtcttatctgactgacctactcgggaaaaaggagttcaaaatcctggtgccaaagattaaaatcaactccttgctgaagataaatggatttccctgccacattaccggtaagacgaacgatagcttcttactccgacctgccgttcaattttgttgctcgaatgacgaagtcctgtacttcaaaaagatcattcggttttcagagatccgttctcagagagagaaaataggcaagacaattagtccatacgaagatctttccttcaggagctatatcaaagagaacctgtgtaagaagaccaaaaatgacgaaatcggggagaaggaattttacgatttgctccagaaaaagaacctggagatttatgacatgctactgactaaacataaggatacaatctacaaaaagcgccccaattctgcgaccattgacatacttgtgaagggaaaagagaagttcaaaagcctcatcattgaaaaccagtttgaggtgatcctggaaatcttgaagctgttctccgccactcggaatgtctcagagttacaacacattggcggtagtaaatatagcggggttgctaagataggcaacaagatctcttccctcgataattgcattctgatctaccagtcaattaccggaatctttgagaaaagaatagaccttctgaaggtgtga

SEQ ID NO: 3261 - RNA, 4188 nt, synthetic construct
  misc_feature 1..4188: note = Cas9 variant
  source 1..4188: mol_type = other RNA
atgaagaaagagatcaaggactacttcctgggcctcgatgtggggaccggaagcgtcggttgggccgttacagacactgattataaacttctgaaggctaacagaaaagacttgtggggcatgaggtgctttgaaacggcagagaccgccgaagtgcggcgcttacaccgaggggcgcgtagaaggattgagcggcgcaagaagagaataaaactgctacaggaactcttctcccaagagatcgctaagattgatgagggatttttccagaggatgaaagaatctcccttttacgccgaggacaagacaatcctgcaggaaaatactcttttcaacgataaagactttaccgataagacatatcataaggcataccctaccattaatcacctgatcaaagcctggatagagaacaaggtaaaaccagacccgcggttgctctatctggcttgtcataatatcattaagaaacgcggccacttcctgtttgagggtgatttcgactcagaaaaccagtttgatacttcgatccaagcactcttcgagtacttacgagaagacatggaggtggacattgatgccgacagccagaaggtcaaagaaatcctgaaggattcctctcttaagaatagtgagaaacagtcaagattgaacaagatactggggctaaaacccagcgacaagcagaaaaaggctattacaaatctcatcagtggaaacaagattaattttgccgatctgtatgacaaccctgatcttaaagacgcggagaaaaattccatctctttcagcaaagatgacttcgatgcactgtccgacgacttggcctcaatcctcggcgatagttttgaactgttactgaaggctaaagccgtgtacaactgcagcgttctctctaaggtgattggcgacgagcaatacctttccttcgcaaaggtcaaaatatatgaaaagcataaaaccgatctgacgaagttgaaaaatgtgatcaagaagcactttccaaaagactacaagaaagtattcgggtataacaagaacgagaaaaataacaataactactcaggatatgttggtgtgtgtaagactaaaagcaagaagctaattatcaataacagtgtcaatcaggaagatttttacaaattcctgaagaccatactctctgctaaatccgagattaaggaggtgaacgacatcctgacagaaatcgagactggcacctttcttcccaaacagattagcaagtcgaatgccgaaatcccttatcagctgaggaagatggagttggaaaagattctctctaacgcggagaagcacttctcctttctgaaacaaaaggatgagaaagggttatcacatagtgaaaagataatcatgctgctaacattcaagattccatactacatcggacccatcaatgacaaccacaaaaagagctttcctgatcggtgctgggtgattaaaaaggagaaatccccatctggcaagaccacgccgtggaatttctttgaccatatagataaggacaaaactgccgaagcattcatcacaagccgtaccaacttctgtacttatctcgtcggtgagtcagttctgcccaagagttcccttttgtacagcgagtatacagtgctgaatgaaattaacaacctccagatcattatcgatgggaaaaatatatgcgacatcaagctgaaacagaagatttacgaggaactttttaaaaagtataagaaaatcacccaaaagcagatttctacgttcatcaaacacgagggaatatgtaacaagaccgacgaagtaattatcctgggcattgataaagagtgcacatcaagtctcaagagctacatcgagttgaagaatatatttggcaaacaggtggacgaaatctccactaagaacatgctggaggaaattatccgctgggctaccatttatgatgagggggaaggaaaaacaatcttaaagactaaaataaaggccgagtacggtaagtactgttctgacgagcagattaaaaagatcctgaatctaaaattctcgggctgggggagactcagcaggaagtttctggaaaccgtcacatccgagatgcctggattctcagaaccagtgaacatcattaccgctatgcgggagactcaaaataaccttatggaattgctgagttctgagtttaaattcacggagaatatcaagaagattaacagcggctttgaagatgccgagaaacagttctcctataatggtctcgttaagcccctgtttttatcacctagcgtgaaaaagatgctgtggcagacacttaaattggtcaaggaaatatctcacatcacccaggcaccacccaagaaaattttcatcgagatggccaagggggctgagctcgaaccggcgcgaactaaaacccgcctgaagattctacaagacctgtacaacaattgcaaaaacgatgcagacgccttttccagtgagatcaaggatctcagcggcaaaatagaaaatgaggacaacctgagacttaggtctgataagttgtatctgtactatacacagttaggaaagtgtatgtactgcggcaaacctatcgaaattgggcatgtgttcgacacctccaactatgatatcgaccacatttacccccagtcaaagatcaaagacgatagtataagcaatcgggtactcgtttgctcgtcctgtaacaagaataaagaggacaagtacccactgaagtctgagattcagagcaaacaacgcggattctggaactttcttcagagaaataacttcatctcactggaaaagttgaataggctcactcgtacaacgcctatcagtgatgacgagaccgctaaatttattgcccggcagctggtggaaactcgacaggcaacaaaggtcgccgctaaagtgctagagaagatgttccccgaaaccaagatagtctattccaaagccgagacagtgtctatgtttagaaacaagttcgatatcattaaatgcagggagatcaatgactttcatcacgcacatgatgcgtacctgaacattgttgtgggtaatgtatataacactaagttcaccaataacccatggaattttatcaaagaaaagcgcgacaaccccaagatagctgatacgtacaactattacaaagtcttcgactatgatgtgaagcggaataacatcaccgcctgggagaaaggcaagacaattatcactgttaaagacatgctcaagagaaatacccctatttacacaaggcaagcagcctgtaaaaagggagggctgtttgaccagactatcatgaagaaaggccttggtcagcacccattgaagaaagaaggggctttcagcaacatatccaagtacggcggatataataaagtgtcagccgcatactataccctgattgagtacgaagagaagggcaacaagatccgcagcttagagacgatcccgctctatctggtcaaagatattcaaaaggaccaggatgtgcttaaaagttacctgacagacctactcgggaagaaagaaatcaagatactggtacccaagattaaaatcaattctttgctgaagattaacggattcccttgccacatcaccggtaaaactggcgattcctttgtgttacgaccagctgttcagttctgttgcagcaatgacgaggtcctctattttaagaaaataattcggttcaacgaaatccgttcgcagagagagaagatggggaagacaatctcaccctacgaggatctgtcttttaggagttacattaaagaaaatctttgtaagaaaaccaaggccgacgagatcggagaaaaagagttctatgatctgttgcaaaagaaaaacctcgaaatttacgacatgctgctaactaagcataaggataccatatataataaacgccctaactccacaacgctgggcatgcttaccaagggtcggtacgagtttatcaatctcaaaccaaaggaccagattatcgtgatgctggagatcttgaaactgttctgcactacaagagaagcgattgatttagggctcataaagggcaagcccgccgctggagtggcaaccctgggcaaaaagatcagcaacccggacaattgtattcttatctatcagtctattacagggatctttgagaaaaggatagacctgttgaaggtctga

SEQ ID NO: 3262 - RNA, 4188 nt, synthetic construct
  misc_feature 1..4188: note = Cas9 variant
  source 1..4188: mol_type = other RNA
atgggggacaccgtgaagaactaccacatcgggctggatattggaacaagctccgtcggtttcgccgctagagacgatgacaataacctcataagggttaaaggcaagaatgtgatcgggactcggctattttctgagggacagacggcacaagaacgccgaatggcccgtgcgtcaagaaggcggtataaccgcagaaaatggaggctgcggttgttagatgagattttccatgacgaaatcattcacaaggatgctgagtttttcaatcgcctgaaacagagtagcctatcccccaaggacgaacgaaagcagtactttggctctctcctgttccctgaggtaggtgattcggagtattaccatgacgggaaccagaccatctatcaccttagacataggctgatgacacaagatgaaaaagccgacatacgggagatctacttggcactccgtcacattatcaagtatcgcggaaattttctggatgacactccagtgagctcattcgaagccagtgacctgaaactcgcttcctttgtcccgaccttaaacgatctgttcgagacaattgacgtgaattacgagttttctatggataacatcaatgaaatagaggacattcttttgaacaataagctgagaaacagcgataaatccaagcagctacccgacctcctgaccgaacctatcgttaatattgatgacaagtcacttgagaaacagttcaacaaggaaaggactgatatcagtaaagagatcgcaaagagcgtggtcggctctaaaatgaacgtgaataagctgttgtcctttgagtcaagcggcgggtacaaaattgccttcagtttctctgacgcttccagcgaagataagatgatggagctctcggacgtactggacgattctcggatgaacatattaaatatcctgaaggttatttattcccgagtgcgcctcaaccagatcataccatcaggaatgggtcttagtgaaagcatggtcgccgcgtacgacctgcacaaacaacagttgaaggatcttaaaaagctgctcaatgtgctgccctttaacgagagatatgcagtgaaaattgcctacgctgcctatatcggcaatatcgacaagcagaagttcacaaaatccgaagtcaagaccattgataaacttaaggagaaatctgcaatcatgaacgttctggactttaagagcgggcatattacgaatgaggaattgtcaaacgtgataaaggtagtgatcgtcgataaatacctcaatgacgagaacttcgaatatcacagtattgtggagaagatcaatcaggatatctccaacggaagctacctgttaaaacaaaggaataaccagaacggcaatattcctcatcagctgcaccaaatggaactagaccagataatcgagaaccagtctaagtactatccatttctcggtgagctgaatcccaactcaaatcggaaccacattgctaaatacaagatcagtgaacttgttgccttccgcgtgccttattacgtcgggccattgattactccggaggaacaggagaagaccagcggagcgtcctttgcctggatgaaaagaaaggaggatggcgcaatcacaccctggaatttcgaagagaaagtggacaaggaagagactgcttctaggtttataaaacgtctgaccgtaaaggatacatatctcctgaacgaagacgttcttcctgacaattcgctgttgtacgagaaattcaaggtgctcaacgagctgaatgtcgtgaaggccaacaataaacggttaaccgtcgaagagaagcaaggcgcttttgataacctgttcaaaaagatgaaaacggtgactgccaagaagttgaaaaattatctcgttagcaaccataaccacatcaattccgtggaaattacagggctgtcagacgtagataagtttaacaatagtctttctacctacatcgacttcaaaaagattttcgatgacaaaatcgataacccagacttgctggatgactttgaggatataattgaatggagcactgtcttcgaggaccgaaagatctttgaggaaaaggtgagaaaagatatttcctggatctcagagagcgaaataaaggcagttgtgtctaaaaggtactccggatggggtcgcctcagtaagaaactgttaaatggcatcacaaacaatgaggggcggaacattatcgacgaactgtgggaggagagcgaaaccttcatggaggccgtctctaagcccgaagtgaaggagcagattgacggaatcaattccgattttataaagaacacggacattgagtcagtacttgctgatgcgtataccagtcctcagaataagaaagcaatcagagaaacacataagttggtgaaagacatccagaaggccatgggcggtcaagctccagccagcatttcgatcgagttcactaggaacccccaggataaagggcagctcacccgctcccgacactctgaagttagccggaagtacaaggagatttcaaaagaagtcagtaagacactgaatgacgagctaaaatccaagaaaaactctatggatgtggacaagtattacctgtattttatgcagatgggcatagatctctacgacggaagctccatcgatattgacgacctgaataactatcaaatcgatcatattatcccgcagtcattctacaaggacgatagctttgacaaccgtgtgcttactcactacagtaataaccagaaaaagggcaataacacccctttgaatgggctgaacatagatgacaaaacaagagcaatctggaatcacttaagggatctcggactgattaccaagaaaaagtataacggtcttactctgaagggcatggaccagttgtctaaatacacgaagcatgggttcatccgccggcaactcgtcgagacatcccaggttattaaactggtggccaatatcctaagcgatgaattttcgaccgacgatactaagataattgaggtgaaagctaagatgaactcacagatcagacaagtattcaatctgtataaggtcagggaactcaacgactaccaccatgccgtggatgcatatctgaccacatttatcggaggctacctttataatcgataccccaacttgcgcaatatgttcgtttacggtgacttcaaaaagttttctgcggacgtggataacctgaaaaccttcaactttttacacgacattactaatccaagtgataagttcgaggaccggatatttgatgaaaaatccggggagctcatcctggacagaaagcacgctattgagacaatcaagaaaatttatcagtacaagtatatgcttatcacgagggaagtcagcaccaaaaacggccagctgtctgatcagactgtgtacagcgccaagcgtataaataacgttaaagcacctatccccgtgaagaaagactccaatccagagctatatggattccgcacaggcaacgtagatcatcacatggtcattgtgaagtaccccaagaaagactcatatgattacaaggtggtcgggatccctctccggtttgttcaaaaactgaaggaaaccaaagacaataaggattacgagaacttgctgaatcagattgtgcagatgaagttaaacaggaaaaagcaggacttcatcgtagtggtcgacaatgtgatgtatggacaactcatacaggatggtggcgaaaaatacacactggggagtagcacttataagtacaacgccaaacagcttgttattaatatggacaagaccagaatcctggaggataaccgatatctaaattctctcgacgagggagaagtgtccgagaagctggtcaacatctacaatgatattatgaaagtggttaactcacggtttgacctattcgatatcaacaagtttcgcgaaaaactgaatgacggccttaacaagttcaaaaatataagtaacgagcagaaggaggaaacgctcctgaagattttgagcggtctgcattgcgggtccgctaatgtgccaatcaaagagttaggcctcaccacaccgctgggaaaacttcaactgccctctggcattgtcttgtcggaagaggccgtagtgatctatcagagcccttcaggcctcttcgaaaacaaagttagactgaaggatctatga

SEQ ID NO: 3263 - RNA, 4188 nt, synthetic construct
  misc_feature 1..4188: note = Cas9 variant
  source 1..4188: mol_type = other RNA
atgaagaaagagatcaaggactacttcctgggcctcgatgtggggaccggaagcgtcggttgggccgttacagacactgattataaacttctgaaggctaacagaaaagacttgtggggcatgaggtgctttgaaacggcagagaccgccgaagtgcggcgcttacaccgaggggcgcgtagaaggattgagcggcgcaagaagagaataaaactgctacaggaactcttctcccaagagatcgctaagacagatgagggatttttccagaggatgaaagaatctcccttttacgccgaggacaagactattctgcaggaaaatacccttttcaacgataaagactttgcagataagacatatcataaggcctaccctaccatcaatcacctgattaaggcttggatcgagaacaaggtaaaaccagacccgcggttgctctatctggcatgtcataatataatcaagaaacgcggccacttcctgtttgagggtgatttcgactcagaaaaccagtttgatacaagtattcaagccctcttcgagtacttacgagaagacatggaggtggacatcgatgctgacagccagaaggtcaaagaaattctgaaggattcctctcttaaaaattcggagaaacagtcaagattgaacaagatcctggggctaaaacccagcgacaagcagaaaaaggccataactaatctcattagtggaaacaagatcaattttgcggatctgtatgacaaccctgatcttaaagacgcagagaaaaattccatttctttcagcaaagatgacttcgatgccctgtccgacgacttggcttcaatcctcggcgatagttttgaactgttactgaaggccaaagcagtgtacaactgcagcgttctctctaaggtgatcggcgacgagcaatacctttccttcgctaaggtcaaaatttatgaaaagcataaaaccgatctgacgaagttgaaaaatgtgataaagaagcactttccaaaagactacaagaaagtattcgggtataacaagaacgagaaaaataacaataactactcaggatatgttggtgtgtgtaagactaaaagcaagaagctaatcattaataacagtgtcaatcaggaagatttttacaaattcctgaagaccatcctctctgccaaatccgagataaaggaggtgaacgacattctgacagaaatcgagactggcacctttcttcccaaacagatcagcaagtcgaatgcggaaattccttatcagctgaggaagatggagttggagaaaatcctctctaacgccgaaaagcacttctcctttctgaaacaaaaggatgagaaagggttatcacatagtgaaaagattataatgctgctaacattcaagatcccatactacattggacccatcaatgacaaccacaaaaagtttttccctgatcggtgctgggtggtcaaaaaggagaaaagcccatccggcaagaccacgccgtggaactttttcgaccatatcgataaggaaaagactgcagaggctttcattacatctcgtaccaatttttgtacttatctcgttggtgagagcgtgctgcccaagtcaagtcttttgtactccgaatatacagtactgaatgagataaacaacctccagatcattatcgacgggaaaaatatttgcgatatcaagctgaaacagaagatatacgaagaccttttcaaaaagtataagaaaatcacccaaaagcagattagcacgtttatcaaacacgagggaatttgtaacaagaccgacgaagtgatcatactgggcattgataaagagtgcacatcttcattgaagagttacatcgagctcaagaatattttcggcaaacaggtcgacgaaatcagcactaagaacatgctggaggaaataatccgctgggccaccatttatgatgagggggaaggaaaaacaatcttaaagactaaaattaaggctgagtacggtaagtactgttccgacgagcagatcaaaaagatactgaatctaaaattttctggctgggggagactctcgaggaagttcctggaaaccgtgacaagcgagatgcctggattttccgaaccagttaacattatcaccgccatgcgggagactcaaaataaccttatggaattgctgtcaagtgagttcacgtttacagagaatatcaaaaagattaactctggcttcgaagatgcagagaagcagtttagctatgacggtctcgtgaaacccctgttcttatccccttcagtcaagaaaatgctgtggcagacccttaagttggtgaaagaaatcagccacattactcaggccccacccaagaagatatttatcgagatggctaaaggggcggagctcgaaccggcacgaaccaagacacgcctgaaaattctacaagatctgtacaataactgcaagaatgacgccgatgctttctcttccgagatcaaagacctcagtggcaagattgaaaacgaggataatctgagacttaggagcgacaaattgtatctgtactatacccagttaggaaagtgtatgtactgcggcaagcctatcgaaatagggcatgtattcgatacttctaactatgacatcgaccacatttacccccagtccaaaatcaaggatgactcaattagtaaccgggttctcgtgtgcagctcgtgtaataaaaacaaggaggataaatacccactgaagtccgagatccagtctaagcaacgcggattttggaatttccttcagagaaacaattttataagcctggaaaaattgaacaggctcacacgtgccacgcctatttcagacgatgagaccgcaaagttcatcgcccggcagctggtcgaaactcgacaggctacaaaagtggccgcaaaggtcctagagaaaatgtttcccgaaaccaagatcgtgtatagtaaggcggagacagtttccatgttcagaaataaatttgacattgtgaagtgcagggagataaacgatttccatcacgctcatgacgcctacctgaatatcgtagtcggtaacgtgtataatactaaatttaccaacaatccatggaacttcattaaggaaaaacgcgataatcccaagatcgcagacacgtacaactattacaaggtttttgattatgacgtgaaacggaacaatattaccgcctgggagaagggcaaaacaatcataactgtcaaggacatgctcaaaagaaacacccctatctacacaaggcaagctgcctgtaagaaaggggaactgttcaatcagactattatgaagaagggacttggccagcacccattgaaaaaggagggtccgttctctaacatcagcaaatacgggggctataataaggtgtccgcagcttactataccctgattgaatacgaggagaaaggaaacaagatccgctcattagaaacgatacccctctatctggtaaaggatattcaaaaagaccaggatgtgcttaagagctacctgacagacctactcggcaaaaaggagtttaaaatcctggttcctaagatcaagattaatagtttgctgaaaatcaacgggttcccatgccacataaccggaaagactaatgattcctttttactccgacccgccgtccagttctgttgctctaacaatgaagtgctgtattttaaaaagattatccggttcagcgagattcgttcgcagagagagaaaatcggtaagacaatatcaccttacgaagacctttcttttaggagttacattaaggagaacctgtggaaaaagaccaaaaatgatgaaatcggcgagaaggagttctatgacttgctccagaaaaagaacctggaaatctacgatatgctactgactaaacataaggacaccatttataagaaacgcccaaattccgcgacaatcgatattcttgtgaaggggaaagagaagtttaaaagcctcataatcgaaaaccaattcgaggtcattctggaaatcttgaagctgttttctgccacgcggaatgttagcgacttacagcacatcggaggctccaagtactcaggtgtggctaaaattgggaacaagataagtagcctcgataactgtatcctgatttatcagtctatcaccggcattttcgagaaaagaatcgaccttctgaaggtgtga

SEQ ID NO: 3264 - RNA, 4188 nt, synthetic construct
  misc_feature 1..4188: note = Cas9 variant
  source 1..4188: mol_type = other RNA
atgaacgccaatagagagatggcttactatatcggcattgacatggggaccggaagcgtgggtatggcaataacagatgaaaactacaatctgctcaaggtcaaaggccaggactattggttcgttagggagtttgaaactgccaacacgcaaatcaagcggcgcatgcaccgaatttccaaacgtagacttaggcggcatcaggtgcgcgtagcgctgatcagatcttacttcgctgaggaaattttgaagaatgatcccttatttttcatcaggcaggacaactcaatatattacctggaggataaagacagtgtgctaaagaccaaggattgcctctttgccgactataattaccacgataaaaactactataaggactaccctacaatcttccatctgcggcaggcatttattaaagatactgtcaaggacgatgagaatcacacccgctatgcccgacttctgtacttggctatcattaacatgttcgaacatagagggcactttctcctgaatagcgtgtccgaggacatcaacaaagaaatggttaaggacgcaggagagggcttcacactgtatctccaagagaggataaaggaaattaaaccagtgtcttactcggatatcttagacgtcctggtggagaagaatatttcacggagcgaaaagaaggagcgtatcgtagaactttttggtatcaaaaagagttgtaaaaacgggatggagattataaagtgcttgtgtggactggaggccaatgttgctatcatgttcaacctagatgacattgaaaacaagctcaccatcgtggtctccaaagatgactatgaggataagctggccgaagtgcagccgcttgtggacgaggaatcttttgagctgttgagccgcataaaacagctctacgattactcccagctgcaatcaattttaaagggctataaagagaaggaagacggcgaggataagtacctgagtgacgtcagagttgaactctatgagaaacacaaggcggaccttaaactgttgaagaaagtgtacaagagggatctagacaagaaagggaagatctgcgaaggaaagaatatccagcggagctctaagtataacttcatgttccgatccggtaaagatggcacttactcagcatatacaaatagcctgaacagtttttgttctaagaccattgagaataagtaccgcagaaacatgaaaaatagggaccgggcctccctctacgatacgatcaagaaagacctgagcgggattgagaacgatgacgtaaagaaaatacttcgcgatatcgaaactgagaagttcctgcccaaacagattaccggagaaaatggcgtgatccctaaccagatccatgctaaggagttgaaggccattctcaaaaatgcagagaagcatctgccatttttaacagaaaaagacgattcgggtctgactgtctctgagagaataatctccctattcaggtattgcattccctactatatcgggcctgtgggaaaggactcacgtaccggctgggctagtattaaagaagagggccaaatctttccatggaacatagaacagaagatcgatgttgacaagacaagcgaggagttcattacccggctcatcaaaacgtgtacttacctgtccaatgaaaaggtggtccccaaacagtctcttgtgtatgagcgatactgcgtattgaacgaaattaataacatcaagataagagggaaaaggattgaccctcaactgaagcaggagatctttaaggaactctatattggaagcaaatgtggtaagaaagttacacgcaagaacctgtgccagtaccttgtgaataaaggcgccatcgaggaggattcagaaataagtgggatcgacaaggatctgaacacctacatgtccagctatggaaagatgtaccagattttcggcgacaaaatcaagcgggatgacattaaagaggtcgcggaagagatcatatattacggtactatttatgggggcgccaaggaaatgtttaaaaagaaaatcgagcaatacgtgtctgaggatatcttggacgaagcacagatgaataggattctcggattcaagtttaaggattgggctagactgagtaaaaagttcttatatctggagggctacgacaaagggaaccagaatcagctaacaaccctcatgcaagccctgtgggattacaaccttaatacgatggaattgatgaactcaccaatgtttaccttcaaggagacactggagaaacagaagaataagatggaaaaagtcctctgtgacttcgagtatgaagatctggacgagtactattttagcgctccggtgaagcgcatggtttggcagactatcgcctgcttaaaagaagtggtacagattatgggacacaaccccaagcgaatattcatcgagatgcctcgggcagacgaggaaaaaggtgagcaaggccgtaaggcctccagaaagaataggctgctttctttgtacgaagagattgaagatgagcgcccatggaaaaaggagatcgaaaacgctgcggagtcggggcggctcaatagcaaaagaatgtatctgtactatctacagatgggaaaggacgcatacaccggcgaagatattgacatcgaggatctgtttgacaactccaaatacgatatagaccacatctatcccaggtcactcacagatgacaatagtctggaaaacaaccttgtcttggtgtctgccactattaatcaggatgttaagaagaacgactaccctatcccatatgacaaaattcgaggtaatagcaaggtgcgcgagctgtggcggttcttacacgagaaaaagtttatgaacgatgaaaaatacaatagactcatgtccgacgtccccctgacccaggagcaacttgctgggtatatcgccaggcagctggtggaaacagcacagggcaccaagggaatagccgatattatcaagtcagtaatcccggacgctgatattatatacagcaaagccaagaacgtgtctgacttccgtaaacgctatggcatgttgaagtcccggctcactaatgattttcatcacgcaaaagacgcgtacctgaacgttgtcgtggggaatgtgtacttcacgaagtttacacaaaaccctagaaaatatatcaaggatgagaatgacattgagaacaagaaatacaattataacctaagtaagatgtacgataaagacgtcatcaggaatggaaaggttgcttggattgcccagaacggtaaaaaggcaggcaccatccagactataaagaaagtgatggatcgaaacacccccatcattacacggcaggccttcgaacaacgcggggagctgtatgacctccagccaatcagcaagcataaagctaagaaagaaaattacgtgcctattaaggccaccaacgagaagatgaaagacgtaactaagtatggaggctttacatctctgaatcccgcatacttcgtctttgtggaatacggttccgctaaaaagagacagaggtgcttcgccgttgtgcactcatattgggcgagtagcatcaaaaacaatgaggatcttgtcacgcatttgaaggaccgggggtacgagaacccaatagtgattgccgataagatcaaaaagaactcgctgatcaaatataatggctacttcttatatattgttggaatggacgctcgaaaacaggtggaattttccaatgcaacctctatgtgtctcaacaataacttcatccaatacatacagaaaattgagaaggccaatactctgatcgctgaagccaaaaagagacgcccctatattgatgagagcatcacagcagaaaggaacatagcgctttacaatgagctgaagaaaaagcacctagactcaatttttaaaaaccaccctaagggcatcgggagtgtactcgagtccggagaaggcgccttcgtccagctgtctttggagcagcaaatcggtattctgtacagcatcattcagttttcctcattcaaaaaggggacctttagcttaacactcataggaggcccaaaggaagtgggtcgtatccggattagtggcaatatgccgaaagctagagagctgaaacttatccattattctatcactgggatgtacaaaaaggaaattaacctgttggattga

SEQ ID NO: 3265 - RNA, 4188 nt, synthetic construct
  misc_feature 1..4188: note = Cas9 variant
  source 1..4188: mol_type = other RNA
atggagacccaggccagcaaccaactgatctcctctcacctcaagggctaccccattaaagactatttcgtggggcttgatataggaacatcaagtgtcggttgggctgttactaataaggcatacgaactgttgaaatttagaagccataagatgtggggctccaggttattcgacgagggggaatctgccgtggcgcggcgcggatttcgatcgatgcgtagaaggctggagcggcgcaaactaagactcaagctgcttgaagaactgttcgctgatgccatggcacaggtagaccctacgtttttcatgaggttgcgggagtcaaagtatcactacgaagataaaaccacaggccatagcagtaagcacatcctctttattgacaaaaactatactgatcaggactactataaggagtacccaaccatctaccatctgcgcgtggccctgatgaaatccggtacagatgacattcgaaaactcttcttagctgtccaccacatcctgaagtatagagggaattttctttacgaaggagcaaccttcgattctaacgccagcactttggacgatgtgctgaaacaggctctagagaatataacatttaactgcttcgactcctcagccgcgatcggcagtattggccaaatcctcatggagctggggaagaccaaaagcgacaaggcaaaagccattgaaaggcttgttgatacgtatatcataactgacgaggtggatacctctggaaagacacagaaagaacaggtcaaggaggacaagaaacggctgaagtcctttgctaatttggtgctcggtctgtcagccagcttaactgatctgttcggcagtgtagaagacctcgatgaggaccttaaaaagctgcagattatcggggatacctacgacgagcgtcgcgatgacttggcaaaagtttggggagacgaaattcatatcatcgatgactgtaagtctgtgtatgatgctattatactaatgtccatcaaggagccgggcctgacaattagcgaatcgaaagtcaaggccttcaaaaagcacaaagacgatctcgcgatcctgaagtctcttctgaagtccgacagatcaatatacaacaccatgtttaaagtggatgagaagggtttgcataattatgtgcactacattaaacaagggaggacggaagagacttcatgcaaccgggaggacttctacaagtatacaaagaaggtcgttgaaggactccccgatagcaaggacaaagagtacatcctgtccgaaatcgagttacagaccctgctacctctccagcgaattaaggataatggcgtgatcccatatcagctgcaccttgaagagttgaaagtaattctggccaagtgtggccccaaatttcctttcctcaacgaggtggcagacgggttttctgtcgctgaaaagctgataaaaatgcttgagttccgcatcccatactatgtgggacccctgaatactcatcacaacgttgataatggtggctttgcctgggctgtgagaaaggccagcgggagggtcacaccttggaacttcgacgacaagattgatcgggaaaaatcagcagccgcttttatcaagaacttgaccaataaatgcacgtacctcctgggagaggacgtgttaccaaagagttccctgctatatagcgagttcatgctcctgaacgaacttaataacgtacgcatcgatggcaaaccgttggagaaggcggttaaggaacatctgattgaggcagtgtttaaacaagaccacaagaaaatgaccaagaatagaatagaacagttcctcaaagataacaattacatccccgagaagcataagcctgagattacaggtctggacggggaaatcaaaaacgatttagcctcttacagggacatggtccgtattctgggcaataactttgatctttcaatggctgaggaaatcataactgacatcaccattttcggagagagtaagaaaatgttgcgggaaacactccgaaataagttcagctccagactggatgacgaggccatcaaaaagctatctaagctgaggtatcgcgattggggccggctctcgagaaaactgcttaacgtgattgaggggtgtgacaaggcaggagacggtactccagaaaccatcataattttgatgaggaattttagctacaacctgatggagttactcggcgataaattctcctttatggaacgcatccaggagattaatgccaagctgatcgaagggcaaatagtcaacccccacgacatcattgatgaccttgctctgagtcctgccgtgaaacgagcagtttggcaggcgttgcggatcgtggatgagattgtacacatcaagaaaacactcccagctcgtatattcgtcgaggtgaccagaagtaacaaggccgaaaagaaaaagaaagactctaggcagaagcgcctgagcgatctatatgcagccattaaaaaggacgatgctctgctctccggactgactaatgaggaatttggcggtcttaagtcagggttggccaaatacgacgatgcagctctgcggagcaagaaattatatctctactatacgcagatgggcagatgcgcctacacaggagaggttatcgacctgtctcaacttaacaccgacaattacgatatcgaccatatttatcccaggtccctgactaaggatgacagtttcgataacctagtgctctgtaaacgaaccgcgaatgcccaaaagagcgacacatacccgatctctaaggagattcagaaagctcagaaggcattttggatattcctgaaacagcagggcttgatctccgaacgcaagtatgagcggctgaccagaattactcctttaacagccgatgacctctcagggtttatcgctaggcagctggtcgaaacgaaccagagtgtgaaagccgcaaccactcttctgcgtcgcttgtaccccggagtagatgtggttttcgtcaaggcggagaatgtgacagactttcggcacgataacgacttcattaaggtgagaagcctcaatcatcaccaccatgccaaagatgcttatctgaacatcgtcgttggtaatgtgtaccacgaaaggtttacccgaaacttccgggccttctttaagaaaaatggcgcaaaccgcacatataatctagctaagatgttcaactacgacgtgaaatgcactaacgccaaggacgggaaggcatgggccgtaaaaacctcgatggatacggtcaagaaaatgatggactccaatgatgtgagagttaccaagagggtgtacgagcaaaaaggacagctgtctgacataaaccttacaaaggctagcaaagtcaaggcggatatctatctcccaattaaggccaatgaccctatcatgtcacagaacatgaaatacggcggttatagtgatattaagaatgcatactatactatcatagagtactccgacaaaaagaacaattctattaaggcttttatccccatcccaattttcatagccaccaagacactgactaagcaggccttgctggaatatatcaaaaccgtgttacccaaggctaacaatctccggattatctacaaaaaggtttacaacgatcaactgcttaaaattgacgggtttaattattacctgggcggacgaagcaacgatagattctgtatcgacaatgcaatacagttgatcgtgcctctcgagattcagttttatatcaagctggtagaaaagttcacggccattatctccgagaacaaaaatatagcgctaaaggcttcaagcgtcaaaagtcgcaacccaattaacaatcaagtggaaaacatcacactggagtacacccagaaactttttgattatctcgtgtctaaattcaatgagctgatctacttgaagatgaggggcaacaagttaactgacgtcaataacattgggcgtaaacagtttatcaagctgtccctcgaggagcggtgcaaagccctggcagaacttctgaatatattcacaaacatgaataagaaattgagcctatcgaccattaacgtttcagcctctagaaaggtggtaaatttcaaaatcagttccctggacgagtttaagattgtgaacgaaagcatcactggactctattctcatgagataaccattgtctga

SEQ ID NO: 3266 - RNA, 4188 nt, synthetic construct
  misc_feature 1..4188: note = Cas9 variant
  source 1..4188: mol_type = other RNA
atgaacctgagaaataccacagacgagtacaacatcggcctcgatatggggactaatagcgtgggatgggccgtcacggacaaggttggtgctattgcacacttcaaaggcatgcccacccttgggtccaggctgtttgatgccgcgcagacagctgccgaagcacgggcccatcgcggacaacgacgtagatatgtgaggcggcgctggagattggacttactgcagtctctattccaggatgagatagacaaggtagattcagaatttttcatcaggctccggcagagtcgcctgcacgtggaggaccgagaagatggccatgctgactacaaatggcctatttttaacgatagcgacttcactgaggtcgattattacaagagatttccaaccatctatcaccttaggaaatggctgattgagacagaccaaaaggcagacatccggttgatatacctcgccgtgcataatatcgttaagcaccgtggtaacttcctgcgcgaaaataacaaaaatctgtcctctagaaacgctgatccggccgaggcggtggggcacctcaggttagcactgaataactggtgccttgaacggggatatgagtgtgcctggaagtcgggcggcaatgacaacgctattttgaatgtcctgatcgatggggagaaacgacgctcagaccaggtgagagaaattgccaagctaaccggaatcgattgcggtgacgcaaaacagagcaggcagtgtaacgaggctatagccaaggcgattgtaggcctcaaggccgaaatgaaaaacatctttggggagttccccgcagaaaagactctgatttaccttagttccgatgacgatgttgaggtggtccgggacgcttgccctgatgactctgtggagctgtttcaagccttgtgtgaactctacgctgcctatatcctgcagggattactgagctacgcaccaggccagacaatctccgtgaatatggtcaaaaagtatgaccgctacggtgaggatctccatcttctgaaagaattgaccagaacgtatgcctcaaagaggtacgacgctttctttcgtggggagacttatgaaggaagtagcgattacgttgtggacaaagcgcagggctacacccggtataacctaggcacaactcaactgtcttacgatgacttccagaaggcagtaaaggaactcttcaaagggaccgatgccctgcaggacgagcgatatcaaggaatgatggtggcttttggtgaacagagattccttaggcgcctgaagacatccgataatggctcaatttactatcagttgcacctcgaggaactgcatgccatattagagaaccaggggaaacactacccctttctgctagcagaagaggacaagatcgagagcctcgtcagtttccggattccttattacgtgggaccactgaccagagaaaatgccgctgttggccacgatggtaaagagaggtttgcctggtcttcccgccgagacgggatggaacatgcagtgatcacgccctggaactgggaggagataattgatcgggacaagagcgcggaagacttcatcatccgtatgactggcgattgcacataccttcaaggagagcctgtcttgccaaagtgttcgctgctctatgaagagttttgcgctctgaatgaacttaacggcgcccactggaccattgacgaggatgacgagagaaggttcgatgcagcccagcgcgaacggatcatgtgtgacctgtttagatctactaggaaagtgacatacaagaaagtatccgattggttggagcgagaagactcattcgttggggctcgcgtgcatggaggtcagggcgagcacgggtttgaaagtcagctcggaagctatattttcttttgcaaggatgtcttcaaaaccgactccctggatgaggccgactacccgatgatagagcaaatcattttatggtctacgctgttcgaagatcgggacatcctaagaaggaagatcgaggaagcatatggcgaccgtctcaccacagagcagattaaggtgatatgtaaaaagcgctttgctggttgggggcggctgagcaaaaagttgcttactggcatcaaagtcgataccgacacaggaagaaagtcaattatcgatgtgctgagggaaggcaatcccaacgacgggcagcgaagtcggactatggttttcatggaggtgctccgcgatgagggactgggttttcagaaggccgtagacgatttcaatagagactacttttccgaacataacaatggcttaatggatgtcaacgacctgcctgggagcccagcgattaggcggtctatcaatcaagccgtgcgaatagttgatgagatcgtgtcaattgctaaaaaggaacccgcaaacatcttcattgaggtcaccagagaggaagacgaccctcgcaaaaagggaaaaaggacaaagcgtcggtatgatgccatcaaaagtgctcttgaggtgtttaagaaggacgatccacagttgtggaaagaactcaccaagaaagacagcaacaatatggatgagagactgtccctatacttcatgcagaggggcaagtgcatgtactctggtcgccccataaaaattgaggagctgcacactgggaagtatgaggtagaccacatcattccgcgatcgtacatcaaggatgacagcctcgaaaacaaagtgctggtttatagagaggaaaatcagcataagacggatacacttttgatagactcctcaatccggaggaaaatgggcaagtactggcgcatgctgcacaacgccaaattaattggagataagaagtttcgtaatctcttcagagaccatatcgatgacaaaaccatgaagggctttgtcgcacggcaaattgtggagacttcacagatggtgaaactggtccagacccttctggaagcgaggtatcctggggcccgcatcgttcccgtgaaggctaacatatctcacgacttgcgagatgccgcaggactcgtgaaatgcagagaggctaatgacttccaccatgcccacgatgcatttctggcctgtcgggtaggcctattcattcaaaagaggcatccaagcgtctacgacaaccctatcggtctggctcacatcatgcgcgattatgcgagagcccaggcaagggagtacaagaaatcccattacctcgctcacacaaaggggttcattgtgaatagttttctgagctctggattcgacaaagaaaccggcgaggtttttaaggatgactgggatgccgaagccgaggtggaaggtatccggcgtgtccttaactatcgccagtgcttcatttcccgaatgcccgtggaggctactggcacattttgggaccagacgatatacagtccaaaatgtgggaagaaattgaccctgcccttaaagagaggactcgatcctgacaggtatggcagctactctcgggagcaattcgcatactttttcatctatgaagcccgcgatctgaagcacgagagacatattcttcagtttgcgcaggttccagtgagggtagctgcccacatcgcaaaagacccgtcccagctggaatcatatgccgtcaagctagctgggcaagcaaatctcgccttcgtgcggattgtgcgaagacgcatcctgaaaaagcagttgctggagttaaacggagacaggctcataatcactggcgtccgggaggttcgtaatgcgacagaatttgctttcagtctggatgaggaaacccttattgagagatgcgtgcagatcgccaaagtaggtagcctgattggggtggtcaacgacgaagatgaggagcagttgtcggcagacctcaatgaactgttctcctctctagtgaagaggggacccaagctgtgtaaccgcctttacgcccaactcaaactggataagtacttgagcaaatttgacgagctgacattaactgataaggctaaagttgtgctccagctgatcgccataaccaacggctcaattaatatggcagaccttagtgctctgggttcctctaagtatgccggctgcatgcaggtcagctacttcaagcaattgaacgcgcctatcggggaagtgaatatcattgatcagtccgttacgggaatgtttgagcggcgaacccatataggcctctga

SEQ ID NO: 3267 - RNA, 4188 nt, synthetic construct
  misc_feature 1..4188: note = Cas9 variant
  source 1..4188: mol_type = other RNA
atgaaggagatcaaagactacattataggcctggatatcgggaccaacagctgcggatatgtggtcacagacaagcagaataacattctcaaacttaagggtaaaactgccatcggcgctagactgttcaaggaagggcaagcagccgcggataggcggtcctttcgcacgacccgacgtagattggctaggcggcactggcgcttaggactgctagaggaaattttcgaccccgagatggaaaagatcgatcctaatttcttcagaaggctcaaagagtctgactactcaccaaaggatagtcggaaacagtttaacgccatagttttcaagagcatcaaagcagacaagcgcttttataagaaatacccgacaatttatcatctgcgaaatgcccttatgcacgataaccagaagcatgacctgagagagatcttcatggctgtgcaccatattgtaaaatacaggggcaactttttgcgggaagattccgtgaatgcattcaaggccgctaaattttctctccgtggtgaggacgggatcggacccgtcgataagctgaatgacctgctcaaagaaatatattcggagtactcacctgagttagccactaacaatctgagcaagattgaagacatcattaaggataaaaacctttacaagcaggacaaattgaagcaagtggcgaccctgctaatcaaagaggcagatagtaaggacaaggccaaactcaataaggatatcgctaaacaggttgccaactccttcatgggctatatgtttcgcctggacacacttttctctctgaccgatgtggacgtcaaggattacaaattgaagttcagcgacgcaaatattgatgaatccctcgacgacctgacttcattactgacagatgctcagatagagtttgtgctcgaacttcagagtatctataacaccattgtactgaacgagatcgttccagacggcatgagcttgtctgagtccatgataaagaaatacgatgaccacaaggaagatctaaaaattttcaaggagtatatcgactcactgagcgatcagaaaaaggccaagaaactcctgagtgcgtacaatctttatgtgaactacagaaagtctgacctggtcgaagccaaaaatttgtttaagaacaaaaaggtgggggataaaaatttcgcagacgtgatctccaactttgaggtcttcggaaagtttgttagcgataatctcgacgattcggaactggctaacaagattaaagccaggttagacctgggtgagttcctacccaagcagcggacgaatcagaacggcgtgatcccttaccagctccaccaagtagagctgactcagattcttgaaaaacaggggaagtattacccatttttgataacccccaatcctgtggagtctcatcgaaacaatgctccatatgaaatctccgagctggtctcattccgcgtgccgtactatgttggacccctcattgacaaccaaagtatcaaagataagcagaataagaacaaatttgcctggatggtgagacagaagcagggccaaatcacaccttggaacctggaagagatggtcgacactaccgagagcgcaaatcagttcattaaaaggatgacacggaaggatacctaccttctggccgaagacgtgttgccaaaatcctctctcgtatatcagaagtttatgatactggatgagttaaaccgcatcaagattgacggtaaaaagctgacgagcgaactaaaacacgatatcttcgagaaactcttcaaaaagcagaagtcaattaatctggacaaccttaaaaattacttgctggttgaggggaacatccccggactcatagaaggcctgagtgatggcatcaattttaacaattccttcagcacttacattgactatagaaacatctttggggatgagattgacaatcctaacaagcaagctgatttcgaaaagatgatcgagtggtctacagtgtttgaagacaggaagatattcaaacgtaagttaaaagagattacctggctgacttcagagcagatcaagcaggtcagtagcaagcggtactccggatggggtcgactttctaaaaagttgctcacacagattaccgacgaaaatggcgtgaacatcctgcaaagactatggaatgagccagaaacgctgaccgaggtcctcgcgaaccccgtgataaaaaggaagatcgttgaagcaaactcgagctttacaaaagccaaggatatgaaggacattctggtggaggcttatacttccccgcagaataaaaaggccatccgccaggtaatgcgggtcgtggatgacattatcgcagccgctcatgggaaaaagccttcacagatagccattgagttcgcaagagaagatcaagacaacccccagatgaccaaaagtaggaaggcgcagcttgatcaaatctacgctaagatctctgacgagtttttggatgacgccgttaaaaatgaactgaagaacatgaaagataataagccattagcaaaagacaaggtgttcctctattttaagcagatgggacgcgacgcctacagcggcgagaaactgtcccttgataacctgcaggactatgatattgaccacatctaccctcagtcattcattaaggatgacagctttgataatcgagtcttggtgcaacgggcttacaacaatggtaaatctgacaacgtacccgtgctcctgttcgggaataagatagccgcaggcctaggaatcacaattcgtcagatgtggaaaaagtggctggaactcggcctgatctccaagagaaaattcaacaatcttattactgatccagagaagatcagtaggaacatggctagcgggtttgttaatcgccagttggtcgagacctctcaggtgataaaactggtggccaacatcttacaagcgaagctccccgacacagaaattatcgaggtcaaagcctcctataactcaattctgcggaaggaatttaatctttacaaaagtagagaggttaacgattatcaccatgctatcgacgcatacctgaccactatagtgggaaattatctataccaggtgtatcctaagctcaggccatactttgtatacggtcagttcaagaaatttggcaaggccgagaaccaggaagatgacccggtcaaaaagattaaaaagttcaattttatctatcaactgatctgggggaaggacgatgctatttgtataagccacacgaaccaacaggtgttctcgaaaaaggacatcattgataaattgacaaccgcctacaattttaagtatatgaacatctcccatgcagtttacactcgaaataacaatatgttcaaacaaaccctgtttcccattatcgagcgcacaaccgcgaagactaagtctttaatacctaaaaagctcgaccggccaacagatatctatggaggctacagcaacaataacgacgcctatctggctcttgtgaaagtcgataagaaaagaggttcagaatacagggtggttgggattcccatgcgtgccgcagctatgctgaaggccagtaagaattacgacgaggatttgcgcaaagtgatcgaacctatggtaatgttcgacaagaacggcaaagcaaagcggggaattgagggcttcagagtcctcgtggggaaaatgccatttaagcaggccgtgctggatggaaataaaaagttcatgctaacgggtaccgtcgacactcccaacctgaagcagcttgttctctcccagcaaaacatgaaatatatcctggattacatagaggacgtggactgcaggaagcacaaatttggcgataaggtacagaatccggacaaatgtttgctggaagtgttcgatgagattatcgaaatcgtcgacaagtattttgagttattcgattctcgagactttcgggaaaagctccgcaacagcagaaataaattcattaagctggaggcttccaaaaaggcggatacaatccttgccatactgaaagggttgcaggcaaagtcaaccagggctacaattaaggagctcaacatcagcgactttggacggattatcaccagttctatatcccctgaagcccagctgatttaccaaagcccaactggcctattcgagcgaagagtgaaagttaaggatctgtga

SEQ ID NO: 3268 - RNA, 4188 nt, synthetic construct
  misc_feature 1..4188: note = Cas9 variant
  source 1..4188: mol_type = other RNA
atgagcaagaaataccagaacaccaagtattacgtgggcctggacatcgggacatcctctgtcggatgggccgttactgatgctaattatgagctccttaaagtgaacggtcacaagacgtggggctcaagactgttcaccgaagcagagacagccttggaaaggcggactcatcgcgcgacccgacgtagattacaaaggcggaaacagcgcctggacctactcgatgagctgtttgctgaggagcttgccaaggtagacccccagttcctgttgagactcaaggagagtcagtaccacatggaagataaaagcacagacgataagtatgtgctgtttaatgaccaaaacaggaccgatggggagttctttactgaataccctacaatttatcatctgcggtccgagctcatgcaggggaaaaaggaggacatacgcgcagtctacttagccctgcaccatatcgtgaaataccgaggccacttccttttgccaggtgataattatgacatgcaggggaacctgtctgaactaattaagagactctttaagttcatcgaggaaaccctgtttattgaggatcttggactgacggacgaaatccagtcgaaaatagaggagatcttgctcactaagaccaaaacaaggctggaccggcaaaaggaaattgttaaattattcaatactaagcaccagaaactggatgacaagcagaagaaactccttgaggctatctttaagctgtgcttgggcctaaaaggcaacatggtgaatattttcggggataagggagaatacggtatcgactttaccgatgtcgaggacaaaaagaagaaagtggagttctcagcagattatgacaacaatataaacgattacgtagacttctttggcgaatatttcgagctgctcgaaattacaaagaaaatcaatgataccgttatttttagcgagatcctggtggacgggaagggattcagtgaatccaaagtcatctcttacgagaagcatcagcaagaccttcgtaagctgaaaacgttgctcaagagcctggataaaactttaggctataagtacggtgaagggctgtaccagaaaattctactcgacgatgtgaagtccaactatgtgaattactcaggaaacagtcagaagctgaaaaagtgtacaaaagacgagttttatggcttcataaagagcaaacttaactctgtcaccaagaaagagaaggtttccgaagcccaacagaaggagatcgctcagattttggccgatatggaatttggcgactacctgccgctccagcgcactacagataatggggtgatccccaaccaactgcacaaaaaggagcttatagagattatcgaacagcagaccaaatatcatgacttctttaatgatgtagacgagaacggactgacgatcaaggataaaattatctcattgatgaccttccggattccttactatgtgggtccactcaatgactaccacaaggtcgcggatggcacagggcacgcatggatagaaaagaaaaaggacggaaaaatctacccctggaactttgacgagatggtggatactgaagccaccgctgagaagttcattaaaaatctgacaaacaagtgcacttatttaaagggcgaggacgttctgcctaaagaaagcaagctatacagtgagtttatgctcctgaatgaacttaacaatatcaaaatcgataaccagaagttggacccaaaactgaagatgaagatggtgtctgaactcttcatgaaaaagaatgaaaagattaccaagaaaaagatagtcgattatctgaggtccatcggtcaagccaacgggaatgagatggtgagcggcattgaccgggagatcaaatcggatttaaagacaattcataagatccagcactactatcaggacgcatctctggaaatggctgagaacataatccgatggaacaccattttcaatgattccacttcagacatccttaaagataagattacgaaagcctacggagacgtattgacacccggccagatcaaggggctcagtaacctggcgtgtaaagattggggaaagctaagcgaaaagtttctgaccggtatacgctgcgacgttggcgagttcaaaaatatttccatcattcaagccatgagagacactaacaataacctcatggaactgctttctaataagtatgagtttatggataaaatccaggagtacaacaaggaatactatggggacttcacctttaaagcagagcctagcataatggatgacttgtacgtgggaccaggcccgaagagggctatctggcaggccgtccggattgtggaagagatcaagcgcattatgggtcatgatcccgagaaaatcttcctggaaacaaccagaactaatagggctcctaaggtcaaaaacacaaagcgttatgacgccttagagaaaaagtacgaatcagtgaaggagcacgaatatgcagaggttaaaaaggagtttgaaatagagaaaaatgatagtctcaacattaagaaactgttcctttactttacgcagctggggcattgtatgtattccgacgaaaagatcccatacaatgagttgttcaccaaccggtacgatatcgaccacatttatccccgaagcaagactagagataattctatggacaacctcgtgctggtaaaagccgaatgcaacagggacaagaaagataattaccctatcaagctaaaaacaaacattcaacagaagtgtcaggtccgctgggcttatctgcgggacaaaaagctcataaccgaggagaagtacaatagactggtgaggaaaacaccacttactgaagatgagttgtcacaatttatcgcgcgccagctggttttcaccagtcagagcgtgaaggcaacggccgaagtctttaaacgattatatgaggactccaagatttgctacgtgaaagctgaaaacgtatctgatttccggtatggctcgacccgtaagatgagcaaggacgatcagccccaaccgttcatcaaaaatagagacgtgaacgattttcaccatgccaaggacgcatacctcaatattgttgtcggaaacgtgtacgatgtgaaattcacacagaatcctactaggtttatcaaggccaacaaagactattccctgaattacatattccgctatcccgtcaacaagaagggcgagaatgtttgggatccagagcagtcaatgaaaatcgtggaaaagacccttaaaagtaacgacgtgcgggtaacaaagctggtcaaacctattacttctcccatcagcaatgagaccctacacaaggctctcaagtgtaaaccagggtcctacctgcccagaaagtcaagcaaaggaacgcctttggccgacgtgacaaagtatggtggctacgagaaaattaagaacgcatattactctatctacaaatatacctacatgaagaagaaagaatgcatggaggaatttctgttagttccaataccgattcatctcgtgaacaatgatgaggaactgcccaagtatatcaacgacaaaatcgcggagagggctaagaaaaagaaacttgaaactgtcgagtgtattgtgaaagagctgtaccaggggacattggttcgaataaatggatatgattaccgcatcgccggctccagtggtaagcaattcgaactccacaacgggattaatctgatcgtggagccttgggtagaaaaagtcctaaaggagaccgacaaatttgtgagaaagagcaactctaagctggataaaaagcagcagaaagaaaatactaccgagacacttattgagaagcagctcaacgacgtgttcgaatatctgtgcagaaaattgaatcaaggcatctttaagaacaataagcacacgctgccagcaaaattactcggagattccatacagaagaggttcgaggacgcctcaatcgaagatgagtttgaagtcattaaagagctgatcagtgctattgccaagaacccccagaatttcaaaaccatccaaaaggttcttgacataagcggctcgtccattcctcgtttcaacctgaaattgactaagaataacgtggatgagtttatcatcaagaatgaatctgtaacaggactcttcacccatgagaaagtgatttttcgcaagtga

SEQ ID NO: 3269 - RNA, 4188 nt, synthetic construct
  misc_feature 1..4188: note = Cas9 variant
  source 1..4188: mol_type = other RNA
atgaagaaagagatcaaggactacttcctgggcctcgatgtggggaccggaagcgtcggttgggccgttacagacactgattataaacttctgaaggctaacagaaaagacttgtggggcatgaggtgctttgaaacggcagagaccgccgaagtgcggcgcttacaccgaggggcgcgtagaaggattgagcggcgcaagaagagaataaaactgctacaggaactcttctcccaagagatcgctaagattgatgagggatttttccagaggatgaaagaatctcccctgtacgccgaggacaagacaatccttcaggaaaatactctgtttaacgataaagacttcaccgataagacatatcataaggcataccctaccattaatcacttgatcaaagcctggatagagaacaaggtaaaaccagacccgcggctcctgtatctggcttgtcataatatcattaagaaacgcggccactttctcttcgagggtgattttgactcagaaaaccagttcgatacaagtatccaagcattatttgagtacctgcgagaagacatggagcttgacattgatgccgacagccagaaggtgaaagaaatcttgaaggattcctctctgaaaaattcggagaaacagtcaagactaaacaagatgctcgggctgaaacccagcgacaagcagaaaaaggctataactaatcttattagtggaaacaagatcaatttcgccgatctgtatgacaaccctgatttgaaagacgcggagaaaaattccatttcttttagcaaagatgacttcgatgcactctccgacgacctggcctcaatcttaggcgatagtttcgaactgctccttaaggctaaagccgtctacaactgcagcgtgctgtctaaggttatcggcgacgagcaatacttgtcctttgcaaaggtgaaaatttatgaaaagcataaaaccgatctaacgaagctgaaaaatgtcataaagaagcacttcccaaaagactacaagaaagtgtttgggtataacaagaacgagaaaaataacaataactactcagcttatgtaggagtttgtaagatcactcacaaaaagctcgtgattaagaatagcgccagtcaggaagatttctacaaatttctgaagaccatcctttctgcgaaatccgagataaaggaggtcaacgacattctgacagaaatcgagactggtaccttcttgcccaaacagatcagcaagtcgaatgccgaaattccttatcagctcaggaagatggagctggaaaagatcttatctaacgcagagaagcatttttccttcctgaaacaaaaggatgagaaaggcctatcacacagtgaaaagattataatgctcctgacatttaagatcccatactacattgggcccatcaatgacaaccataaaaagagcttccctgatcggtgctgggtggtgaaaaaggagaaatccccatctggaaagaccacgccgtggaactttttcgaccacatcgataaggaaaagactgctgaggagtttattacaagccgtaccaatttctgtacttatcttataggcgaatcagtcttgcccaagagttccctgctctacagcgagtatacagttctgaatgaaatcaacaatcttcagattatcattgacggtaaaaacatctgcgatataaagctgaaacagaagatctacgaggaattgttcaaaaagtataagaaaattacccaaaagcagatctctacgtttattaaacacgaggggatctgtaacaagaccgacgaggtgataattctcggaatcgacaaagaatgcacatcaagtttaaagagctacattgagttaaagaatatcttcggcaaacaggtagatgaaatatccactaagaacatgctggaggaaatcattcgctgggccaccatctatgacgagggcgaggggaaaacaattctaaagactaaaatcaaggctgaatacggaaagtactgttctgatgagcagattaaaaagatactcaatctgaaattttcgggttggggcagacttagcaggaagttcttggaaaccgtgacatccgagatgcctgggttttcagaaccagtcaacatcatcaccgccatgcgggagactcaaaataacctgatggagctcctgagttctgagttcaaatttacggaaaatattaagaagatcaacagcggattcgaagacgcagagaaacagttttcctataatggcttagtgaagcccctgttcctttcacctagcgttaaaaagatgttgtggcagacactcaaactggtgaaggagatttctcatataacccaggccccacccaagaaaatctttattgaaatggctaagggtgcggagctagaaccggcacgaactaaaacccgcctgaagatcctccaagatctgtactccagttgcaaaaacgacgccgatgctttcagctctgagattcagtatctttccgggaagatcgaaaatgaggacaacttgagactgaggtcagataaattatacctctattacacacagctgggcaagtgtatgtattgcggaaagcctatagagatcggccacgtctttgacaccagtaattacgatattgaccatatctacccccagagcaaaattaaggatgactcgatctccaaccgggtgcttgtatgctctagctgtaataaaaacaaggaagacaaatatccactgaaggccgagatacaatcaaagcagcgcgggttctggaacttcttgcagagaaataactttattagtctcgaaaaactgaataggctaactcgtacatcccctatctctgatgacgagacggcaaagttcatcgcccggcagctggttgaaacccgacaagctactaaagtggccgcaaaggtcctcgagaaaatgtttcccgagacaaagattgtgtacagcaaggcggaaaccgtctccatgttcagaaacaaatttgatataatcaagtgcagggagattaatgacttccaccatgctcacgatgcctatctgaacatcgtggttggaaatgtgtacaacacaaaatttactaataacccatggaatttcattaaggaaaaacgcgacaaccccaagatcgcagatacctataattactataaggtatttgactacgatgtcaaacggaacaatataacggcctgggagaagggtaaaaccatcattacagtgaaggacatgcttaaaagaaacactcctatctacaccaggcaggctgcctgtaagaaaggcgaattgttcaaccagacaattatgaagaaggggctgggacaacacccactgaaaaaggagggcccgctctcaaatatcagcaaatatggtgggtacaacaaggttagtgcagcttattacactctgatagagtatgaagagaaaggctctaagattcgctcccttgaaaccatccccctgtacctagtgaaggatatccagaaaaataaggacggactcaaaagctatctgacggaccagattggcaagaaagagatcaagatattgattcctaagatcaaaattaactcgctgttaaagatcaatgggtttccatgccatataacaggaaaaatgggtgaggccttcgtcctccgacccgcggtgcagttctgttgctcaaacgatgaagccctgtactttaagaaaattatccggttcaatgagatccgtaagcaaagagaaaagatgggcaaaaccatttctccttacgaggaccttagttttaggtcctatatcaaggataacctgtgtaaaaagactaaagctgacgaaattgaggagaaggagttctacgatttgctccagaaaaagaatctggaaatatatgacatgctactgacaaagcacaaagataccatctacaagaaacgcccaaacagcgcaactattgacatccttgtaaaggggaaagaaaagtttaagtctctcatcattgagaatcagttcgaagtgatactggagatcttgaaactgtttagcgccacccggaacgtttccgatttacagcatattggaggctcaaagaatgctggtaacgccagagtcgggaataaaatcagtagcctcgacaactgcattctgatctatcaatctataacaggcatcttcgagaagaggattgatcttctgaaaatctga

SEQ ID NO: 3270 - RNA, 4188 nt, synthetic construct
  misc_feature 1..4188: note = Cas9 variant
  source 1..4188: mol_type = other RNA
atgagcttcaagaaaatcctgggcctcgacgtgggggtcgcctccattggatgggctgttgtgagagagaacgaagagaatcccaactttaataccataacaaaacttggtgtaagggtggtccctatcacttctgatgaaaaactgaacttcgagaagggcaaatcaattacgagtaatgcagaacggaccttggcccgcagctcccgacgtaacttacagagatttaggctgcggcgcaagaatctaatcgcgattctcctgcaaaaccagatcataacaccaactaccccgcttacagagaaggggaaattcaccacttttgagacactgaagatcagagctaaagccaccaaggaaaagattgagttggaggaactcgcaagggtgctgctgcacatcaataagaagcggggatacaaatcttcgcgcaaggttaaaaactcagaggacggcaaggccattgatggtatggaagctgcaaaaatcctctatgagaataagttaacgcccgggcagtacacttatcagctgcttgaaaaaggaagcaacaagatacctgacttctactgcagtgatttgcaaattgagtgggaagtgatctggaattttcagaagcagttctatccaaacctgctaaccgaggactttaaaaaggagctcaaaggcattggccagcgagccacagctgccctgttccttaagaaatacgggatctatactgcgctgaataagggaaagagagaagagaaaaagttgcaagcatacaaatggaggtccaagtctgtcagcgagaaaatccccgtggaagaactcgcctacgtaattgctgagataaactcccatatcaccaactcaagtggttatctgggcacaattagcgatcggtctaaggagttatactttaatcagcagaccatcggggaaaacctgtatgcccaggttgcaaagaatacgcacgctaaactcaagaaccaagtgttccttcgtcaggactactccgccgagtttgaacagatatgggagactcaagcgaaattccatcctcagctgacaccagaattgaagaaaaagattcgcgattcaatcatcttctatcagagaaagctaaggagccagaaacggctgattagtatctgtgagtttgagaatcgagaaattgagataatcaagaacggcaaaaagaaaaagaaaaagattggactcaaggccgcacccaaatcttcccctctgttccaagaatttaagatctggcaggtccttaataacatcgtgattaaacaggagggtaaggaccgcctgttgacctgggaggaaaaagagctcctgttcactgaattaaatataaaggggaacatcagcggacagaaggctctggccctactcaaactgtcgccaaaggatacaaaaattaatgtgaccatccttgagggcaaccacacgcaagaacagttgtacagagtctatctgaggattctcggcatggaggggtacgacgtttttgatctgcttaagatcccggagaatcaggacgaaataaaacccgctgactctaagatctccgccgcagagattaaggaaaccgtgaaatcagtattcaagacatgcagtatcagcccttccattctggattttgacccattgctccccaaccctgagttcgaaaatcagtctagctaccaactgtggcatttactgtattcatacgagggagatagttccccaagcggtaacgagaaactactcgaactgcttaagaacaaatttggcttcaagaaggagcacgccttgctgctcgcttctatctcatatacttacatatatgggaatctgagtagcaaagcgatgcggaagatttacccctattccaaagaaaacacctactctgaggcatgtatgttagccggataccgccactcgaagaatgctctgccgagagaggaacttgtgaaatatcagttgaaggacaggctcgagatcctgcctaaaaacagcctacgtaatcccgtcgtggaaaaggttctgaaccagctcattaatctggtgaactcccttatggatgagtacggcgcctttgacgaaatccggttggagatggcacgagagctgaagaaaaatgccaaggaaagagagaaatggtcaaagaacatagctgatgccacaagtaggaatcagaaacatgcagaaatcttaaagaaggacttcaaaatttctaacccaagcaagaatgatctcatccgctatcggctgtaccttgagctgaaagcgaacggttataatgacttgtacactaacacctatattgatatcaactacctctttacacacagatacgacatagaccatattatccctcaatccaaggtcctggatgactcattcagcaataaagtgctagtacccaggcaggctaacctggaaaagtctaatctcaccgccttcgattatatctcccaccaggggaaggagaaagaggaacactacctgaacgttattactgagctttataagcgcggcagtatcagcgaaacgaaatacaagaatttgcagaaaaagggaaacgagattggcgaagggtttataaatcgagacctgaagaacacacaatatatcgtgcggaaagcacgtgagattttatctctcatcaccccaaatgtcgtgactaccacaggagagattaccgccaagctgagaaaagattggaaccttatcaattccatgaaggaactgaacatggacaaattcaggaatgctcgcctaactgagctcgtcgaaaactcacggggtgagaagaaggaaataatcattgattggaataaaagaaacgaccagaggcatcacgccatcgatgcactggtggttgcttttacaacgcgaaaccatgtgcagtacttgaattatatgaacgcccgcgaggacgagagtcacaagcaacatagccacattctgtcgatcgagaaaaagataaaatacgataagttccacgaaaatggctcccggcagtctagatttatttaccccaccagcaacttcagggaagaggcgaaaaagaagttaaaagagatcctcgtatcatataagactaaaaataaggtcgtgacagttaacatcaataaacctaagaagaaagggggatacagtccaaagcatgaactgaccccgcgtggcccccttcacaaagagacaatttatggtatgatacgcatcctgcatactaaggaaattaaagtgtcctctaagttgaactttgagaccgtcgtgcggatccagaatcctagatacaggaacgccctcctggaacgactaaaggacaatttcaacgatcccaaaaaggcttttagcgggaccaattccctgacgaaaaacccagtattccttacagcaaattcaactgagaccgtgcctgagaaggttacaattcagtggtttgaaaaagtctatactatccggaagccaataaaccccaccaatttcaagaacgagaaaaacatcgaaaaggtgctcgacccgacgattcgcacactgttgaaaaagagactgcaagagtacaatggcaacgccaaagaggcttttagcgacttagaaaagaatcctatctggctcaaccaggagaaaggaatttgcatcaagaccgtgactataacaggcattagtaatgtcgaatctctgcacaccaagaaagatcacttcgggaaggagcttctggacatcaacggaaatccaatccccgttgatttcgtgtccactggtaacaatcatcacgtggccatttatgaagacagcgagggcaacttgcaggaaaaagtagtctcgttttacgaggcagtggagagggttaatcaggggctccctgtgatcgataccctgtacaacctagacctgggatggaagttcctttttacaatgaaacaaaatgaaatgttcctctttcccgcggatgacttcgatccaaacgacatagatatttatgacgagaagaatctgatcttgatttcaaagcatttatttcgggtccagaaactgtctagtaaggattactgtttccgacaccatctcgaaacgtccatcaactttaacgaccctgccctgaaaggcataacctggagacgcgagagccccaatggtcttaggaacctggtgaaggttcgtttgaatcacctagggaaaattgtgcacatcggcgagtga

SEQ ID NO: 3271 - RNA, 4188 nt, synthetic construct
  misc_feature 1..4188: note = Cas9 variant
  source 1..4188: mol_type = other RNA
atgaagaaagagatcaaggactacttcctgggcctcgatgtggggaccggaagcgtcggttgggccgttacagacactgattataaacttctgaaggctaaccacaaagacttgtggggcatgagatgctttgaaacggcagagaccgccgaaaagaggcggttattccgcggggcgcgacgtagaattgagaggcggcgcaagagaataaaactgctacaggaactcttttcccaagagatcgctaagattgatgaggacttctttcagaggatggaagagtctcccttctacgccgaagataaaacaatcctgcaggagaatactctttttaacgaccgggatttcaccgacaagacatatcataaagcataccctaccattaatcacctgatcaaggcctggatagagaacaaggtgaaaccagatccgcgcttgctctatctggcttgtcataatatcattaagaaacgaggacactttctgttcgaaggcgactttgattcagagaaccagttcgacacttctgtacaagcactctttgaatacttaagagaggacatggaactggatatcgacgccgatagcaagaaaattaaggagatccttaaagactccgctttgaagaatagtgataagcagaacaggctgaataaactactcggtctgaagtcgtcagacaaacagaagaaagcccttacaaacctgataagcgggaataaggcgaacttcgcagatttgtatgacaatcccgatctcaaggacgccgagaaaaacagtatttccttctctaaggatgactttgacgctctgagcgatgaattagcctccgtgctgggagactcattcgagctccttctgcgggcaaaagctgtctacaattgcagtgtgttgagcaaggttatcggcgatgaacagtacctatcttttgccaaagtgaagatttatgagaagcataaaaacgacctgaccaagctcaaagaagtcgtgaagaaatacttccctatcgagtatcgtaacatctttggctacaagcaatccgagaataacaattgtaactattcacgctacgtaggggtttgcaagagcggaagtaaaaagaaagtgattaataagacggcgtctcaggaagatttctataaatttctgaaggacatacttctgaaaagatccgatgtcccagaggccaacggtatcttgactgaaattgagaccggcacattcctccccaagcagatcagcaagaataacgcagaaataccttaccagctgaggaaaattgagttagagaagatcctgactaatgctgaaaaatttttctcgtttctaaagcaaaaagacgagaacgggctctctcactccgaaaagatcattatgctgcttaccttcaagatcccatactatattggacccataaatacatcacacaaacagtactttcctgatcggagttgggtgatcaagaaagagaacgccccacaggagaagattaccccgtggaatttcttcgaccatatcgataaagaaaagacggctgaggcctttatcactagccgaacaaacttctgtacctatttgattggcgaatccgtgctgcccaaaaattctctcctgtacagcgagtatactgtccttaacgaaataaacaatctgcaaatcattatcgacggtaagaacatttgcgatgttaagttgaaacagaagatctacgaggagctctttaaaaagtataagaaagtgacacagaagcagatatcaaccttcatcaaacacgaagggatttgtaataagacggacgaggtaatcattctgggaatcgacaaagaatgcaccagttccttaaagagctacatagagctgaaaaacatttttggcaagcaagtggatgaaatctctacaaagaatatgctagaggacattatccgctgggcaactatatacgatgagggcgaagggaaaaccatcctcaagacaaaaattaaggccgagtatgaaaaatactattcagacgagcagatcaagaagattctgaaccttaaattgagtggatggggtagactgagcaggaagttcctcgaatccatcacttctgagatacctggctttattgagccagtcaatatcatcaccgctatgcgggaaacacagaacaatctgatggagttactgtcgagcaaattcaagtttaacgaaaatattaaaaagatcaactccgggttcgaggataccgacaagcgcttttcatacaatagtcttgtgaaacccttgttcctctctcctagcgttaagaaaatgctgtggcagactctaaagctggtgaaagagatttcccatataacgcaagcgccacccaagaagatctttattgaaatggcaaaaggagccgagctcgaaccggctagaacaaagaccaggctgaaaatccttcaggatttgtataactcatgtaagaatgacgccgatgcattcagctctgagattcagtacctgttaggcaaaatcgaaaacgaggacaacctccgtctgcggtccgataaactttatctgtactacactcagttgggtaagtgcatgtattgtgggaagcctatagagatcggccacgtcttcgacaccagtaagtacgatattgaccacatctatccccaaagcaaaattaaggacgattctatcaataaccgagtgctcgtatgctcctcatgcaataaaaacaaggaagacaaatacccactgaagcctgagatacagctaaagcagaaaaagttttggaatttcctgcagagaaacaattttattagtatcgaaaaattcaacaggctcacacgcaccactcccatcagcgatgacgagacagccaagtttattgctcggcaactggttgaaacgagacaggccaccaaagtggcagcgaaggtccttgagaagatattcccagagactaatatcgtgtattcgaaagctgaaacagtctccatgtttaggaacaagttcgatattatcaaatgtcgcgagattaatgactttcatcacgcccatgatgcatacttgaacatcgtggttggaaatgtgtataacaccaagttcacaaataacccctggaactttataaaagaaaagcgagacaatcctaagatcggcgatacttacaactactataaagtattcgactacgatgtcaagcggaataacattaccgcctgggagaaagaaaagacgatcattaccgtgaaaacaatgctgaagcgtaatactccaatctataccagacaggctgcctgcaagaaaggggagttattcaaccaaacaataatgaagaaaggactcggtcagcacccgctgaagaaagagtgtcccttttctaatattagcaagtacggcgggtataacaaagtttcagcagcttactatactttcatcgaatacgaggaaaagggaaataagatcaggagtcttgagaccattcctctgtacctagagaaagacatccagaagtcccaggacggcctcaaaggttatctgacggatcaattggggaagaaagaaataaagattctggtgccaaagatcaaaattaactctttactcaagatcaatggctttccctgccatataacaggaaaaaccggcgccagcttcgtcctgcgccctgcggtgcagttttgttgctccaacgacgaggtactttacttcaagaaaattatccggtttaatgaaatcagatcacagagggagaagatggggaagactattagcccatatgaagatctgagtttccgatcttacatcaaagagaacttgtgtaagaaaacaaagaatgacgagattggagaaaaagagttttatggtttcctccagaagaagaacctggaaatatacgatatgctactgatcaaacacaaggacaccatttattccaaacgccccaatagcactacccttgatatgctcatcaagggccggtacgagtttatcaacctgaaaccggaagaccaaattagagtgatgttggagatactgaagttattctgcacaacgagggaggttatcgatctcgggctgattaaaggaaagtcggaagccggcgtcaccactcttggtaagaaaatctcaaacctggactcttgtattttgatctaccagagtataacagggatctttgagaagcgtattgatctcctgaaaatctga

SEQ ID NO: 3272 - RNA, 4188 nt, synthetic construct
  misc_feature 1..4188: note = Cas9 variant
  source 1..4188: mol_type = other RNA
atgaagaaagagatcaaggactacttcctgggcctcgatgtggggaccggaagcgtcggttgggccgttacagacactgattataaacttctgaaggctaacagaaaagacttgtggggcatgaggtgctttgaaacggcagagaccgccgaagtgcggcgcttacaccgaggggcgcgtagaaggattgagcggcgcaagaagagaataaaactgctacaggaactcttctcccaagagatcgctaagacagatgagggatttttccagaggatgaaagaatctcccttttacgccgaggacaagactattctgcaggaaaatgcacttttcaacgatcgggactttaccgataaaacatatcataaggcctaccctaccatcaatcacctgattaaggcttggatcgagaacaaagtaaagccagacccgcgcttgctctatctggcatgtcataatataatcaaaaagcgaggccacttcctgtttgagggtgatttcgactcagaaaaccagtttgatacaagtattcaagccctcttcgagtacttaagagaagacatggaggtggacatcgatgctgacagccagaaagtcaaggaaattctgaaagattcctctcttaaaaattcggagaagcagtcaaggttgaacaaaatgctggggctaaagcccagcgacaaacagaagaaagccatcactaatctcataagtggaaacaagattaattttgcggatctgtatgacaaccctgatcttaaggacgcagagaaaaattccatctctttcagcaaggatgacttcgatgccctgtccgacgacttggcttcaattctcggcgatagttttgaactgttactgaaagccaaggcagtgtacaactgcagcgttctctctaaagtgatcggcgacgagcaatacctttccttcgctaaggtcaagatctatgaaaaacataagaccgatctgacgaaattgaagaatgtgattaaaaagcactttccaaacgactacaagaaagtattcgggtataacaagaatgagaaaaacaataacaattactcagcctatgttggagtgtgtaagactaaaagcaagaagctagtcataaacaataccgtgaaccaggaagatttttacaagttcctgaagcccatcctcctggcgaaaagtgagattaaggaggtgaatgacatccttacagaaatagagactggtacctttctgcctaaacagatttctaagtccaacgccgaaatcccatatcagttgcggaaaatggagctcgaaaagatcctgagcaatgcagagaagcacttctcgtttttaaaacaaaaggatgagaaaggcctgtctcattccgaaaagattatcatgctactcacattcaaaattccctactacatagggcctatcaacgacaatcacaagaagtcatttccagatcgttgctgggtcattaaaaaggagaaaagtccgagcggaaagaccacgccctggaacttctttgaccatatcgataaagacaagactgctgaagccttcatcacatcccgcaccaatttctgtacttatctggttggcgagtctgtgcttcctaagaacagcttgctgtactcagagtatacagtactcaacgaaattaataacctgcagataatcattgatggtaaaaatatctgcgacattaaacttaaacagaagatctacgaggaactgtttaaaaagtataaaaagataacccaaaagcagatcagtacgttcattaaacacgaggggatctgtaacaagaccgacgaagtgattatcttgggaatagataaagagtgcacatccagcctcaagtcttacattgagctgaaaaatatctttggcaagcaggtcgacgaaatttcaactaagaacatgttagaggaaatcataagatgggctaccatctatgatgagggcgaagggaaaacaattctgaagactaaaatcaaggccgagtacggaaaatactgtagtgacgagcagattaagaagatcctaaatctcaaattcagcggttggggcaggctgtcccggaagtttcttgaaaccgtgacatctgagatgccagggttctcggaacccgttaacataattaccgcaatgcgagagactcaaaataacttgatggaactgctcagctccgagtttaaattcacggagaatatcaagaaaatcaactcaggatttgaagatgtggagaagcagttcagttatgactctctggtcaagcctttatttctgagcccatccgtgaaaaagatgctttggcagacattgaaactcgtaaaggaaatttcacacatcacccaggctcccccgaaaaagattttcatagagatggccaagggcgcggagctggatcctgttcgcactaaaaccagactaaagatcctgcaagacctctacaataactgcaaaaatgatgcagacgcctttagctctgaaattaaggatctgtccggtaaaatcgagaacgaagacaaccttaggttgcggagtgataagctgtatttatactatacacagctcgggaaatgtatgtactgcggcaagcccattgagatcggacatgtgttcgacaccagcaattatgacatagatcacatctacccacagtctaagattaaagacgattccatctcaaaccgcgtcctggtgtgcagtagctgtaataagaacaaagaagacaagtaccctcttaaagctgagattcagtcgaagcaaagaggcttctggaattttctgcagaggaacaatttcatctccttggagaagctcaaccgtctgactcggacatctcccataagcgatgacgaaacggccaaatttattgcacgacagctagtcgagaccagacaggccactaaggtggctgccaaagttctggaaaagatgttcccagagacaaaaatcgtgtattcaaaggcagaaaccgtaagtatgtttaggaataagttcgatatcattaaatgccgcgagataaacgactttcatcacgcgcatgatgcttacctcaatatcgtcgtggggaacgtttataatacaaagttcactaacaatccctggaactttattaaagagaagcgggacaaccctaaaatcgccgatacctacaattattacaaggtgttcgactatgacgtcaagagaaacaatattacggcatgggaaaaaggaaagaccatcataacagtgaaagatatgctgaagaggaacactccaatctacacccgccaagccgcttgtaaaaagggtgagctttttaatcagacaattatgaaaaagggcttggggcagcacccgctgaagaaagaaggacccttatccaacatctctaagtacggcggttataataaagtaagcgccgcatactatactctcattgagtacgaagagaaggggtccaaaatccgatcactggagaccatacctctttatctggtgaaggacattcaaaagaacaaagatggcctaaagagctacctcacggaccagatcggaaagaaggaaatcaaaattctgatcccaaagataaagattaatagtttgctgaaaatcaacggcttcccctgccacattacagggaagatgggagaggctttcgttttacggcctgccgtccagttttgttgctctaatgatgaagcgctctatttcaaaaagatcatacgttttaacgagattagaaaacagagggagaagatgggtaagaccatctccccatacgaagacctgagcttccgctcgtacatcaaagataatctttgtaagaaaactaaggccgacgagattgaagagaaagaattttatgatctgttgcaaaagaaaaacctcgagatctacgacatgctgctaacaaagcataaggataccatttataaaaagcggcccaattcagctactatagacatcctggtgaaaggcaaggagaaattcaagtctcttattatcgaaaaccagtttgaggtgatcctcgaaattctgaagttgttcagtgcaaccagaaatgtctccgatctgcagcacatagggggaagcaaaaacgccggcaacgctagggttggtaataagatctctagcttagacaactgcattctcatctaccagtccattacagggatctttgagaaacgaatagacctgcttaagatctga

SEQ ID NO: 3273 - RNA, 4188 nt, synthetic construct
  misc_feature 1..4188: note = Cas9 variant
  source 1..4188: mol_type = other RNA
atgaagaaagagatcaaggactacttcctgggcctcgatgtggggaccggaagcgtcggttgggccgttacagacactgattataaacttctgaaggctaacagaaaagacttgtggggcatgaggtgctttgaaacggcagagaccgccgaagtgcggcgcttacaccgaggggcgcgtagaaggattgagcggcgcaagaagagaataaaactgctacaggaactcttctcccaagagatcgctaagattgatgagggatttttccagaggatgaaagaatctcccttttacgccgaggacaagacaatcctgcaggaaaatgcacttttcaacgataaagactttactgataagacctatcataaggcctaccctacaattaatcacctgatcaaggcttggatagagaacaaggtaaaaccagacccgcggttgctctatctggcatgtcataatatcattaagaaacgcggccacttcctgtttgagggtgatttcgactcagaaaaccagtttgataccagtatccaagccctcttcgagtacttacgagaagacatggaggtggacattgatgctgacagccagaaggtcaaagaaatcctgaaggattcctctcttaaaaattcggagaaacagtcaagattgaacaagatactggggctaaaacccagcgacaagcagaaaaaggccattactaatctcatcagtggaaacaagattaattttgcggatctgtatgacaaccctgatcttaaagacgcagagaaaaattccatctctttcagcaaagatgacttcgatgccctgtccgacgacttggcttcaatcctcggcgatagttttgaactgttactgaaggccaaagcagtgtacaactgcagcgttctctctaaggtgattggcgacgagcaatacctttccttcgctaaggtcaaaatatatgaaaagcataaaacagatctgaccaagttgaaagccgtgatcaagaagcactttccaaataactacaaaaaggtattcgggtataaccaggacaatgagtcaaagaacaattacagcggatatgttggtgtgtgtaagacgaaaaacaagaaactggtcattaataacagtgtgaatcaggaagatttttacaagttcctgaagcccatcctctctgcgaaatccgagataaaggaggtgaacgacattctggccgaaatcgagactggcaattttcttcctaaacagatcagcaagtcgaacgcagaaattccatatcaactgaggaaaatggagttggaaaagatcctctctaatgctgagaagcacttctcctttctgaaacagaaggatgagaaagggttatcacatagtgaaaagattataatgctgctaaccttcaaaatcccctactacattggacctatcaacgacaatcacaaaaagagctttccagatcggtgctgggtcgttaaaaaggagaaatccccgtctggcaagacaactccctggaacttctttgaccatatcgataaagaaaagaccgccgaggagttcattacaagccgtaccaatttctgtacgtatctcataggtgaatcagtgctgcctaagaacagtcttttgtactccgagtatactgtactgaacgaaatcaataacctccagattatcattgacgggaaaaatatctgcgatacaaagctgaaacaaaagatatacgaggacctttttaaaaagtataaaaagatcacccagaagcagattagcactttcatcaaacacgaaggaatttgtaacaagacagacgaggtgatcatactgggcattgataaagagtgcacctcttcattgaagagttacatcgaactcaaaaatatttttggcaagcaggtcgacgagatcagcacgaagaacatgctggaagagataatccgctgggctaccatttatgatgaaggggagggaaaaacaatcttaaagactaaaattaaggccgagtacggtaaatactgttccgacgaacaaatcaagaagatactgaatctaaaattctctggctgggggagactctcgaggaagtttctggagaccgtgacaagcgaaatgccaggattctccgagcccgttaacattatcactgcaatgcgggaaacccagaataaccttatggagttgctgtcaagtgagtttaaattcacagaaaatatcaagaaaattaactctggctttgaggatgccgaaaagcagttcagctatgacggtctcgtgaagcctctgtttttatccccatcagtcaaaaagatgctgtggcagacccttaaattggtgaaggagatcagccacattactcaagctcccccgaaaaagatattcatcgagatggcgaagggggcagaactcgagcctgcccgaacgaaaacacgcctgaagattctacaggatctgtactcttcctgcaaaaatgacgctgatgcctttagtagcgaaatccagtatctctctggcaagattgagaacgaagacaatctgagacttaggtccgataaattgtacctgtattacacccagttaggaaagtgtatgtattgcggcaaacccatcgagatagggcatgtattcgacacttcaaactacgatatcgaccacatttacccacaaagtaagatcaaggacgatagcatttcgaaccgggttctcgtgtgctcctcttgtaataaaaacaaggaggacaaatatcctctaaagagcgaaatccagtcaaaacagcgcggattctggaattttcttcagagaaacaatttcataagtctggagaagttgaacaggctcacccgtacaacccccatttccgatgacgaaactgcaaagtttatcgcccggcaactggtcgagacacgacaggctacgaaagtggccgcaaaggtcctagaaaagatgttcccagagaccaagatcgtgtactctaaagcggagactgttagcatgtttagaaataagttcgatattataaagtgcagggaaatcaacgactttcatcacgctcatgatgcctatctgaatattgtggtaggtaacgtctacaatacaaaattcaccaacaatccctggaactttatcaaggagaaacgcgacaatcctaagattgcagatacatataactactataaagtgttcgactacgatgttaagcggaacaatatcactgcctgggaaaagggcaaaaccataatcacggtgaaggacatgctcaaaagaaacaccccaatttacacaaggcaggctgcctgtaagaaaggggagctgtttaatcaaactatcatgaagaaaggacttggccagcacccgttgaagaaggaaggtcccttctccaacatttcaaaatatgggggctacaataaggtcagcgcagcttattacaccctgatcgagtatgaggaaaaagtgaacaagatacgcagtttagagacaattcctctctacctggtaaaagacatccagaaggatcaggacgtgcttaagtcttatctgactgatctactcggcaaaaaggaaatcaaaattctggttccaaagatcaaaataaattccttgctgaagattaacggattcccctgccacatcaccgggaagacgggagacagctttgtcttacgacctgccgtgcaattctgttgctcgaatgatgaggtgctctactttaaaaagattatccggttcaacgagatacgttcacagagagagaaaatgggtaagacaatttctccatacgaagacctgagttttaggtcctatatcaaagaaaatctttgtaagaagaccaaagcggatgagatcggcgaaaaggagttctacgacctgttgcagaaaaagaacctcgagatttatgatatgctgctaactaaacataaggacacaatctacaataaacgccccaacagcaccactctggggatgcttaccaagggacggtatgaatttattaatctcaagccgaaagatcagataatcgtcatgctggagattttgaagctgttctgcacaacgagagaagccatcgacttaggcctcatcaaaggtaagcctgctgcaggggttgccaccctgggcaaaaagatttctaaccttgataattgtatactgatctaccaaagcattactggaatctttgagaagaggattgacttgctcaaagtgtga

SEQ ID NO: 3274 - RNA, 4188 nt, synthetic construct
  misc_feature 1..4188: note = Cas9 variant
  source 1..4188: mol_type = other RNA
atgaagaaagagatcaaggactacttcctgggcctcgatgtggggaccggaagcgtcggttgggccgttacagacactgattataaacttctgaaggctaacagaaaagacttgtggggcatgaggtgctttgaaacggcagagaccgccgaagtgcggcgcttacaccgaggggcgcgtagaaggattgagcggcgcaagaagagaataaaactgctacaggaactcttctcccaagagatcgctaagattgatgagggatttttccagaggatgaaagaatctcccctgtacgccgaggacaagacaatccttcaggaaaatactctgtttaacgataaagacttcaccgataagacatatcataaggcataccctaccattaatcacttgatcaaagcctggatagagaacaaggtaaaaccagacccgcggctcctgtatctggcttgtcataatatcattaagaaacgcggccactttctcttcgagggtgattttgactcagaaaaccagttcgatacaagtatccaagcattatttgagtacctgcgagaagacatggaggtggacattgatgccgacagccagaaggtcaaagaaatccttaaggattcctctttgaaaaattcggagaaacagtcaagactgaacaagatgctagggctcaaacccagcgacaagcagaaaaaggctataactaatctgattagtggaaacaagatcaatttcgccgatctttatgacaaccctgatctgaaagacgcggagaaaaattccatttcttttagcaaagatgacttcgatgcattgtccgacgacctcgcctcaatcctgggcgatagtttcgaattactgctcaaggctaaagccgtgtacaactgcagcgttctttctaaggtgatcggcgacgagcaatacctgtcctttgcaaaggtcaaaatttatgaaaagcataaaaccgatttgacgaagctaaagaatgtgataaagaagcacttcccaaaagactacaagaaagtatttgggtataacaagaacgagaaaaataacaataactactcaggatatgttggtgtgtgtaagactaaaagcaagaagctgatcattaataacagtgtcaatcaggaagatttctacaaatttctcaagaccatcctgtctgctaaatccgagataaaggaggtgaacgacattcttacagaaatcgagactggcaccttcctgcccaaacagatcagcaagtcgaatgccgaaattccttatcagttgaggaagatggagctcgaaaagatcctgtctaacgcggagaagcacttttccttcttaaaacaaaaggatgagaaagggctgtcacatagtgaaaagattataatgctactcacatttaagatcccatactacattggacccatcaatgacaaccacaaaaagagcttccctgatcggtgctgggtggtcaaaaaggagaaatccccatctggcaagaccacgccgtggaactttttcgaccatatcgataaggaaaagactgccgaggagtttattacaagccgtaccaatttctgtacttatctgataggtgaatcagttcttcccaagaatagtttgctgtactccgagtatacagtgctcaacgaaatcaacaatctgcagattatcattgacgggaaaaacatctgcgataccaaacttaaacagaagatatacgaggaactgttcaaaaagtataagaaaatcacgcaaaagcagattagcacctttatcaaacacgagggaatttgtaataagacagacgaggtaatcatattgggcattgacaaagaatgcacttcttcactcaagagttacatcgagctgaagaacattttcggcaaacaggtggatgaaatcagcaccaagaatatgttagaggaaataatccgctgggcaacaatttatgacgagggggagggaaaaactatcctgaagaccaaaattaaggctgaatacggtaagtactgttccgatgagcagatcaaaaagatactaaacctcaaattttctggctgggggagactgtcgaggaagttccttgaaacagtcaccagcgagatgcctggattttccgaaccagtgaatattatcactgccatgcgggagacgcaaaacaatttgatggagctgctctcaagtgagttcaaatttacagaaaacatcaagaagattaattctggcttcgaagacgttgagaaacagtttagctatgatggtctggtgaagcccttattcctgtccccttcagtcaaaaagatgctttggcagaccttgaaactcgtgaaggagatcagccacattactcaggctccacccaagaaaatatttatcgaaatggccaagggggcagagctggacccggtacgaaccaaaacacgcctaaagattctgcaagatctctacaacaattgcaaaaacgacgccgatgctttctcttccgaaatcaaggacctgagtggcaaaattgagaatgaagataaccttagattgaggagcgacaagctgtatttatactatacccagctcggaaagtgtatgtactgcggcaaacctatcgagatagggcatgtttttgatacttctaactatgacatcgaccacatttacccccagtccaagatcaaagatgactcaattagtaatcgggtgctggtctgcagctcgtgtaacaagaataaagaggataagtacccacttaaggcggaaatccagtccaaacaacgcggattctggaacttcctgcagagaaataactttatatctttggagaagttcaataggctcacacgtgcaacgcctattagcgacgatgaaaccgccaaatttatcgctcggcagctggtggagactcgacaggccacaaaggtcgcagccagagtgctagagaaaatgttccccgaaaccaagatcgtttattcaaaggctgagacagtgagtatgtttaggaacaaattcgacattgtaaagtgccgcgaaataaatgattttcatcacgcccatgacgcatacctgaacatcgtcgtgggtaatgtttataacactaaattcaccaataacctctggaattttattaaggagaaacgggataacccaaagatcgcggacacgtacaactattacaaggtgttcgattatgacgtcaaaagaaataacattaccgcttgggaaaagggcaaaacaatcataactgtgaaggacatgctgaaaaggaatacccccatctacacacgccaagccgcatgtaagaaagggggactttttgatcagactattatgaagaagggcttgggtcagcaccctctgaaaaaggaggggccattctccaacatctctaaatacggcggatataataaggtaagcgccgcttactataccttaattgaatacgaggagaaaggcaacaagatccgatccctcgaaacgataccgctgtatcttgtgaaggacattcaaaaagatcaggacgttctgaagtcatacctaacagatctcctggggaaaaaggagttcaaaatcttggtccccaagatcaagattaatagcctgttaaaaatcaacggatttccttgccacataaccggtaagactaatgacagtttcctcctgcggccagccgtgcagttttgttgctctaacgatgaagtgctttatttcaaaaagattatccgtttttccgagattagaagccagagggagaaaatcggcaagacaatatcgccctacgaagacctgtcattccgctcttacattaaggagaatttgtgtaaaaagaccaaaaacgatgaaatcggggagaaggaattttatgacctcctgcagaaaaagaatctagagatctacgatatgctgcttactaaacataaggacaccatttataagaaacggcctaacagtgcaacaatcgatattctcgtcaagggaaaagagaagttcaaatccctgataatcgaaaatcaatttgaggttattttggaaatcctgaagttattcagcgctacgagaaacgtgtctgacctccagcacatcggcggtagcaagtactccggggtggccaaaattggcaataagatatcaagtctggacaactgcatccttatttatcagagcatcaccggaatttttgagaaaaggatcgatctgttgaaggtatga

SEQ ID NO: 3275 - RNA, 4191 nt, synthetic construct
  misc_feature 1..4191: note = Cas9 variant
  source 1..4191: mol_type = other RNA
atggacagctccaagcagggcctgagaaggtaccacctcgggcttgatatcggaaccaactctattggttggacagccatagacgatcatttctcactgttgcgggtgaaaggcaagaatgctatcggggtccgcacttttaaagagggagaaacggcagccgaccgacgtggcttcagaaccgcgaggcggcgcttaagtagaaggcggtggcgcctgcaatttctagatgagttctttgctccctatctcgccgaagttgaccctaacttcctggcacgacttaagcagagcgatatttccgccaaagacccagctaagaatcaggagtacatgggtaagctgttgtttccggatcaggaagcagcctctgacgggaacggatatcccacactcatccaaatgagaaaagctatgcctgccgagaaggcggcagatttcccagtgtttaatatttaccagctgaggtatgccctgatgaacgagaaacggaagttcgacctccgtgaaatctacttagctgtacaccatatagtgaaatatcgcggcaattttctgaacaatacttcggtcgataagttcaaggccgaccagatcgactttaacaaatcattcgagacccttaatgatttgttcagacaggtgcaacccattgcaccttttcagatcgacctgacaaaggttgatgaactaggcaaactcctgcttgacaccaagcagaaaaagctggataggcagaaagctgtggccaagttgctcccactgattgaggacgggactgataaggagatcgtcaaagcgcaccaacagacagcccgggaaataagcaagttaattctgggatacaaagcaaaggtgggtctcatccttcagaacaatctggaccaaaccttggatatgagtacggagaactccgacgatcagctaatgcagattgctgaagaactggacgactaccagatggaactcatcaatcaactgtctcttctgtatagccagatcatgttgaacgagattgtacccaacggcgagactgtttccgcctcaatgctcaatcgatactataaacatcgctgccagctgaaggaattaaaggattacggggctgcccaggacaaaaagaccagagagcaactggatcacctatatgcagaatacataggacagatccctaaagacagtaagttcgattttacaaaagacctcaagaagctgatggataaaagcgaccttggccagaagattaaagatgagatcgaagccggtgactatttgccaaagcagaggacttctgctaacggggtgataccgcaccaaatgcatcagcaggagctggatcagattatcgagaatcaaaaagaatactacccctggctcgcggagcctaacccagtcgaaaagaatatcaagaacgcaaaatataagctggaccagcttgtgtccttccgggtgccctactatgtcggacctatgattaccctggccgatcagcaaaagacatcaaaggctagctttgcctgggcagttcgcaaaaaggccggcaaaatcaccccatggaatttctacgacatgattgacagagagaagagtgctaacaattttataaagaggatgacgaacaaagatacttatttgctctctgaagacgtgctgcccgcctccagcttactgtaccagaagttcacagtactaaatgagctcaacaatatccgtgtgaacggccggaaactgcagccggcacttaagcaggcgatttataccgatttgtttcaaaaacgaaagactgtcaatctgaagacactcaccaacttcctggctatccacgagcctacgttaaccaaacccaagatcgaagggctgtcgaacggaagatcttttaattcctcacttggtacatacattgacatgagtaaaatattgggcgatagcctcgacgatctgaactacagggacgatatcgagaagattatcgaatggtccactgtgttcgaggactctgagatttatggggttaaactacaggaaatccagtggctgaccaatgagcagcgcgaaaagctcgtgcggaagagataccaaggatggggcaggctgagcaaaaagttgcttacaggtataactgatgagaacgggcagcgcatcattgacctgatgtgggatacctcaaagaattttatgcagatcgtccatcagccagtgttcgaggagcaaattgccgagttaaaccagcagctcctgcaagacgcagacaaggcccctcttgaagtagttgatgacatcctggctgatgcctatacaagtccccagaataaaaaggcaatacgacaggtggtcaaggtggtcgctgacgtggttaaagccgtgggcaacgcgccagcctccattagcatcgagttcgctcggaatgaagatcgtaacaaggagttgaaaaattctagaaggcactcaattgaaaagctctaccacgagaccgcagagaaactggtaaagcagactaacctactggaggaactcggaaatgtcaaagacctgaacgatcgctattacctttattttacgcaagccggccgggacatgtacgatgggacacccatcaatatagacgaaatcagtacccattacgagattgatcacatcttgcctcagagcttcctgaaggacaactccttagacaacagagtgctcgttaagaaatctgaaaatgctgccaagtcggatagggtgccagcaaaactgtatggagcgaagatgcgagccttttggaaacagcttaaggagagccagctgatttccaaccgcaagtacctaaatctcactaccgacccggagcaagtcgataaatatcagatgcagggtttcgtgcatcggcagctggtagaaacaagacaaatcataaagttggctgccaacatttttggctcactgtaccccgacagtgcagtgatcgagaccagggctgaattaactaaacagctccgtgagaagttctctctgtataaagttcgcgatgtcaatgactaccaccatgccgtggatgcatatcttacagcctttgctgggcactacctgtaccagcggtatcctaagttgagaccaatgttcgtgtacggagactatgcgaagatctacgccgatgacctcaaaaggctgcgaagcgtcaacctatttcacgatctggagaaggaccagtataattccggcacggcagttaaccccgaaaccaaagagaagattgtggatgtggactggctttcagactacgtaagcaaaatccaacatttcaagtatatgctcatttctaaggctgtctacactcagcacggtcagctgtacggggccacaatattgcctgtggcccaagttgataaaatctccgctccaattggcatcaaggacgataaacccgtggacatttatggagcatacaccaatgaagtcgccgcgtatatggctatcgtgcgggttaacggcaagaaaccgaagtacaaggtggtaagtgtccctgtgcgcatgctgcagagattaaaaatggccgagcagaaggggcatgatcagtatatgcaaacactccacgacgtgctgcttaggaattttactagcctgaaaaagaaccggaaaaccggattgaaggaagcagtcgttaaagatttcgacgtgctcgtaccatgtgtgcgatacaatcagctggtcatagatggtgacacgaagtttaccctaggctctgccacatatcagcacaacgctaagcagctggtgctttgcaatcattccctcgagactctggcaaacaacttcgagtacgttagaaaacaccccgatgaagccgacgagcgcatgatcatgttgtacgatgacattttagaccaagtgaatcattatttcaccctgtacgataagaacaaatttagggaaaagctcaatgcggggcgtgacaaatatctgaaacttcctacattctcacagtttgagaacaataagaaaactgctatcggaaagagtgaagccattatcaacatactgcggggcttgcacgcaaatgccgctattaccaacctaaaatgtctgggtgtcagcacgcccttcgggcagctccagtcgccatccggcatcgagctgtctgagaatgccaaacttgtgtaccaaagccctacaggattattttcaagagaagttctgctcaaagatttgtga

SEQ ID NO: 3276 - RNA, 4191 nt, synthetic construct
  misc_feature 1..4191: note = Cas9 variant
  source 1..4191: mol_type = other RNA
atggccaacctgagaaattacaagggcgactataacatcgggctcgatatgggaaccggtagcgtgggctgggctgtcacagactccgaggggaaacttctgcacttcaagaaacagcccacttggggatctaggttgtttgattcagcagaaacggccgcgagtgctcggattcctcgcggccaacgacgtagatacgttaggcggcgctggagattagacctgctacagcagctattccaggatgaggtgagcaaggccgacccagaatttttcataaggctgcggcaatcccgccttctgaaagaggatcgagaagagggtcatagagactataatcacccgttgtttaacgattctgacttcaccgagacagattactataataggtttcccactatctaccatctccggaagtggctgatggaaaccgacgagaaggcagatattcgtctggtatatctcgccgctcacaacatcgtgaaacatcgcgggaatttcttaagacaggaaaacacatcgctgtcagcaaagaatgccaggcctcttgacgctttgcgggagtttcgaagcgccctggtcgactggtgcgcggagctaggatacgaatgtaacccagatgagagtggcgaaatttccaatgagatcctctctgtgctggaagaggagcacgttgcaaacagcgacaaaaagaaacgcatatcctcacttatcggcgtggccatgaatgaaggggctaaggagagtaaggcctgcaacgatgcactggctggagccatggtcggtttgaaagcggaatttaagaatgtgtttggcgagattagcgccgaacagacctctatctacctctccaacgacgaggcagtagatgctctgagagaggggattcccgacgaaggattagagctgttcggcaaactctgttcagtttatagcgcctacgtgcttcagggtctgttgagttatgctcctgggcaaactatctctgtcaacatggtggccaagtacgaaaaatatggaaatgatctaaagacactgaaagcactcgtgtgcgagtacgccagggctgaatatgactcctttttccggggcgagttctaccgcgatcaggacggccacgagctgaacatatacaatgcgagcaaggcacaggggtataccagatacaaccttggaacgtcgaagatgtcttatgaagattttgagaaagccgtcaagaaactgttcgctggtactgccgcagaagaggacggcaggtacttgcagatgatgaaggagtttggggaacaacgtttcctccggcgactgaaaacctccgacaatggatcaatttattaccagttacatctggaggaactaacagccatcctcagtaaccagggcaagcactatccatttctggttgaggatgctgaaaagattaaaagccttgtgtccttcagaatcccctactacgtaggtcctttgactgacaggaatgcccgcaaggataaacatgggaagaaccggtttgcatggtctgagagaaaaagcggcatggaggacgcggtgatcaccccatggaattgggatgaagtcattgacaggggaaagtcagctgaggccttcataacacgcatgaccggcatgtgtacgtatctgcaaggggaagatgtgctcccgaagtgcagtctgctttacgaggaattttgtgttctgaacgagttgaatggatcccgatggggtatggacggcgataaagagcaccggttcgacgcagccgatcgtgaagctatcattgaggaactctttaagaaaaagaaaactgtgaagtataaggacgtcgccaactggctggagagagaagcagggaggatgaatgtgcacgtaatgggaggccagggtgagacagggtacgagagcaaattatcttcatattacttctttcgccgggatatcttcgacgttgaggaactggacagagctgattatcccatgatagaacagattatcctatggaacaccctcttcgaggacaggcgaatcctgaaggagaaacttgaagatgcctacggccctaagggaaatggccgcttggacgatgaccagattaaaaagatctgccggaaaagatttactgggtggggaaggctgagtaagaagttcctcacaggtattaaagtggataccgactgtggcccacgtagcataatggatgtcctgcgcgagggggaccccaacgcgggatttcggggcaagacgatggtgatgatggaagtcttaagagatgagaacctgggtttccaacagaaagtggacgaatttaataagaactacttcgggcagaaaggcaaggcccttgaggttaatgagttgcctggatccccagctatcaggcgatctctcaaccaggcaattcggatcgtggatgaaatcgccaagattgctggcaaagaccccgagtcgatatttatcgaagtaacccgcgacgatgagctggacaagagagggaaaaggacaaagcggcgatatgatgccctaaaagaagcactgactgtcttcaagaaggaggacccggagatttgggcggaactccaagccaccagcccttccgatctggacgagagacttacattgtactttatgcagcgcggaaaatgcctgtattcaggcgaacccatcgatattaataagttaagttctggtgagtacgaagtggaccatatcataccaaggagctatatcaaagatgactccctcgagaacaaggctctggtttgtcgtaaatacaatcagtcaaagactgatgccatgcttctggaccctagcattcggagaaagatgaggtcttattgggacatgttgctcgatgcaaaactgatcgggcccaagaaacaccgcaacctactgcgagaccatattgatgagaaggctatgaaaggattcgtggccagacagctcgtcgaaacctcccaaagtgtgaagctggcaggcagccttttgtctgtacggtacccaaatgccaacatcgtgcccgttaaggcttccatgtcacacgacctgagggaggcggccggttttgtcaagtgccgcgaagcaaatgatttccatcacgctcacgacgcctacttagcctgccgtatgggcctctttatacagatgagacatcctaaggtgtatgagaacccaattgctatgacacgggtgatgcagaaatacgcacagcaacagagtaaggagttcaataggaaccaccgcgtcccggggaccagcggattcatcgttaattcgtttatgtcctctggcttcgataaagaaactggggagatttttaaggacacgtggaacgccgaaacagagatcgaaggaatacgaaaagcgctgaactatagacagtgttacatcagccggatgcccatggaggataccggcgctttctggaatgccactgtgtattcacctagggacccaaagatgggtcccaaacttgcactgcctctcaaaaaggggctcgatcccaaaaagtacggaggctttagttcccaacagttcgcctatttcttcgtgtacgaggctcgcgacaaaaaggataagcaggtatttagattcgcagaagtcccagtgtggctggcctctcagattgagagcgacaaaatcgcgttggaaaggtacgctaccggtctggccgaggcagaaaagttaaaatttgttcggattgagcgtgccaagatcctcaaaaagcaactgatagagattgacggcgatcgcttcatccttacagggaagaaagaaatgcgaaacggaagagagctggctttgtcccagaaggaaaccctcaatctgatcgtggccggcgacgagaacgcatcactagatgacagggggaatgctagcgatgccgtcttcgacgcgattgtgcggcagggagatgaaatcggcctgcgcctttataaacagctcaagattgccgagatagcagagagatacaggagtgttggtgctgacgccaaagtgggggctgtaatgtctctgttgtccagcatcaacgcatcgtcaaatatggtcaacctgtctatggtgggaggcagtaagtatgccggtaatttacaaccgaactactccaatctcctgagcgatcctgaaactaactttgtgattatcgaccagtctgtcacaggcatgttcgagcggcgaacgagaattgggctttga

SEQ ID NO: 3277 - RNA, 4191 nt, synthetic construct
  misc_feature 1..4191: note = Cas9 variant
  source 1..4191: mol_type = other RNA
atgaccaagccctacagcatcggcctggacattgggacaaactccgtgggatgggccgtcataactgatgactataaagttcctgctaagaaaatgaaggtgctcggtaatacgaacagagattacatcaaaaagaatcttctgggcgcattgttattcgacgggggagagaccgccgaaggcaggcggctgaagcgcacagcgcgacgtagatatactaggcggaaaaaccgcctaagatacctccaggagatttttgctgaagagatgatgcaagtagatgaatctttctttcagaggctggacgattcattccttgtggaggaggacaagcagggtagtaaatatccaatctttgggaccctgaaggaagagaaagaataccacaagaagttcaaaacaatttatcatttgcgggaggagctcgccaatagcaaggaaaaagcagatctgcgcctggtctacctcgccttagctcacatgatcaagtttcgaggacatttcctgtacgagggcgaccttaaagcagaaaacaccgatgtgcaggccttgtttaaggacttcgttgaggaatatgataaaactatagaggagtcccacctgtctgaaatcacagtggacgctctatcgattctcaccgagaaggtctcaaagagcagtagactggaaaatcttatcgcccattacccgacggagaaaaagaacactctgtttggcaatttgattgcgctctccctggggttacaagcaaacttcaaaaccaattttcagctgtctgaagacgccaagctccagttcagcaaagatacatatgaggaggaccttgaaggactgttgggtgaggtgggcgatgaatacgctgacctattcgtatccgccaagaacctgtatgatgcaatcctcctgtcagggatacttactgttgacgataatagtaccaaggctcccctgagcgcctctatggtgaaaaggtacaaggagcacaaagaagagttggcggcctttaagcggttcattaaagagaagctccctaagaaatatgaagagatctttaaggacgataccaaaaacggatacgcaggctacgtcggtgctgacaagaaactgcgtaagcgctccgggaagttagccacagaagaggagttctataaatacgtgaagggcattctgaataaagtggaaggagctgattattttctagacaagatcgacagagaggatttcctcaggaaacagcggacgtttgacaacggctcaatcccacaccaaattcatctgcaggaaatgcacgccatacttcgacgccagggggagcattaccccttcttgaaggaaaaccaggataaaatcgagaagattctgacttttagaatcccttattacgtcggaccactcgcaaggaagggtagccggttcgcctgggctgagtataaagcggacgaaaagataacaccctggaattttgatgacattctggataaagagaagagtgcagaaaaattcatcacccgcatgactcttaacgacctgtacttgcctgaggaaaaggttctcccaaagcactctccgctgtacgagacatttaccgtgtataatgagttaacgaaagtaaagtacgtgaacgaacaaggcgaggccaaattcttcgataccaatatgaagcaggaaatctttgaccacgtcttcaaagagaacagaaaggtgacaaaggataaactgctaaattatctcaacaaggaatttgaggagttcaggattgttaatctgactgggcttgacaaagaaaacaaggcttttaatgcctccttgggaacctaccatgatctgcgtaaaatcctcgacaagagcttcctggacgataaggtgaacgagaaaattatagaagacatcattcagacattaactctgtttgaggatcgggagatgatccgacaaagacttcagaagtattcggacatcttcaccacacagcagttgaaagaactcgagaggcgccactacaccggctggggtcggctgtcttataagctaattaatgggataagaaacaaagaaaataagaaaactatcctggattacctcattgacgatggctacgcaaacaggaactttatgcaactgatcaatgacgatgccctttccttcaaggaggaaattgctcgcgcccagatcataggagacgtcgatgacatcgcaaacgtggtacatgatttgcccggcagccctgcgattaagaaagggatcctgcagagtgttaagattgtggacgagttagtcaaagtgatgggacacaatccaacgaacatcataattgagatggctcgagaaaatcagacaaccgacaagggtcggcgtaacagccaacagagactcaaactgcttcaggattccctgaagaatttggacaaccccgtcaatatcaagaacgtggagaatcagcaactccagaacgataggctgtttctatattacattcagaatggcaaagacatgtatactggggaaaccctggatatcaacaatctctctcagtacgacatagatcatatcattcctcaagccttcatcaaggacaacagcctggataaccgcgttcttacacggtcagacaaaaatagaggaaagagtgatgacgtgccatccattgaggtagtccacgaaatgaaatcattttggtctaagttgctgtcagtgaagttaatcacccagaggaaattcgacaacctcactaaggcagagcgaggcggtctgacagagaatgataaagccgggttcataaagcgccagcttgttgaaacgcggcaaattaccaaacacgtggctcaggtcctggacgccagatttaacgcaaagcatgatgagaataagaaagtgatcagggacgtaaagatcattactctaaaaagtaacctcgtgagccagttccgtaaggattttaaattctataaggttcgcgaaatcaatgactaccaccatgctcacgatgcctatctgaacgcggtcattggcacagccttgctgaagaaataccccaagttagcttccgagtttgtgtacggagagttcaaaaagtatgacgtgcggaaatttatagcaaagtctgataaagaaatcggcaaggccaccgctaagtacttcttttattcgaatctcatgaacttctttaaaaaggaggtcaaattcgccgacgggacagttgtggaaagaccggatattgagactagcgaagacggagagatcgcatggaataagcagaccgatttcaaaattgtgaggaaggtactgtcctaccctcaagtcaacatcgtgaagaaaacggaggttcagacccacggtcttgaccgaggcaagccccgggggctgtttaatgcgaacccatcacctaaacccaagccagacagttctgaaaatttggtgggaataaaacgcaacctcgatcccaagaagtatggcggttacgccgggatcagcaactcctatgctgtcctggtgaaagccattatcgagaagggcgttaaaaagaaagaaacaatggtgctagagttccagggaatttcaatcctggacagaataacttttgaaaaggataagagggcattccttctcggcaaagggtacaaggacattaaaaagatcatcgagctgcctaaatacagcttgtttgagctgaaggatggatctcggcgaatgttagcttccattctcagtaccaataacaaaagaggcgaaatacataagggtaatgagctgttcgtaccacagaagtttacaactcttctgtatcacgccaaacgcatcaacaatccgattaacaaggaccatatcgaatacgtcaaaaagcacagggatgacttcaaagagttgctcaattatgtgctggaatttaacgagaagtacgtgggggcaaccaagaatggagagcgtctaaaagaagccgtcgctgatttcgacagcaagtctaacgaggaaatttgcacgtcctttctgggcgcggttaatagtaaaaacgccggtcttttcgagctcacatcactgggcagcgcatcggattttgagttcttgggggtgaagatcccccggtatagagactacaccccttcctctttactgaaagatagcatactcatccatcaatcaattactggactgtatgaaacaaggatcgaccttagtaagctgggcgaggactga

SEQ ID NO: 3278 - RNA, 4191 nt, synthetic construct
  misc_feature 1..4191: note = Cas9 variant
  source 1..4191: mol_type = other RNA
atgaagagagtgaacgaggactacatcctgggcctcgatattgggaccaatagctgcggatgggccgtcacagacaaaaagaacaatcttctgaaattgaggggtaagactgctataggctcccacttattcgaagaggggcatacggcagccgatcggcgcggatttcgaaccacacgtagaaggctgaaacggcgcaagtggagactaaggctcctggaagagatcttcgcggaacccatggctaaggttgaccctggctttttcgtgcggcttcaccagtcttgggtatcaccactggataaagaccgcaagaaatataacgccattgtgtttccgactgcaaaggaggatcaagccttctacaaacattatgctaccatctaccacttgcgagacgagctcatgacacaggatagacagtttgacctgagggaaattttcctggcaatccatcacatagtcaagtatcggggtaattttctccaggatacccccgtgaaggacttcgaggccagtaaaatcgaagttgggcctattttaagccacatcaacaatgcttttgccgagaagattgtggaggatcaagacccaatcgaactgaacgtcgcgaatgcagccgacatagaggatgtgattcgtggaaaagacgctgaaaagactgtatacaaacttgataaggttaaaaagatcgccaagttgctgacagactccaccgcaaaagaggaaaagaacgtggctaaacagattgccaatgcgatcatgggctataagacgcagttcgagactatcctagataaagagattgacaagtctgataaggcccagtgggaatttaaactctcggacgcagatgctgacgataagctggacgcccttctgcccgacttggatgagaccgaccaaacagtcgtggctgaaatagagaaactcttctcagccatcactctgagcaccattgtggatgaaaacaagagtttatcccagtctatggtcgagaaatacaagaagcataaaaaggactacaaaaagctgaaaaagtatatcaatacactccaggatcagaccaaggcaaagaaacttctgttggcctacgacctatatgttaacaatcgccacggcagactgctcgaggctaaaaagacgttcgaagataaaaagaaaaagaaggcgctgactaaagacgagttttacaagatagtgaaagataaccttgacgatagcgacctggcacatgaaattcaacaggagatcgccgctgataacttcatgcctaagcagaggacaaattccaacggggtaatcccatttcaattgcaccagattgaactcgacaaaatcattgccaatcagggaaagtattaccccttcctggcagccgagaaccctgtggaggaccaccggaagcaggctccatataaattagatgaactggtccgatttcgcgtgccgtactacgttggtcccatgataaccgccgacgagcaagaaaagacttcaggcaaaagtttcgcatggatggtgagaaaggaggatgggcagatcacaccttggaattttgagcagaaagtcgacaggcaggaaagcgcgaacaagttcattaagcggatgaccatcaaagatacgtatctactctctgaggacgtgctgccagctaattcccttttgtaccaacgctttgaagtactgaacgagctcaataacatcagaattaatggatcaaggataagcgttgatctgaagcagcagatcttcaacgacctttttgaagagaaaaagaccgtgacagagaaaagtctgacttcttatttgaagcagaatctccatctgcccaccgtcgaaattaagggcttagccgatcctacaaaattcaactccagcctggcatcgtactatcacctaaagtctctccatgtgtttgacaaagagctggccgatccacaataccagaaggacttcgaaaagatcattgagtattcctcaatcttcgaagataagaaaatatttcaggacaaacttcacgctgagttcaagtggttgactcccgagcagtttaaagccatcagtacctggcgtctgcaaggttgggggcggctcagccgaaagctgttagtcgaactgcatgacacaaatggacagaacattatggagcagctttgggattcccagaaaaacttcatgcagatcgtgaccgaaccggactttaaggatgcaattgctaaagagaatcagaacgttactagagccaatggcgtggaagagatcttggcggacgcctacacgtctcctgctaacaagaaggcaataaggcaggtagtcaaagtggttgccgatgtggtcaaggctgccggcgggaaaaagcccgcacaattcgcgattgagtttacacgcgacccagataaaaatcctcagctcagccacatccggggaaccaagctgctaaaggcctaccaggaaactgctggtgagctggtggaccagaaactcaccgattcactgaaggaagccatgacaagtagaaaacttttgaaggacaaatatttcctgtactttatgcaagcaggcagggatgcttataccgggcagaagattaacatcgacgaggtatccactaattaccagatagaccacatcttaccccagagcttcattaaggatgactcttttgataaccgcgtgctcacagccacgccactgaatgcagagaaatcagacgatgttccctataagcgattcgccaacaattacgtcagtgacatgaaaatgaccgtgggagaaatgtggaagcattggcaaaaagctggcatcattaacaagcacaaacttggtaatctgttgctcgatcctgaccggctgaacaaatttcaaaagagcgggttcatcaatcgtcagctagtggagacttcccaaataattaaactggtctctgttatcctccagaacaagtatccagatgcggaaatcattacagtgaaagccggcgacaactcggcactgagacagaggcttaatttgtacaagagccgcgatgtgaacgactaccatcacgctatcgatgcctatctgtccattatatgtggaaatttcttataccaggtatatccgaaataccggccctattttgtctacggcaagtataagaaattctcacaagaccctgacctccagaaggaggtgatcaaacactttaaggggttcacctttatgtggccactgcttcagaaagataacagtgaaagaaaggcccccgagaagattaaagagaataactctgacaggatcgttttctacaagcatcctgatatttttgacaaactgcgaaaggcttacaattataaatacatgctagtgagccgcgaaacaactaccgagaactccggactcttcgatgtcacgatctatccacggggtgaaagagacctggcaaagaccaggaagttgatacccaaatcaaatggcctggatccgaagatctacgggggatatagcggcaacacagacgcctacatggtgattgttaaaatcgataagggtaaagagtctatttataaggtgatcggggtacctatgcgtgcgttagcttccctcaatcgcgccaagaaacagggcaactacaaggaggaactgcaccaagtccttgagccacagataatgtttgacaaaaatggaaagcccaaacggagtgtgaagggcttcagaattatcaaagatcatgtgccttttaagcaggtcgttctggacggggataagaaattcatgttgaacagctctacttacgaaatcaatgcaaagcagctcaccctgacacccgagactatgaggattgtgaccgacaacctaaagaagggagaagaccaagatcagctgcttgtaaaagcctatgacgagatactccagaaggtggatcagtacctgccattgttcgacgtcaacaagtttcgaaattccctgcacttaggtcgggctaaattcctcgatctggcagtgaacgacaagaaaatcacgcttacaaatattctgaacggcttgcatgataatctcgttacccctgacctgaagaacatcgggattaaaactcccctaggaaagctgcaagtgccatcaggcatcgtccttagtagcgaagccatactcatctttcagtcgccgacaggtctgttcgagaagcgcgtgagaattgcggatttgtga

SEQ ID NO: 3279 - RNA, 4194 nt, synthetic construct
  misc_feature 1..4194: note = Cas9 variant
  source 1..4194: mol_type = other RNA
atgaaggactacaacatcggcctggatattgggaccagctccataggattcgccgctatcgacgatgacaataacctcattagagtgaaaggtaagaatgtcatcggctctaggctttttgcagaggggaaaacagccgcggaacggcgcggattccgaactgctcgtagaaggtataaccggcgcaagtggagactgaaattgttagatgagattttctacgaagagatcatacacatcgaccccgagttctttaataggctgaagcagtcaagtattagccctaaggatgagtccaaaaagtatttcggctctctactctttccagacaaaacggattcggcctactatcatgacggtaaccaaaccatctaccaccttcggaatcgccttgttcatcagaaggagaaagcagatattcgagaaatctatctggccttgagacacatagtgaagtacagggggaacttcctcgactcaacaccggtaagcagttttgaggctgataatctgaagctggacgaactcgtgcccgtcattaacgacatgtacgagaatatcgatattgacttctccatcaacgtggataatatctctgagattgaaaaagttttactggacaaccatcttaagagcgcagataaacaggaccggttgaaggagctgctatatgataatcctgaatacccagacgataaagtgaagcagaaagagatatccaagtttcgtaaggacctcgataaagaaatcattaaggtcatcgtgggatataaattcaacgcctacaagatagtaaactatattcccgacgacggctcaaaatttagtttcagcttctctgatgagtcctcagacgataagctggacgatcttagcgaggttctggacgatagtcaaatggaaatcttgaatactctcaaggtgatctactctcgcgtcagactgaaccagattatccctaatggcatggggttatccgagagcatggtggctaaatataacaggcaccacgaacagctggaggacctcaaggaacttctggatgtgttgccaaatgacgagaaacggtcgattgagtacgcctacaccgcgtatataggaaacgtcgataagcagaaatacaataacaatctagttgcatctctgaaggacctccccatcaagggtgatattaacaaaaagatccaagccgtgtttgaatatgctaaaggccatatctcctcacaggacctgtacgacgtaattaagacaataatcattgataaatatcttgaggacgaaagtttcgagtaccacgatctggtggaacgaatcagcaatgacattgataacaaggactatttgctcaagcagcgctcctctcagaatgggaacatccctcatcaagtccaccagatggagatggataaaataatcgccaatcagagccaatactacccatttctgggagtgttaaacccgaacgagtcaagaaggcacattgcaaagtataaaatcagtgaactggtttccttccgggtgccctactatgtcggccctctaattaccccagaggaacaggagaagactagcggtaaacattttgcttggatgaagcgcaaagaggccgggaagatcacaccctggaatttcgaagagaaggtggacaaagaagcgaccgccgcaaagtttataaaaagactcacggtaaaggatacttacctgcttaacgaggacgttttgcctgataattctctgctctatcagcagttcaaagtgctgaacgaacttaatattgtcaaggtgaacaataagaggctgaccttgtcagagaaacaaggagtctacaacgacctctttaagaatacaaaaagtatcactgtgaagcgtctgaaaaactatttaattagcaattacaagcacctggagaacatcgaaataaccggcctatccgatggcgacaagttcaataactctctcgggacatacaatgactttaaaaagatcttcggagctcggattgatgacgttaactattcggccgattttgagaacatcattgaatggagcaccgtgttcgaggaccgatccatcctgaaagaaaagctggagaaagatatagactggattacgccagaggaaatcaaggctgtagtcgccaagagatactcaggttggggcaggttgagtgcaaaactgctcactgagctgttagatgacgatgggcagcgcatcattgacatcctgtggaatgattctattacattcatggaagccgtgagcaagcccgagataaaagctcagatccagaacattaatcgggactttatcaaggcgaccgacattgaaactgttcttgatgaggcatatacatccccgcaaaacaaaaaggccatcagagaggtgtacaaattggtcaaggacatacagaaggctatgggaggcaaagccccttcaagcatctctattgaatttaccaggtcccccgaggataatggtagtgtgacgaagacccgctataacaatatgcagaacaaatacaaggaactcgggaaagagctgagcgacgatctatctgcacagctgaaggagtataagggccgaatggaccaagataaattttacctctacttcatgcagatgggaaaggacctgtatgatggctccacaatcaatcttgacgatttgaactcataccagattgaccatatcgtaccacagagtttttataaagatgacagcatagacaatcgggtgctgactcactacaccaacaatcaaaagaaagggaaccatacacctttaaatggactcaacattgatgcccagactcagaacctgtggaagcaccttaataagctgggtttgatctcgaaaaagaaactccaaaacctgtgcttcaaggacatcaatcagctatccaaatataccaagcacggctttgttcgtagacagctggtcgaaacatctcaggtgattaagctcgtggctaacatactgagcgatgagttcgccaatgacgggaccaaaatcattgaagtcaaggcaaaaatgaactcacttatgagggatacttttaatttgtacaaggttcgccaactgaacgactatcatcacgcggtggatgcttacttaacgacattcgtgggaaaatacctctataagcggtaccccaagctgagaagtatgtttgtatatggcgacttcaaaaagttttccgccgaggatgaccttaaagatatcaagaccttcaatttcctgcatgacattactaacccaaaagaatctaataaggagaaaatctacgatgaaaagagcggtgaactaatactcgacaggaagcacgcaatcgagaccattaaaaagatctatcagtacaaatttatgctgattgtccgagaagtgtccacaaagtcagggcagttgttcaaacagaccatctatagcgccaagaagactaacggcctgaaaagtgctatacccgttaagtctaatttagagccttccatttacggataccgcagcggcaacgtggaccaccatatggtcatcgtgaaaatcaagaaagggacaaagtattcgtttaaggttattggaatctcagcccgggcaatacaagaactcgagattgctaaaaagatcggtaattacagagataaactgtatgaggtggtatctgacaggcttagtcagtccatgaaaagcgtcgaatctttccgtattatcctggataacataatgtacggccagttgattgtggacgggaatgataagtttacgctcggaagcgccgactatcgcaagaactcccggcagctggtgctatgtaccaactcactgaagatccttaaagatgaggactacatgaatagactcagtgatatccaaaggagcaagctgatggtccaggtttatgacgaaattatcaaaattatgaagaacaaatactctttgttcatatccaatactgagaagctgttagaaaaacgagatatcttttgcggcctctcattcgacgagcagaagattgtgatctggaagatcattatagacctgcacaacggtccatttacaaaaatccaagagcttgggattaataacaagatgggcaccttccagacaaaacatggaatcattctgactgaaaatgcgatcgtaatataccagagtccgagcggcttgtttgagcggaaggtgcgcctcaaagatctgtga

SEQ ID NO: 3280 - RNA, 4194 nt, synthetic construct
  misc_feature 1..4194: note = Cas9 variant
  source 1..4194: mol_type = other RNA
atgaagaaagtgctgggcctcgaccttgggaccaacagcatcggatgggccctggtcaatgaggctacaaaggaagagaaaaaggaaggtaaatcctctgagattataaagttgggcgttagagtgaaccccttaactgtagatgaaaagacgaatttcgagaaagggaggcctctgtcaaccaacgcagaccggacactaaagcgcagtgcccgacgtaatctccagagatacaaactgaggcggcgcaaccttatcgagattctgatcaagaatggatttattactaaagataccccattgacagaaaccggcaaggacactacacaccaaaccctcaagctgagagcgaaaagcgctaaggagaaagtggatctgaaggacttcgccaaaatcctcttaacgataaacaagaaaaggggttataagtcctctcggaaggtcaattcggatgaagacgggctggcaatcgatggaatggccgtggctaaacatctttacgagcagaacttgactccgggccagtatgttctgaatctactccagaagaacaaaaagtacgtgcccgacttttatcgctcagatctgcaagaggaatttaaaaatatttggaacaatcagaagacctactattttgacatccttacagatactctgttcgaggaattgaaggacaaaaacaagagccagacctgggcaatttgcaaaaagccttttgacatcgccggcataaaacagattgggaaggctagtgataagcgactcgagagatacaaatggaggacagaaggactgacccaaaagttaaacctggagtacctcgccatcgcgcttcaggagattaataacgacatcaataaatcctctggttatctgggcgcaatcagcgatcggtccaaggaattgttctttaacaaagagacggtcggggaaaatctataccgtcagctggtgaagactccacacacatcactccgcaaccaggtattctatagacaagactacctggatgagtttgaaaccatttgggagactcaggccaagttctatccccagcttacacataccctgaaagaggaaataagggacgttatcattttctaccaacggaagttgaaaagtcaaaagagcctcatctctttctgtcagttcgagtcctgggaacagacgtatatagagaaagaaaccggaaagtcaaaaacacgaactgtgggccgcaaggtcattcctaagagcagtccactgtttcaggagttcaaaatctggcagaatttaaactctctggagtttagaaattccgatgaaggtgagatcattgagttcatcaagctagacgaagatattaggcagaccgtgtttgaggaactcaacctgcgggggaatcttaaacccaacgacgtgttgaagatactgggaaattacatcagcctcggcaaagtctcgcagtggaagtgcaacttcgaggaaattgagggcaatcgcacaaacgctgccctgtacaacgtttatcaaatcatcgcagaaaatgaggggtacggatttgattgggctaagaaaactgcctctgagattaacaaggaacttaaaaatatattccctcagctgggtatcgacgcgtccattttggactttgatttcacccaggccaactttgacaagcagacatcatatcaactctggcacctgttatacagtgcagaggaagatttcaaaatcagcgaggaagacaaggtgctgtatggcaattcctctgtaagcctaaagaaaaagctccatcagaaatacgggtttaagccagagtataccaaactgcttactaacatttcattgcagccggattacggaaatctgagtgctaaggccatctgtaacatactcccctacctgaaggagaataacgtgtattccgaggcttgcgacttaacgggctacaatcacagcaacttcctgacagccgaagaacaggcaaaaagacctcttaagccaatcttggagctcctgaaaaagaactctctaaggaatcccgtcgtggagaaaattctgaatcaaatggttaacgtggtcaaccaggtgatcgaaacctatggtaagcctgatgagattcgtatcgaactcactcgggagctgaaaaagtcagccaaggaacgagctaatatgaccaaaagtatagcggacgcaacaagaaggaacgatgactaccgcaagaccattatcaaagagttcgggattccaaatcccactaagagcgatgtagttcggtatagactttggcaggagttggcctccaggggctacaaagacatctttacagatacggaaataaagccgcaagagctgttctctaacaagatcgacattgaacacatcattcctaaggctttactctttgacgattcgttcagcaataagaccctggcctttaaaaaggacaaccttaaaaaggcaaatcgcactgcctatgatttcatcgctaacgactacgcccccaatctggagaactacatagaacgagtggagtccttgcataaggatcggaaaattacacgtgcaaagagaaataaactcctgatgctacagtcaaagctgccagacggatttatcgagagggatctccgcaacagtcagtatatcaccaaagaagcgaagaagatgctgtacgaggtctgtcggacagtggtctctactagcggctccattaccgacaaacttagagaagattgggacttgatcaatgtgatgaaggagctgaacttccctaaatataaggctttagggctcacggagaaaattgaaaggtacgatataggagccgagaagatgaaggaagttgagatcattgaagactggaataaacgaaacgatcaccgccatcacgcaatcgacgccctgaccgtggctttttcaacacacagccatattcagtatcttaaccacctgaatgcccggagagacgagggtcataagaaacacgcagctatcatagccatcgaatctactattaccgagaaggagggcaacaaaaagaggcgtttcatcgcgcccctaccaaattttcgcctccaagccaaagaacatattgagtccatcctggtaagtttcaagaacaagaataaagtcgtgacaaacaatataaacaagactaaacggattaagaaagataagtttaataccaaggttcagttgacgcccagagggcagctgcacaaagaaacaatctacggaaagatcaaacagcctttagagaagcacattaaactcaacaagagcttcaccctggagcaagctaaacttataatcgacaaaaggcagcgagaaaaggtgctgaatcatttggagaaatatgcacacaactctgatattgccttcaattccaagactctcaaaaagaacccactgctaatctcagacgaaccgctgaaggaggtcctttgctttgaagaggtgttcacaattcggaaagatatcagttacgacaattttaagaacgagaaacagctcgataaggtaatagacgaaaaagtgaagcaggctctgaaagagcgcatcaatcaatacaacggcgatttcagagaagcctttagcgacattgagaggaaccccatctggttgaataaggcaaagggtatttgtgttaaacgggcgaccatcaagggggtctcgaacgccgaacctctgcatactgctaaaaatcacttaggcgaggaggtgctcaccgaaaacaaggagcagataccagtggattatgtctccacaggaaataaccaccatgttgccatttacgaagacgaggacggcaatctgcaggaaaaagtggtgtctttctatgaggcagtaatccgagtcaacgaggggcttcccatcattgataaggaatacaataagagcctgggatggacgtttaaattcaccatgaagcaaaacgagatgtttgtgttcccttcagaagactttaatccaactgagatcgatttgctcgaccagaaaaacgctagtctgatatcccccaatctattcagagttcagaagttcacaattaaagattactttttccgccaccatctggagaccacagtggaaaacaataacactcttaagaacaccacgtggaggcgtgagggtctctctggcatctatgggattatcaagatacggctgaatcacttgggagaaattgtccaggtgggcgagtattga

SEQ ID NO: 3281 - RNA, 4194 nt, synthetic construct
  misc_feature 1..4194: note = Cas9 variant
  source 1..4194: mol_type = other RNA
atgaacgagaataaggaatggttcctgggcctcgacatcgggaccgccagcgtgggatgggctgcaacagatactaactacaatcttctgaaattgaagggtaaaaagtcctggggcgtcagattatttgacgaggcccagacggcgaaagaaaggcgggattgccgctctaagcgacgtagactggctaggcggaagtggcgcctagggctcctggaggaacttttcgccgaggagattaacaaaatagaccccaactttttcatgagactgagggaatcaaagtataaagttagtgataagaccggaaatgtgcctagcatcttgtttaatgagaaaaactacacagacaaggaatattaccggaattataagactatttaccacctccgcgcagatctgatccataaaaacaatccagacattcgagagctgttcctcgccatccaccatatattaaagtatagaggccactttctgttcgctggtcaacagtttaaagggtccgagatcaaggataacattagggaacttttgcagtacaattctctgaacatcaaaattgacatcaccgatgagctaataaataacattgcagaaatcctcctgaagaaaaagaactcgacagacaagattatcgagttcaaaaagctgtttgccgatgaaaaacagcttatcgaggctttgcggctcgccctgggaaataagacccaattagcgaaactgttcgacattgaggcatacaaggaactcgacatatcaatcaagactattagctttaaagagaagatctatgaagatgtacgtagtaactacgaggaaatacttggcgagtatattatcgtgctggacacagccaaattgatctacgatgctattatcctatccaagattaaaataaagaatatgaccatctctgagagcaaggtcgtgtcctatgaaaaacatggcaaggacctgaaacagctcaagcacctgattaaagaggattgtaaactttcaaagaaagaaaagcgccagctgttcgagaacatcttcgttaaagaagacgagaagggggccaattacgtgaactatatcggaaagaataacgcaggtagtagcaagtcttcctgctcatacgaggattttaaaaagttcttgacgaaggaactcaaatgttgcgaggaaagcaagctgaaacaggacattttagctgagctggagctagaaacttttctcccgagacaaaggaccaaggataatagtgtcatactgtaccagatccacaaagaggaacttgagaagattttgaacaatgccgtgcagtatcatcccttcctgaacaatacagacgaatacggcatctctattaaggagaaaatcatacagctcctggagtttcggatcccttattacgtagggccacttaacacttcccacaaggttggagatggcggtttcagctggtcggtgcgaaataaagggtatgaacatattgcggtcaccccctggaactttaacaaggtgatcaataaagaggaatctgccaagaacttcattgagaatctgacaaaccaatgtacctacttgctctatgaagacgtgctgcctaagcactccttactgtactcagagtttgcactactcaatgagctgaacagtatcaattacggaggcaaacgccttacggtcgaacacagaaacttgataattgagaggttctttaagcagagcgctccaaaagccactggcaaggaactgaaaaagttcctcatgtccgagggggttatcgacggaaaggatgaactgtctggttttgacgtgagcattaaaaatgatttaaagtcatatcgggacttcaaaaagatcctgggcgataaattcgacagtgagaaggtagagaaaatgatacgctggatcacactttttggggaatccaagcagttgctcgtggataagattaccaaagagtacggagacatctatagcctggaagagattaagaaaatctctggcctaacttacaaggattggggtagactgtcagagaaactcctgacagaaatagtcagtagccaactttatgacgagtccaccggggaatgcttcaacattatcaatgctatgaggaacaatacgttgctgtttatggagttactcggcaccaactacgattatttcgaaaagatcaatatttacaaccgtcggctgcgaaaggagatcacagagattactccccatatacttgacgatctgtacgtgtctcctgccgttaaaagatcgatctggcaagtggtcaggattgtggaagagttgaagaaaatcattggaagcgaaccaaagcgcatctttgtagagaccacacggtccaacaaagaaaagaagggcgacgacgggagaaaagattcaaggaagaaagcactcctggagctatataagaaaataaagacttccgacatcgttgagctggaaaaggccctcggacacaccgtggatttcgacaaaaagaaacaggatctgacagacattgataataacaaacttaaggctcgcaagttgtacctgtattacacccagttaggtcgatgtctctatactggcaaggcgatcgacctgaataaccttctgtctagcaattccgagtacgatgtcgaccatatttatccgcagtcaaaaacgaaggatgggagctggaacaatctagtgctcgtcaacaaaacagaaaattctaagaaatccaacggactgatcagtgagagcatacagcggaagaataaacacttttggcgtttcttgaaggcaaagaacctgatttctgaagagaaatacaagagattaaccaggactgaggactttaccgatgacgaactctccggcttcatcgcccgccagctgatcgagacatcacagagtgtgaaagctgttagccaaattcttcagaatctgaaccccaccactgaaatatgcttttcgaaggccgagaatgtgcatgacttccggcaggagtttggtaaaatcaaggtagggaagagaaggaacttgacagaagaacagcaaaaagaagcaaaggagggccagctcattaaagtccgagatctgaacgacctacaccacgccaaggatgcttacctgaatatcgtggttggaaacgtgtatcatattaaattcacgcgcaatcctaagaacttcatccggaagaatagtaaaaacagagaatacacccttaatactctcttttattctgacaagatagagaggaacggcgaggtcgcctgggaaaaagggaagacagagaaaatcgtgagctcagtaatgtgtaataacctgattaatgtgacccgtcgcacaagtgaacagaagggagcattgtacgatgcgactatctataaggctaacgccgcaaaagagggttcctactatccagttaagaccaaaaataagaacctgaaagacgtcacgcggtacggcgggttcacctctattaagatcgcctactatagcatatttaaatacgatattagaaataaggacaaggtgaaagaaaacatcaagatcattcccatccctatatatatttcccagaatatcaaaacagatttagacctcattaacttcgctgagaagcaaatcaaactgaagaagggagagaacatagaaaatcttcagctgatttacaaaaagttgaacatcggcgccctcgtgaaaatcgattattacccatattacgtcggtgggaagactaatgacaacttttacattgacggcgcagttcaggtgctgctatcaagcgatatcgagaggtatctgaaagaagtggtaaagttcgtcaattttcaacgagagaacaaggaagctaaagtgagtaaggagcacatttcttccgaggaaaatatagagctttacaacaccctcctgtgcaaaatgacagccaagatcttcactcataccaaaaataacaagtataatgacttggcgcaggataaggccaaaaacacgtttaagaatttaagcctggaggagcagtgtaaagttctcctggagattcttaacctgttgacaaataagaaaaccactttcgacctatcgctgatcaacgaaaaggcttcacgggtgaaatgcggatttaacctcctgaatcagaagcaattctctatcattgagcagagtgtcacaggcctttacgaaaaggagataaaaatcattgaagattga

SEQ ID NO: 3282 - RNA, 4197 nt, synthetic construct
  misc_feature 1..4197: note = Cas9 variant
  source 1..4197: mol_type = other RNA
atggagacccaggccagcaaccaactgatctcctctcacctcaagggctaccccattaaagactatttcgtggggcttgatataggaacatcaagtgtcggttgggctgttactaataaggcatacgaactgttgaaatttagaagccataagatgtggggctccaggttattcgacgagggggaatctgccgtggcgcggcgcggatttcgatcgatgcgtagaaggctggagcggcgcaaactaagactcaagctgcttgaagaactgttcgctgatgccatggcacaggtagaccctacgtttttcatgaggttgcgggagtcaaagtatcactacgaagataaaaccacaggccatagcagtaagcacatcctctttattgacaaaaactataatgatcaggactacttcaaggagtatccaactgtgtaccatctgcgctccgaactgatgaaatctggtaccgatgacatccgaaagctctttttagccgtccaccacattctgaagtacagagggaacttcctttatgagggagctacatttgatagcaatgcatccaccttggacgatgtgatcaaacaggccctggagaacataactttcaattgctttgactgtaactcagctatcagtagcattggccaaatcctaatggaagccggcaagacaaaatctgacaaggcgaaagcaattgagcatctcgttgatacctacatcgccacggacactgtggatacctcctcaaagacacagaaagaccaggtcaaggaagataagaaaaggctgaaggctttcgccaatcttgtgctggggttgaacgcaagcctcatagacctgttcggaagtgtagaggaattagaggaggatctgaaaaagctccagattactggtgacacctatgatgacaaacgggatgaacttgctaaggcctggtctgacgagatctacattatcgacgattgcaagtccgtttatgacgcgatcattctgttgagcataaaagaaccgggcctaacaatctcggagtctaaggtgaaagcctttaataagcacaaagatgacctggcaattctcaagtccctgcttaagtcagatcgtagtatctacaacaccatgttcaaagtcgacgaaaaggggctgcataattatgtgcactacataaaacaaggacgcacggaggagactagctgtaacagagaagatttttacaagtataccaaaaagattgtggagggcttgtccgactctaaggataaagaatacatcctcagccagatcgagctgcagattttactgcccctacagaggatcaaggacaatggtgtcattccttatcaactccacctggaggagcttaaagctatattggccaagtgcgggccaaaattcccctttctgaacgaggttgctgatggattctcagtggccgaaaagctcatcaaaatgctggagtttcggattccttactatgtaggcccacttaacacacatcacaatgtggacaacggcgggttcgcatgggccgtccgaaaggctagtggacgcgtgactccctggaattttgatgacaagatcgacagagaaaaatccgcggcagccttcatcaagaacctgacaaataaatgtacctacttgctcggtgaggatgttctgcctaagagctctttactgtattcagagtttatgctactcaacgaactgaataacgtgaggattgacggcaaaccacttgagaaggtcgtgaaggaacatttgatagaggctgtattcaaacaggatcacaagaaaatgacgaagaatcggatcgaacagtttctgaaagacaacgggtacattagtgagacccataagcacgagatcacaggactcgatggcgaaattaagaatgacctggccagctaccgcgatatggttagaatcttaggtgacgggttcgataggtccatggcagaggaaataatcactgacattaccatcttcggcgagtctaaaaagatgctgcgtgaaacacttcggaaaaagtttgcctcgtgcttggatgacgaggctattaaaaagctcactaagctgcgatatagagattggggaaggctaagccaaaaactgctcaacggcatcgaggggtgtgacaaggccggagacggtaccccggaaacaataattatcctgatgcgcaatttctcctacaaccttatggagttgctgggcgataaattttcattcatggaacggattcaggagatcaatgcaaagttaaccgaagggcagatagtgaacccccacgacatcattgatgacctcgcgctgagtcctgctgtcaaaagagccgtgtggcaggcacttaggatcgtcgatgaggtggcccatattaagaaagctctgccagcccgcatctttgttgaggtgactcgatctaacaagaatgaaaagaaaaagaaagacagccggcaaaagcgtttgtccgatctctatgcagctattaaaaaggacgatgtactgctaaacggactgaataacgagatattcggcgaactcaagtcaagcctggccaaatacgacgatgcggcccttagatctaagaaattgtatctgtactatacgcagatgggtaggtgcgcttacacaggggagatcatcgagttatccctcctgaataccgacaactacgacattgatcacatctatccccgcagtcttactaaggacgatagctttgacaatctggtcctatgtaaacggaccgcaaacgcccagaagtctgatgcttaccctatttccgaagagatacagaagacacaaaaaccattctggacctttctcaagcagcagggcctgatctcagaaagaaaatatgagaggttgactcgaattacacccctgacggccgacgatttaagtggattcatcgcacgccagctcgtggaaaccaatcaaagcgttaaggcggccactacactgcttcggagactgtacccgggcgtggacgtcgtgtttgtaaaagctgagaacgtgaccgatttcaggcatgacaataactttattaaggttcgttcgttgaatcaccaccatcacgccaaggatgcatatctcaacatcgtcgtggggaatgtgtaccatgagcgcttcacacggaacttcagagcctttttcaaaaagaacggagctaataggacttataacctggcaaaaatgtttaattacgacgtcaactgcaccaatgccaaggatggtaaggcttgggacgttaaaacgtccatggacaccgtgaagaaaatgatggattctaacgacgtgcgagtaacaaagcggctactggaacagactggcgcgcttgccgatgcaaccatatacaaagctacagtcgccgggaaggccaaagacggagcttatatcggcatgaagactaaaagctcagtgttcgcagatgttagtaagtacggtgggatgaccaagattaaaaatgcctattccatcattgtgcagtacacgggcaagaaaggagaggtcatcaaggaaatagtgcctctccccatttatctgacaaaccgcaataccactgaccaggatttgatcaactacgttgcgtctatcattccacaagctaaagacataagcatcatttatggcaagctgtgtatcaatcagttagtgaaggtaaacgggttttactactatctcggaggcaaaacaaattccaagttctgcattgataacgccatccaggtcatagtgtcaaatgagtggatcccttacctgaaagtgcttgaaaagtttaacaacatgagaaaagacaataaggatctgaaggcaaacgtcgttagcaccagggccttggacaataaacacactattgaggtgcggatcgtagaggaaaagaacattgagttctttgattatctcgtgagtaaactgaagatgcccatctaccagaaaatgaagggtaataaggctgcagaactatctgagaaagggtatggactgttcaagaaaatgtcccttgaggaacaaagcatacatctcattgagctgttgaacttactgaccaatcagaagacaacgtttgaagtcaaaccactcggcatcaccgcctcgcgatcaactgtgggttctaagatcagtaaccaggacgagttcaaagttattaatgaatccatcacaggcctgtacagcaacgaggtgaccatagtctga

SEQ ID NO: 3283 - RNA, 4197 nt, synthetic construct
  misc_feature 1..4197: note = Cas9 variant
  source 1..4197: mol_type = other RNA
atggaaaagagctactccatcggcctggacattgggaccaactctgtgggatggtcagtcataacagatgactataaagttcccgccaagaaaatgagagtgctcggtaatactgataagaaatacatcaagaagaaccttctgggcgctttgttattcgacagtggggaaacggcagaggccaccaggctgaaacggacagcgcgccgacgttatactagaaggaagaatcggctacgctacctccaggaaatttttgctaaagagatggccaaggtagatgagagcttctttcaaagactggacgagtccttccttaccgatgacgataaaacatttgactctcaccctatcttcggaaacaaggcagaggaagatgcctatcatcagaagtttccaaccatttaccacctgaggaaacatttggctgactcgcaggagaaggcagatctccggctgatctatctggccctcgctcacatgataaaattccgcggccactttttatacgacaatttcaacgacgataattttgactggcgaaacatcgatattcagaagagatacgaagagttcatcgagacttatgactcaacactgggtgaaagctaccttgccgatattagtgtggacgcggcatccatcttggaggaaaaagtctctaagaccgagaggctggaaaatctactcaaatattacccgacggagaagaagactacctttttcgggaacctgataaaacttattctgggacaacaggccaagttcaaagctatctttaatttggaggatgaaattagcctccagttcgccacacccacttatgacgaggatctggaagagttactgggcaagatcgacaacggcgattcctactcagaactctttgtggcagctcagaatctttataacaccatcctgttggccagtttcctaaaaacagacaataagagcgcgaaggcccctctgtctacctccatgattgagcggtacgagaaccataaaaaggacctcgcaaaactgaaggattttgttaaaaagaactgcccagaccaataccacgatatattccgtgacaagtcaaagaatgggtatgctggatacatcgataacggtgtgagccagaatgacttttatacgttcattggcaagtgtcttgaagagagtctgaaaaaggataaaggggcccagtactttttggacaagatcgatcgcgacgatttcctcagaaagcagaggacttttgacaacggagctttcccctatcaaatacatctgcaggaaatgcacgccattttacggcgacagggcgattactatccttttctgaaagagaatcaagacaagatcgagaaaatcctaacattccgcattccatactacgtcggtcccctcgcaagaaaggactctaggttcgcctgggctaactatcggtccgatgaagcgatcaccccttggaattttgacgaggtggtagataaagaaaagagcgcagagaaattcattactcgcatgacactgaacgacctttacttgccagaagagaaggttctgccgaagcattcgctcatatatgagacctttacggtgtacaatgaactgaccaacatcaaatatgtcaatgatcaggggaacgccattcacttcgactctgagcttaaggagaaaatctttaatcagctgttcaaggaaaacagaaaagtgtccaagaagacattgatcgattttctcaataactcagaaggaatttacactgacaaactggtgggcatagatgaggaggtcaagtatttaaacgctagtctgggcacctaccacgacctcaaaaagatcctagagagcttcatggatgacgaaattaatgagaaaatcattgaagatatcatacagacactgactctttttgaagacatcgagatgaagaggcaacgtttgcagaagtacgacgatattttcacccccaaacagctgaaggagctcgcccggcgaaactatacagggtggggaagactgtcctacaaattaatcaatggtattaggaacaaggaaaataacaaaaccatcctggactatcttaagaatggcaaccgcaattttatgcagttgataaacgatgaccggctctctttcaagcaaattatcattgatgcaagaaaaatcgagaagctggacaatatagaaagcgttgtgtacaacctacctgggtcaccagccatcaaaaagggcattctgcagagtatcaaaattgtagatgagctcgtgaaggtcatgggacataatcccgacaacatcgtgatagaaatggctagggagaatcagactacgaaccagggtaaaaaccgctcccaacagcgactgaagcggcttcaggatagcatgtctaattttaaggactcaagtattagcttgaaagatgttgacaactccgacctgcagaatgatcgtttattcctctattacatccaaaacgggaaggacatgtatacaggcgaggaactggatatcgaccacctttctgattacgacattgatcatatcattcctcagtcgttcataaaagacaatagcatcgataacagagtgctgacctcctcagccaagaataggggaaaaagtgacgatgtcccaggccgcgacgtggtattgaagatgaagcccttttggaaaaagctctacgatgttaaactgatttctaagcggaaattcgacaacctaactaagagcgagcacgggggactgaccgaatccgacaaggcaggttttatcaaaagacagctcgtggagacaaggcaaattaccaagtatgtcgcgcagatcctggatggccgattcaatactaaacgcgacgataacaataaggtgatacgggacgtcaaagtgatcacacttaagagctcattggtttctcagtttagaaaggatttcgggttttacaaagtgagggagattaacgactatcatcacgctcacgatgcctacctgaatgcagtagtcggaacggccatcttaaagaaatatccgaagctcgctcctgagttcgtgtacggcgaatataaaaagtgcgacgttcgtaagctgattgccaaatccggtgataagagtgaaatcgggaaagcaaccgctaagtactttttctacagcaaccttatgaactttttcaaacgcgtgatacggtattctaatggcatgattgtcgtgagacccgtaatcgagtactccaaggacactggagaaatcgcctgggataaagagaaggacttcaagacagtgtgtaaagttctgtcatgcccacaggtcaacattgtgaagaaagtggagaagcaaagtcatggcctagatagggggaaacctaagggattttataatgcgaaccccagcccaaagcccaaaaagggttcgaaagtcaatctcgttcctataaaggccaacctgaatccgaaaaactacggcgggtatgctggaatctccaattcttacgcagtgttggtggacgccaccattgaaaagggcgctaagaaaaagctgacacgaatccaggagttccagggtattagcatcatagaccgggaaaaatatgagaagaacaaagtagaatttttaaaggggctcggctacaaggagatctactcaattatcactctgccaaaatatagtcttttcgagctggccgatggatcccgcagaatgttggcatctattctcagcaccaataacaagaggggcgaaatccacaaagggaatgagctggtcctacccgcgaagtacatacctctgctttatcatgccaaccggattcacaatacgtttgaaaccggacaccgagagtacgtggaaaaacatatcgctgagttcaaggagatcgccgaaattatcctcgagtttaacaataaatatgttaacgcaaagaaaaattcctcaataattgaaaaagctctggagagcttcgacagtttttctttggatgagatctgtgactccttcgtgggcaagctgaaaaagaacaacactaaaaagaatagcggtttatttgaactcgtctcgctggggtcagcctctgatttcgagtttcttgaaacaaaggtgccaagataccgcgactatacccccagttccctgttgaacgcaacactcattcaccagagcatcactggactgtacgagaccaggatagatctatctaaactgggcgaagagtga

SEQ ID NO: 3284 - RNA, 4197 nt, synthetic construct
  misc_feature 1..4197: note = Cas9 variant
  source 1..4197: mol_type = other RNA
atggagacccaggccagcaaccaactgatctcctctcacctcaagggctaccccattaaagactatttcgtggggcttgatataggaacatcaagtgtcggttgggctgttactaataaggcatacgaactgttgaaatttagaagccataagatgtggggctccaggttattcgacgagggggaatctgccgtggcgcggcgcggatttcgatcgatgcgtagaaggctggagcggcgcaaactaagactcaagctgcttgaagaactgttcgctgatgccatggcacaggtagaccctacgtttttcatgaggttgcgggagtcaaagtatcactacgaagataaaaccacaggccatagcagtaagcacatcctctttattgacaaaaactatactgatcaggactactataaggcctacccaaccatctaccatctgcgcgctgagctgatgaaagatggtacatatgacattcgaaaactcttcttagcagtgcaccacatcctgaagtacagagggaattttctttatgaaggagcctccttcgattctaacgctagcaccttggacgatgtcctgaaacaggccctagagaatataacttttaactgcttcgactcctcagcggcaatcggcagtattggccaaatcctcatggagacagggaagaccaaaagcgacaaggccaaaacgattgaaaggctggtggatacttacatcataaccgacgaggttaatgcttctggaaagacacagaaagatcaggtgaaggaagacaagaaacggcttaaggcctttgcaaacctggtcttgggtctcaatgcttccctgattgatttattcggctcagtggaggaactggaggaggacctcaaaaagctgcagatcactggggatacctatgacgataaacgtgacgaacttgccaaggcgtggagcgatgagatttacatcatcgacgactgtaagagtgtatatgatgccattatattgctatctatcaaagaaccgggactgacaatttccgagagcaaggttaaagcattcaacaagcataaagacgatctcgctatcctgaagtcgcttctgaagtctgaccgctccatatacaatgccatgtttaaagtggatgaaaagggcttgcacaactacgtccattatattaaacaaggtagaaccgaggagacgtcatgcaatagggaagacttctacaagtatactaaaaaggtggtggaggggctccccgatagtaaggacaaagaatacatcctgagcgagatcgaattacagacactgctacctctccagcggattaaggataacggagtcatcccatatcagctgcaccttgaggagttgaaagttattctggctaagtgtggccccaaatttcctttcctcaatgaagtggccgacggcttttccgtagcagagaagctgataaaaatgcttgagttccgaatcccatactatgtggggcccctgaacacctctcacaacgtcgataatggaggttttgcctgggctgtgcgcaaggcgagcggcagagttactccttggaacttcgacgataagattgacagggagaaatcagcagccgcttttatcaagaatttgacaaacaaatgcacctacctcctgggggaggacgtgttaccaaagagttccctgctatacagcgagttcatgctcctgaatgaacttaacaatgtccggatcgatggaaaaccgttggaaacgaaggtgaaggcccatctgattaaagcagtatttaagcaagaccacaaaaagatgaccaaaaaccgcatagagcagttcctcaaggataataactatatccccgaaaagcataaacctgagattacaggcctggacggtgagatcaagaatgatttagcctcttacagagacatggttaggattctggggaacaattttgatctttcaatggctgaagagatcataactgacatcaccattttcggcgaaagtaaaaagatgttgcgtgagacactccggaaaaagttcgccagctgtctggatgacgaagcaatcaagaaactatccaagctgcgatatagagattggggaaggctctctaaaaagctgcttaacggcattgacgggtgcgataaagcgggagacggtacttcggtgaccatcatagaggctatgcgcgactttagctacaatttgatggagctgttaggcgatcggttcctctttatggaaagaatacaggagatcaacgacaagctgacagaagggcaaattgtcaacccacacgatatcatagacgatcttgccctgtcccccgcagtgaaaagggccgtctggcaggctttgcgcatcgtggacgagattgttcatatcaagaaggccctccctgcacgaattttcgtggaagtaacccggtcaaataaagctgagaagaaaaagaaagatagtcgtcagaagagactgtctgacctatatgccgcgatcaagaaagatgacgccctgctcagcggactgactaacgaggaatttggcggtcttaagtccgagttggctaaatacgatgacgcagccctgaggtcaaagaaattatatctctactacacgcagatggggcgctgtgcttatacaggcgaagtcatagacctgagccaacttaataccgataactacgacattgatcacatctatccacggtctctgactaaggacgattccttcgacaatctagtgctctgcaagagaaccgccaacgcacagaaaagtgatacataccccatcagcaaggagattcagaaagcgcagaaggccttttggatcttcctgaaacaacagggattgatttctgagaggaagtatgaacgactgacccgcataactccgttaacagctgacgatctctccggctttatcgcccggcagctggttgagacgaatcagtcagtgaaggcagctaccactcttctgagaaggttgtaccctgacattgatgtcgtgttcgtaaaagccgaaaacgtgacagactttcgtcacgataataacttcatcaaggttcgcagtctcaatcatcaccatcacgcaaaagacgcctatctgaacattgtcgtggggaatgtgtaccacgagaagtttacccggaacttcagagctttctttaaaaagaatggagcgaacaggacatacaacctagccaagatgttcaattatgacgtcaaatgtactaacgcaaaggatggtaaggcttgggacgttaagaccagcatggatacggtgaataaaatgatgacctcgaacgacgtgcgagtaacaaagcggctgcttgaacaatccggcgccctcgccgatgctactgtctacaaagcaaccgtggccgcgaaggctaaggacggggcctatatcggaatgaaaacaaagtctagcgtttttgcagatgtgactaaatacggcggtatgaccaagattaaaaatgcctattcaatcattgtccagtacatcgggaagaagggcgaggtggttaaagagattgtgcccctgccaatctatttgacgaaccgcaatataacagaccaggatctgattgactacgtagctagtatcacccctcaggcaaaggatatctccattatatacagaaaattatgcatcaaccaactcgtcaaggtgaatggattctattactatctgggcgggaaaactaactctaatatttacatcgacaacgccgtggaagtcgttgtgcccgcgaatattgctgtatatatcaaggtgcttgagaagtttgccctgttgcataaagataacaataacataaaggcaagcacagtcaccactaggatctacaacgaaggatccaccaatattgtgtcaatcacagacaaagacggcctcattgtttatgattacctgatgagcaagctacggacgccactgtacatgaaaatgaagggtaacaaggtggacgagcttagtaccgtcgggcgatctaaattcatgaatatgactctcgaggaacagtccatctatctgttggaggtgttaaacctgctcacaaatagcaagaccacatttgatgttaaagccctgggaataactgcttcgagatcaaccattggcgtgaagatccacacgcttgacgagttcaaaatcattaaccagtctatcacaggtctgtacagtaatgaaataaccattgtctga

SEQ ID NO: 3285 - RNA, 4197 nt, synthetic construct
  misc_feature 1..4197: note = Cas9 variant
  source 1..4197: mol_type = other RNA
atggagacccagacaagcaaccaactgatcacttcccacctcaaggactaccccaaacaggattatttcgtgggccttgacattgggacaaattctgtcggatgggccgttaccaacacatcatacgaactgttgaagtttcatagtcacaaaatgtggggtagcagattattcgaggaaggcgagtccgctgtgactaggcgggggtttcgctctatgcgacgtagactggaaaggcggaagctacgcctcaaactgcttgaggagctgttcgcagatgccatggcgcaggtagactcgacctttttcataagattgcatgaatcaaagtatcactacgaggataagacaaccggacatagcagtaaacacatcctctttattgacgaagattatactgaccaggattacttcacagagtatcctaccatctaccacctgaggaaggacctgatggagaatggcacggatgacattcggaaactctttttagctgtgcatcacatcctgaagtaccgcggtaacttcctttatgaaggggccacttttaattccaacgcattcacctttgaggatgtcttgaaacaagccctggtgaatataacattcaactgcttcgacactaattctgctatcagctccatttcaaacatcctaatggaaagtggaaagaccaagagcgacaaagcaaaggccattgagcgactcgttgatacatacaccgtgtttgacgaagtcaatacgccagataaaccgcagaaggaacaggtgaaagaggacaagaaaactctgaaggctttcgccaaccttgtactgggcttgtctgcgaatctcatcgatctgtttggctccgttgaagacatagatgacgatttaaagaaactgcagattgtgggggacacatatgatgagaagagagacgaactcgcaaaagtctggggagacgagatccatattatcgatgactgtaagtcagtgtacgatgccatcattcttatgagcataaaagaacccggtctgaccatcagtcaatctaaggtgaaggctttcgacaaacacaaggaggatttggtcattctaaaatccctgctcaagctggacaggaacgtttataatgagatgtttaaaagcgataagaagggccttcacaactacgtgcattatatcaaacaggggcggactgaagagacatcgtgctctcgtgaagacttctacaagtacaccaaaaagatagtagagggactggccgattccaaagacaaggaatatattttgaacgagatcgagctccagacgctgttacctctgcagcgcatcaaggataatggcgtgattccataccaactacacctcgaggagctgaaagtcatccttgacaagtgtggtcccaaatttcctttcttgcataccgtgtcagatgggtttagtgttacagaaaagctgattaaaatgctcgagttcagaataccatattacgtgggacccctgaacactcaccataatatcgacaacggcggctttagctgggcagtcaggaagcaggctgggcgggtgaccccttggaatttcgaggagaaaattgaccgagaaaagtccgccgcggcctttatcaagaaccttacaaataaatgcacttatctgttcggagaagatgtattgccaaagtctagcctcctgtactcagagttcatgttactgaacgaactaaataacgttcgcatcgacggtaaagcactcgctcagggcgtgaagcaacacctgattgatagtatatttaaacaggaccacaagaagatgaccaaaaatagaatcgagcttttcttgaaggataacaattatattacgaaaaagcataaaccggagatcaccgggctggacggagaaattaagaacgatctcacttcctacagggacatggtccggatcctgggcaataactttgatgtgagcatggccgaggacataatcacggatattacaatcttcggtgaatctaagaaaatgttacgccagaccctgagaaacaagtttgggtcacagcttaatgacgagactattaaaaagttgagtaaactcaggtaccgtgattggggccggctgagcaagaagctactgaaaggaatcgacggctgtgacaaggctgggaacggagcccccaaaaccataattgaactcatgcgaaatgattcctataacctgatggagatccttggtgacaagttctcttttatggagtgcattgaagaggaaaatgcaaaattggcccaaggccaggtcgtgaaccctcacgatatcatagacgagctggctttatcgccagcggttaagagagcagtgtggcaggccctcaggatcgtagatgaagtcgctcatattaaaaaggccctgcccagccgcatcttcgtggaggttgcacggacaaataagtccgagaaaaagaaaaaggactcaagacagaaaaggcttagtgatctgtactctgccattaagaaggacgatgtgttgcaaagcgggctccaggacaaagaatttggagctctgaagtccggcctagccaactatgatgacgcagcgctgcgcagcaaaaagctctacctgtattacacccagatgggtcgatgtgcttatactgggaatatcatagaccttaaccagttgaatacagataactacgacattgatcacatctaccctcggtcactgacgaaagacgattctttcgacaatttagtcctctgcgagcgtaccgccaacgcaaagaagtccgatatctatccaattgacaatagaatccaaactaaacagaagcccttttgggccttcctgaaacaccagggccttattagtgaaaggaagtacgagcgcctgacacggatagctccgctaaccgccgatgacctcagcggatttatcgcaagacagctggtggagacaaaccaatctgtaaaagctactaccacgttgctgaggcgattatatcctgatattgacgtggttttcgtcaaggccgaaaacgtgtccgatttccgccataataacaattttatcaaggtgcggtcactcaaccaccatcaccatgcgaaagacgcctacctgaatattgtcgttggcaacgtgtatcacgagaagttcaccagaaattttaggcttttctttaaaaagaacggggctaatcgtacatacaacctggcaaaaatgttcaattatgacgtgatctgtactaacgcccaggatggaaaggcttgggacgtaaagaccagtatgaatacagtcaaaaagatgatggccagcaacgatgtgcgcgttactcggagattgctcgaacagtcgggtgcactggcggacgccaccatatacaaggcttccgtggccgcaaaagctaaagatggcgcctacatcgggatgaagacgaaatattctgtctttgcagacgtgacaaagtacggaggcatgaccaagattaaaaatgcctatagcatcattgttcaatacactggtaagaaaggggaggaaatcaaggagatagtgcccctaccaatttatctgatcaacaggaacgctacagatatcgagcttattgactacgtaaaatcagtcatacctaaggcgaaggatatcagtattaaatatcgaaagctctgcatcaatcagctggtgaaagtgaacggcttctactactatttgggaggcaagaccaatgacaaaatttacatcgataacgccatagaactggtcgttccccacgacatcgcaacttatattaagttactcgataagtacgacctgcttcggaaagagaataagaccctgaaggcttcctctatcacaacgagcatttataacatcaatacctccactgtggtatcattgagcaacaaagtggggatagacgtctttgattacttcatgagtaaactccgcacaccactgtatatgaagatgaagggaaataaagtggacgaactatcttccaccggcagaagcaagtttattaaaatgacactggaggaacagtcgatctaccttctcgaggttctgaacttgttaactaattcaaagaccacgttcgatgtgaaacccctgggtatcacagggtctaggagtaccattggagtcaagatccataacctcgacgagttcaaaataattaatgaatccatcactggcctgtacagcaacgaggtgaccattgtttga

SEQ ID NO: 3286 - RNA, 4200 nt, synthetic construct
  misc_feature 1..4200: note = Cas9 variant
  source 1..4200: mol_type = other RNA
atgaagaccatcctgggcctcgaccttgggacaactagcattggatgggccctggtgaaagaggctgaacccttctccgatgagaagtctgaaatagtcagattgggtgttagggtgatccctttaacggtagacgagcggacctcatttgaaaacggcaaaagtattacaactaatgcactgcgcacccagaagcgagggatgcgtagaaacctacaaaggtacaaactccggcgccaggccctgatcgaggagcttaagagcacaggatggattggcaatgatttcatcttttccgaaaccggtccagggtctactttcagaacactgaggttgcgggcgaagtcggcttcagaggaagtgaccctcggagacctggcccgcatactgctccagatcaacaaaaagcgaggctataaaagcagtagaaagatggtctcctctgatgacggccaggcaattgatgggatggccgtggctaaagagatgtacgacaagggattaacgccgggtgagtatgtttaccaaaggatgctggaaggcaagtatgcaatccccgagttttacaaaagcgatcttcaggaagagttcgaccggatttgggccttgcagaagtcctttcacatcgaactgactgatgagctatatcgtaaactctcagaccgcaataagagtcagacctgggctatatgcagagatgagctggggattcaaggacttaaaagctctttcatcggcaaggaaaggctgaaagaggcctaccggtaccgacatttggcggcaacacaggaagtgaacatggaggtcctcacttgtgccctgcaggaaattaatggtcagaaggcttccttatcagggctgctcagcaagatcagtgaccgctctaaagagctttatctgaacaatttgaccgtgggacaaatgctactgaagagaatcgaggacaaccctaataactccctcaaaaatattgtattttacaggcaggattatctggacgaatttgagcggatatggacagttcagagcaagtaccacaccgaacttacgcatgagctgaaaaagcgcttgagagatatcattatcttttatcaaaggccactcaagtcgcagaaaggcctgatatctttatgcgaactggagactaaggacattgaggtggccatcgatggcgtcaaaaagatgaaaaacatcgggccccgtgtgtgtcctcggtcctcaccactattccaggaatttaagatttggcagacaatcaataacattttcgtgaacggagcagctctcgacgatgaggacaagagtgtcatagccaaagaactgatgttcaaggataaacttaaggacagcgatttgctgaaactcctgtttaagaccactaagggtcaatccgttaatttcaaagaggtggacggcaaccgaacaatggcgacccttatgaaggcctgctttaaaatcgcagagaatctggggtacgacgatattggattgtctaagctcagctcagaagaccagatggtaagaatcgagggcatcttcaaagaacagggttttaagacggggttcctgcactttgatagttccttagctagccccgagttcgaaaaccaggactcttataggctgtggcatctactctactcatacgagggcgataaaagtgccagcggaaatgagtccctggtgaagtgtattatggacctttgctctatggatgaaggctcggctaagatattggccagctgtacctttctgcctgactatgggtccctctcagcaaaagccatgcgcaagatcctgccatacatgaaagatggattagagtatacagctgcgtgcgcaatggccggttaccggcacagtaagagatctctgactaaagaagaacttgacaccaaggaatatagcgataggttgtccctcctgccgaagaactcactacgcaatcccgtcgtggagaaaattctgaaccaaatgatcaatgttgtgaacagcgtcattgacgtgtacggcaagcctgatgagatccgaatagaaatggctcgggagctcaaaaagtctgccaaagaacgtgaggaagcacagagagacatcgcctccagtacagctgagagccagaaggtaattgagatcctgaagggggaaccattctttcttcagttccccactaggaatgacattatccgctatcggttgtaccaagagctggcccagaacggatttaaaaccttatactctaatacatatatacctaaggataaactcttctccaaggagttcgacattgagcacatcattccacaggcactgatctttaacgattcattcgcgaataaaacccttgagagtagacagtgtaacctggaaaagggcaaggagactgctatggactacgttaaaagcaagtatgatgaaacgggtgtgcaaacatactgcgacagggtcaacgggttgataggcaaaggaatctcgaagaccaaagccaagtggctcctgatggagggcaaagatattcccgaagactttatcaatcgagagctacgcgattcccagtatattgcaaagaaggcccgggagatcctggaatctctcgtgaaattcgtcgtgccgactaccgggagcgttacagctagactgagggaggactggcagcttgtgaacgtaatgcaagaattgaattgggagaagtacgcccgtctgggattaaccggtgtccgcgaagataaagacggccggagaataccttttattcaggattggactaagaggaacgaccatcgacaccatgcaatggacgctctcacaatcgccttcacgcggcgccagtttatccagtatctgaatcaccttaactcaaaaattgatgtggttagttgggacaagaaggatctggacctaagagattacgacctcgaggatatcaaattcgggaatctgtccgcgggagacaggtacggcattgtgaaggccttgcaagataaatttctgtataaggacggtaacgataaataccggttcgtgcccccaatacctttagacgagtttcgaagacaggctaaggaacagctctctgacatcctgattagcttcaaggcaaagaataaggtctgtacccgcaacgtaaatgtgactaaaaacaaagggggcgccaataggaaagctcagcttacaccccgtggaccactgcacaacgagaccatctatggctcctcattggaatacgttacaaaggagaatgaaaagattgggagcagttttgatactgagcggatcaccacggtctgcaaaaagaaattcagagacgccctcgcaaggcgcctggaggagttcggaggcgatcccaagaaagcgtttaccggtaagaactctcctgaaaagaacccaatatgggtggacgaacatcactccgagcaagtgccggccaaagtccgaacagttactatggggcagagattcaccggacggaagcccatcgatgctacactaaaaattgagaaggtgatcgacaaaaggattcgcgaaatcctgcaggcccgtcttgatgagtttgacggcaaggcagctaaagccttcagcaatctcgatgaaaaccctatatggctgaataaggagaagggtattgcaatcaaaagagtgactgtatcgggcccagccaaccccgtccctgtgcggtttaagagggacaaagatgggaagccaatcattgacgatgctggaaaaaccataggcgcggacttcgttacgcccgggaataaccatcacatcgccatttttcgcgactcatctggaaagttgcaggaacatccggtgagtttcctggaggcaacaatcgctaagtcccacggcttagatgtcattgaccgaaattataacaaagatgagggttgggaatttctcttcaccctgaagcaaaatgagtactttgtgttccctaacagcgaaactgggttcaatccacttgactatgatctgacagaccccagaaactacgccgagatctctcctaatttgtaccgggttcagagcatatccaccaacgattatttcttcaggcaccatctcgaaactacctcagagaaaaataacagtctgtacggaatcacatggaagcgcattagaaacgccagcgctctagagggcctggtgaaagtaaggatcgacaatcttggtcggattgtcgcagtgggcgaatatgattga

SEQ ID NO: 3287 - RNA, 4200 nt, synthetic construct
  misc_feature 1..4200: note = Cas9 variant
  source 1..4200: mol_type = other RNA
atggagacccaggccacagctcaactgatcagcggccacctcaaggggtaccccatttatgactacttcgtgggacttgatataggtactaactccgtcggctgggcagttacgaatagaatctatgaactgttgaaatttaggtctcataagatgtgggggtcacggttattcgaggaaggacagaccgccgtggtacgccgaggctttcgtagtattagaaggcggctggagcgcagaaggctacggctcaaactgcttgaagcgctgttcgctgacgccatggcacgcgtggatagcacatttttcatccgattgagagagtccaagtaccactatgaggacaaaactaccggtcataagtctaagcacattctctttatcgatgacaactacacagatcaggactatttcgccgaataccctaccatataccatctgagggctgatctgatggagaatgggacttcggacatccggaaactctttttagcagtccaccacattctgaagtatcgtggaaacttcctttacgaaggcgccacatttgattcaaatagcagtttggacaccgtgctgaaacgcgctctagagcagatcgagttccatatttttaacgccacgtccgaagatgcgctccactctatcctggacatagttaaacttcaagacaaaactaagagcgataaggcaaaagccattgagtccctggtggacacctatatcacagataaggtcgaatcaagttgcactgacaaagagaagaaagatttgctcaaggctgacaaaaagagactgagggccttcgcaaatttaattctgggcctcaacgctaatcttaccgatctgttcgggacaatcgaagagatcgaggaagactttgtgaagttgcagattaccggagatacgtacgaggaaaaacgggacgattatgccaaggtatggggtgacactatacgaatcattgacgattgtaaaagcgtttacgactctatcatactaatgtccattaaggagccaggcctgacaatctcacagagcaaagtgaaggcgttcaacaagcataaagaagatctcgccatcctgaagcgccttctgaaaagtgacaagtatatttacaaaaatatgtttaaggcagatgagaaggggttggctaactacgtccactatatcaaacagggaagaaagaatgagaccggctgctcttgtgaagacttctacaaatatactaagaaagtggtggagtccctcccggatagctcggacaaggcctacattctgaacgaaatagagttacaaaagctgctacccctccagaggatcaaagataatggtgtcattccttatcagctgcaccttgaagagttgaaggctatcctggagaaatgcaaggacacatttccattcctcaacaccgtttctgatgggtttacggtggccgaaaaactgatcaagatgcttgagttccggattccctactatgtaggacctctgaacccatcccattcaatagacaaaggcggctttgcatgggtggaacgcaaggagcccgggcaggtcaccccttggaatttcgaggataagatcgacagagaaaagagtgccgaggcttttattaagaacttgacaaataaatgtacttacctcatcggagaagacgtgctgccaaagagctccttactgtactctgagttcatgctactcaacgaactgaataaccttaggattgatggtaaaccgttggagcaagcggttaagatgcacctgatcgacgcagtgtttaagaaagagcataagaaacagaccaagaatcgtataatcgagttcctcaaagataacaattatattctgggcaagcacaagcccgaagtcgacgggttagatgaaagcatcaaaggagacctggcctcataccgggatatgaagcgaatccttggcgacgatttcgacgtgagtatggctgagtccattataacaagcattactatctttggtgaatctaaaaacatgttgagagagaccctcaggaagaaattcgggtcaattctgagtgaggatcagatccgcagcctagccaagctgcggtatagagactggggcaggctctccaagaaatttctgataggaatcgatggctgcgtaaagggggaagacggaacacctggtaccattatcgacatgatgcgcaatacttctcataaccttatggagttgctgggcgatacgttctcgtttatggacgttattatcgaagagaatgataaattaacaaaggggcaagtggtcgacccacacgaaataattgaggagctcggactgagccccgcagtgaaacgagccgtctggcaggcccttcggatcgtggatgaagttatccacattaagaaagctctgccttcccgtatcttcgtggaggtagcaagaaccaacaaggacgaaaagaaaaagaaagattcaaggaagaaacgcttgcaggagctctacaagagtattcagaaggagtctccagaatggctgagcgtcactcgggacgagtccgataaactaatatcaaatctggacagagcggatgacagctctctcaggtccaagaaactgtatctttactatacccaaatgggccgatgtatgtacagtggtcgcgtgatcgacttggatcagctgaacacagacaagtacgatattgaccatatctatccccggagcttaaccaaagatgactcttttgataacctcgttctgtgcgaaagacaggagaatgctaagaagtccgacaactacccgattgatcctgacatccagaatgccaggaaacccttctggacttttcttaaggatcaaaacctgatatcaagtcgtaaatatgaacgcctaacacgggtgctcccactggaggcagacgatttgacggggttcatcgccagacagctggtcgagaccaatcagagcgtgaaggctgtaactacattactcaggcgactgtaccctggcgtggacgttgtctttgtgaaagccgaaaacgtgaccgacttccggcacgataatgactttattaaggtccgctcgcttaaccatcaccaccatgcaaaggatgcttatctgaatatcgttgtgggaaacgtgtaccacgagaaattcacaagaaatttcaggaagtttttgaaaaagaacggcgccaaacggacttataatctcgcgcgaatgttcgactttgatgtaatgtccaccaacgccaaggacgggaaggcttgggatattaaaacgtctatgaatatcgtcaagaaaatgatggcaagcaacgacgtgagagttaccaagcgcctgatggaacagaaaggagccctatcagatgctacagtgtacaaggccagtgtcgcaggtaaagcgaagggcggggcctacataggaatgaagactaaagactccgtgttctctgatgttagcaagtatggcggtaggacctccattaaaaacgcttactcaatcgtggtagagtatacagggaagaaaaatgaaatcattaaggagatagtccccctgccagtgtaccttatcaaccgtaataagactgaccaagagctcattcattatatcgtgagcattatcccccaggccaaaaacgtcagtataatctacaagaaactgtgtattaatcagttggttaaggtgaacggcttttattactacctgggaggcaaaaccaataactatttctggatcgattctgcaattcaggtagtgatcgctgacgaatggataccttacttaaaggtcctcgagaagtttgacgtgatgcggaaacaaaataaggaactgaaagttgggacggtgtccacaagcattcagaaccagggaaagaaagtcgtgatcaagatccttgaggaaagaaatgttgagttcttttcgtatctggtgggcaagttgcactcatctatttacagtaaaatgaagggtaacaaagccggggagctcgcaaccaagtccctggaaatcttcgtcaatatgagcctagagaaccaatgcatatatctgatggaacttctcaatctgttgactaacaaaaaggccccagatgtaaaaccgttaggaattacagcttctaggggcaccatcggtagcaaggtgtccaaccaggacgagtttaagattatcaatgagtcaataactggcctgtacagtaacgaagttaccattgtgtga

SEQ ID NO: 3288 - RNA, 4200 nt, synthetic construct
  misc_feature 1..4200: note = Cas9 variant
  source 1..4200: mol_type = other RNA
atgaacctgagaaataccacagacgagtacaacatcggcctcgatatggggactaatagcgtgggatgggccgtcacggacaaggctggtgcaattgcccacttcaagggcaagcccacccttgggtccaggctgtttgatgcggctcagacagccgcaggagcccggatacatcgctctcaacgacgtagatatgttaggcggcgctggagattggacttactgcagtcactattccaggatgaagtgagtaaagtagacagcgagtttttctgcaggctccggcagtcccgcctgtacgtgggcgatcgagaaaagggtcacgctgactatacttggcctatctttaacgattctgacttcaatgaggtcgattactataaaagatttccaaccatttaccatcttaggaagtggctgatggaaacagacgagaaggcagatatccggttgatttatctcgccacccacaacatcgtgaaacatcgtgggaatttcctgcgcgagaacaataagtcgctgtcaagcagagacgctaacccggcccaagcggttaaaagtctcaggttagcactgaatgactggtgttccgaacgggattacgagtgcgcctggaagggagaagaggacgatggcgctatagacgaggccatccttaacgtgttggcagatggcgaaaaagggcgatctgaccaggctaaggagattgccaagctgactggagtcgattgtggtgacgcgaaacagagcaagcagtgcaatgaagccatcgcaaaagctattgtgggcctaaaggtagagatgaaaaacatctttggggagttccccgccgaaaagacatcctacatatatctctcaagtgatgaggacgttgaagctgtgcgcgagagctgtcctgatgactctggagaactgtttcaagccctttgcaaactgtactccgcatatattttgcaggagctcctgtcatacgccgacccaagcggccagaccatcagtgctaatatggtcgcgaagtataagcagtacggtagagatttaaggctgctcaaagaacttacgcggacttatgcaccccaaaagtacgacctgttctttcgcggggagacctacgccggatcttccgattatgtggtggacgaggctagaggctacacaaggtataacttgggcactaccaaagccaactacgatgacttccaaaagagcgtcaaagaactattcaaggggacagatgcactgcaggacgagcgttatcaagaaatgatggttgcctttggagagcagaagttcctccggcgactgaaaacctcggataatggttctatttactatcagcttcacctggaagagttgcacacgatcctcgagaaccagggcaagcattacccttttctgttatccgaagaggacaaaatcgaatcactggtgagtttcaggattccatactatgtagggcccctaactagaaagaatgctgccataggacacgatggcaaagagcgctttgcatggagctcccggaaggacggtatggagcatgcggtgatcacaccttggaactgggaagagattatcgatagagacaagtctgctgaagacttcataatgaggatgaccggggattgtacttacctccaaggcgagccagtcctgccgaaatgcagccttttgtatgaagagttttgtgccctgaatgagttcaacggagcacactggacagtggacggcgatgacgaacgccgatttgatgccgctcagcgggagcgtattatgtgcgacctcttcagaaggacccgctcagttacgtacaataaggtgagtgattggctggaacggaaatataactttaccggggccagagtcaggggaggtcagggcgagcacgggttcgaatccaaacttggaagctacatctttttctgtaaggacgtgttcaagacagatggcctggacgaggcagattatactatgatcgagcagattatcttgtggtctaccctctttgaagaccgagatattctgaagcgcaaaatagaggaggcttacggtggggaccggttaacatcagaacaaatcaaggtaatttgcaaaaagagattcactggctggggaaggctgagtaaacgtctactcaccgacatcaaggttaatacagataccggccgcaaaagcatcatggacgtgctgcgggaagggaaccccaataacggacagagatccaggactatggtctttatggaggtgcttcgagatgaggacttgggtttccagaaggccattgatggcctgaatcgggactactttcgcgaacataacaatgggctcatggatgtcaacgacctgcctggatctccagcgataagaaggtcgatcaaccaggccgtgcggattgttgatgagatcgctagcattgcacgaaaggaacccacgaatatcttcatagaggtgacaagagaggaagacgatcctcgcaaaaagggcaaaaggaccaagcgtcggtatgacgccatcaaatccgctttagagaagtttaagaaagacgatccatcactgtggaaggaactttgcgagaaagcccccggtgacatggatgaaagattgagtctctacttcatgcaaagggggaagtgtatgtattctggccgcccgattaaaatcgaggagctgcacactggaaagtacgaagtagaccatattatccctcgaagctatataaaggatgactcctttgagaacaaagtcctagtgtacagagaagagaatcagcacaagaccgatgcactgctcattgactcaagcatccggcagaaaatgggcgggtattggaggatgctgcatgatgcgaaacttgttggagacaagaagttccgcaacttgtttcgtaatcacattgatgacaaggccatgaaaggcttcgtggctagacagatcgtcgaaacatctcaaatggtgaagctggtacagaccttatttgaggcccggtaccccaacactaggatagtgccagttaaagcaggtatctcccacgatctccgcgaggctgccgggctggtcaagtgccgagaagcaaatgacttccatcacgcccatgacgctttccttgcgtgtagaattggactgtttatccagaaacggcaccctagtgtgtacgataaccccattggcttggccaggatcatgcgcgactatgcaagaatgcaagctagggagtacaagaaaagccactgcctcgcccatacacagggtttcatagtgaatagctttctgtcctcaggcttcgatgaagagacgggggaaatttttaaggacgattgggacgccaaggctgaggtcgagggaatccggcgtgttctaaactgtcgccagtgcttcatcagtcgaatgccagtggaaggcgataccagatatgggggaaggtactggggcgagactatttatagccccaaaggtaagcacaaacatgaaatccctctgaagcaggggctcgacccaaatctgtacggaggctattcggatcttttgtactcctactttctgatttatgaggcatctgacgtgagctcaggtgagcgggtattacgcttcataggcatcccgacaagtattgccgcgagaatggctaaccagaaaaggctcgaagagtacgtctcccggctggcccttcaggaaaatctggagcacgtgcgaatggttagaaagatcatgaagaaacagctaattgaagtggataactgtcgcctcctggtcaccgcagccgacgctgtgacaaatgcaactgagttggccttttctctggatgagatgaagatcatatctacctgcgcgaaatgtatcaacggggctgacccctccgccattgacaagatcggaaacgcacaggattcattctttgacaatttaaaaaggcggggcagcgatcgttgcgccctcctgttcagtcaacttaagctggacaagttgtctcagaacttctatatgatttccagcgatgacaaatcgaagatcctcatatcaattctggatagaatcagggctaaatctaatagtgttgacctatccctggtagggggagccaagcatgcagctcagatgaaatttgatttcaacgccaaacttaataaccctgcgagctcttttgtgctcatcgaccagagcgtcacgggcatgttcgaacgccggacccgaattggtctgtga

SEQ ID NO: 3289 - RNA, 4203 nt, synthetic construct
  misc_feature 1..4203: note = Cas9 variant
  source 1..4203: mol_type = other RNA
atgaacctgagaaatgccaccggcgactacagcatcgggctcgatcttggaacaaactccgtgggttgggctgtcactgactctaatggctcaatggcacacttcaaggggaaacccacgctgggaagtaggttgtttgatgccgcggagaccgctgccggcgcacggcagcatcgcggtcaacgacgtagatatgttaggcggcgctggagattagacctgctacaggggctattccaggatgaagtgaacaaggtagacagcgagtttttcattaggctgcggcagtcccgccttcacgtggaagatcgagccgagggacatgctggctacagatggcctctgtttaatgacacagatttcactgaaaaagactattacaagaggtttccaaccatatatcacttgcggaaatggctcatggagacagatgagaaggcagacatccgtctgatttacctggccgctcataacatcgtcaagcaccgcggcaatttcctcagagaagataacaaaaatttatcttcgcacaacgccaatccggcggaggcagtgaggtcactgcggcaagcccttgacgactggtgcgctgaacgagggtatgtttgtgcctggaccagcgtggatgacttggcagaggctgatagtcatattctggacatcctaactaactccaaggagcgcagagccgatcaggcgaaagaactcgccaagctgtttggagtcgactgcggtgatacaaaacagtctaagagctgtaattccgcacttgctaaggccgtggtaggcctgaaaaccgagttgaaggacgttttcggggaattttgcgctgagaaaacggccatacacctctcaagtgatgacgatgtggaagcaatcagggacgccattcccgacgatagcggagagctgttccaggtcttatgtgctgtgtactctgcgtacgtgctgcaagagctcctttcctatgcacctggccagactatctcagccaacatggtcgctaagtacgaccagtatggtaaagatctgaagttgctcaaaaatctggcccggacctacgttagccgcgaaaactatgacgcatttttcagagggcagacatacgaggatagtaacgactataatgtggataaggcccaaggatacactaggtacaacctcggcaccacaaaggcttcttatgacgatttcaaaaagtccgtagaaaaactgtttaagggcacccaggccgagcaggacaaacgttaccaagggatgatgaagcggttcgcagaagagaagtttcttcgaagactgaaaacgagcgataatggatcgatttattaccagttgcatctcgaggaactgagggcgatcttaaagaaccagggtaaacaccacccattcctgctagaggaagagaagaaaatagaatctctcgtgtcctttcgcattccctattacgtcggccctctgtcaagtaagaatgctagccttgaccataaggggaaacagcggttcgcctggtccgagagaaggccaggaatgaaggatactgtgatcacaccctggaactgggaccaaattatcgactgcgatcagtctgcagagaaatttatcttgcgcatgaccggcgactgtacttatctgcagggtgaacctgttctcccaaagtgcagcctgctttacgaggaatactgtgtgctgaatgagttgaacggggcccgatggacaattgatggcgacgattggcggcgtttcgacgtcgctcagagagagggaatactccacgatctgtttaggaaaacccgctcagtggcctataataaggtagcagactggttagaacgggaggaaaactgggctaatgcccatgttagaggcgggcaaggagagaacagtttcgaatccaagctgggtagctacatctttttctgcaaagatgtgtttaagacggcggccctagacgaggctgattatccgatgattgagcagatcatactctggaataccctgttcgaagacagggcaattcttaaacgaaagatcgagcaggcctacggcgaacaccatgggggaaaattgacagatgagcagatcaaggtcatttgtaaaaagcgcttcactggctggggtcggctgtctagaaagctcctgaccgggatcaaagtggacgctgacacaggcagggtctcaattatggatgtgttacgtgaaggaaaccccaatgagggccaacgcagtcggactatggttctgatggaggtgcttagagacgaagatttggggtttcagaagaaaatagacgatttcaacaaggcctattttgcaggacagggtgagggcctcatgagcgtaaacgacctgcctgggtccccagcgatcaggcgatctattaatcaggccatccggatcgtcgatgaaattgcttcgatagccggaaaagcacccagcaacgtgttcatcgaggttacccgcgaagaggacgatcctagaaagaagggcaggcggacaaatcgaagatacgaggacattaaaaacgctctagaaaattttaagaccgaggatcaagaactgtggtccgagctcctgggtaaagccccaaacgaccttgacgagcgcttgtcactgtatttcatgcagagggggaagtgcatgtacagtggccgtcccatcaaattagaagaactccacactggaaagtacgaagtggatcacattatcccgcggtcttatataaaggacgatagctttgagaataaagtcctggtgtgcagagaagagaaccagaggaagacgaatgagatgcttatcgaccctgcaattcgccgaagaatgggcgattactggcggatgctgcataaagccaagttgatcggggacaaaaagttcaacaatctctttatgagggatcgcattgacgataagacactgaaaggattcgtagctcgtcagctagtggaaacctcccaatcagttaagctggtccagactctcctggaggtgagatatcccaacaccaaaatcgtgccagtcaaggcgaatataagccacgaccttcgggaagccgcagatttggttaaatgtagggaggctaacgactttcatcacgcccacgatgcctacctggcttgccgcgtgggcttattcattcagaagcgacatccttctgtgtatgcaaatcccatcggtctctccagagtaatgcgggactacgccaggaaacaagcgggggaatttaacaagacacacagtatggctcataccaagggattcattgtcaacagcttcatgacttctgagtttgacaaagagacaggcgaaatcttctgggatgccgaggcagccgtggaagacatacgcagagttctgaattataggcagtgttttatctcccggatgccagtggaggatacgggtgctttctgggaccagaccatttactcaccccgtagtaacaagcgccttgaactgcctctaaaagatgacctcgatccaaataagtacggcagctattcgcgagagcagtttgcatacttctttatctatgaggccagagacgcgaaaaagtccaagactgtcctgaggttcgctcaagtgccggttcgggtgacatctgccattgcacgcgatagctcaaaattggacgaatacgccagtgggctggctgtacaggagggattagaatttaccaagatcataagaaggcggattctcaaaaagcagctgcttgagctgaacggcgatcgattggtcatcacaggggccaaagaggtgagaaatgcaactgagttcgcttttaccctcgaggaaacggccctggtggcgatgtgctccgagatcgcccgcgaaggagtcccctctgagattgcaagcgacgttcagtccatctcaagccaactaagtgatctgttccttgctctcattgagaggggcctgaccataggtgtgcggttgcacgggcagctgaagttaggacagtatctccgtcaattcgaagacgccgctctgagagacaaggcaaaagtaatcattggcatcatttctatcacaaacggtgccactaatacccttgatctgtccagcttgaacggctcgaagaatgtggggcaggtcaggataacacataacaaactcctgaatgacaagtcaacttcttacgtgctaatcgatcagagtgttaccggaatgtttgagcgccggacgcgaattggcctgtga

SEQ ID NO: 3290 - RNA, 4203 nt, synthetic construct
  misc_feature 1..4203: note = Cas9 variant
  source 1..4203: mol_type = other RNA
atgaagaccatcacagaggactacattctgggcctcgatatagggactaacagctgcggatgggccgtgatggacaaaaagaatagacttctgaggttgcggggtaaacgcgctatcggctcccacttattcgaagaggggcattctgcagccgatcgacgttcatttagaacgaccaggcggcgcctgaagagaaggaaatggcggctacgcctcctggaagagttctttgcggaacccatggctaaggtcgaccctgccttctttgttcgacttcaccagagttgggtgagcccactggataaggacaggaaaaagtatcatgcaattgtattcccgacagccaaagaggatcacgagttttaccatgactatcccactatctaccacttgagagatgctctcatgcgggaagaccgtcaattcgatctgcgcgagatttttctggcaatccaccatatagtgaagtatagaggaaacttcctccaggacacccctgtcaattcctttgtggcctctaaaatcgatgttgcttcgttcttaacaaacgtgaatcaggcctacgcggacaagtatggcgaggagcagaactttattgagctgaatgaaaacaatgcagccgctatcgaggccgtcattaggggtaaggacaaagataagaccactaaacaacttgacaaggcgaaaaagatcacaaaattgctgcagtcaagcaccaacaagtacgaaaagaatgtgacgcggcagatagctaacgccattatcgggtacaaaactcagttcgagaccattctaggaaaggatatcgacaaaaatgataaggcggactgggagttcaaactcagtgatggcgacgccgatgacaagctggaaaaccttctgccagagtttgatgacaatgaccaatatatcgtagcagaaattaagaaattgttcggctccatagctctctctcagatcgtttacgagaacatgacactgagccagtccatgaagtgtaaatataaggatcacggggaagactacgatttactgaaacagtatattgccactctctcagaccatagtcaagtgcgaaaacttctgttggcttacgatctatatgtcaacaatcgccacggaagactgctcgaggccaagaaagaatttaagcaggacaaagcactgacccaggatgagttctacaagatcgtgaaagagaaccttgacgatagccaactggcccagaagatattgcagaagattgacgaaggtaaatttatgcccaagcagagggtgaataaaaacggctacatcccttatcaactccaccagatcgagctggatcagattatcgctaatcagtctaagtactatccattcttagcggaagagaaccccgtcaaagaacatcggaagcaagcaccttacaaactggacgagctagttcgctttagagtgccatattacgtagggccgctcatttcccccgatgacaagaggaaggacgagcagcagaataaaaaccacgaaatgttcaagtttgcctggatgaaacgtaaggatgacaatggagctataacaccttggaacttcgcccagaaagtggatcgggagacctcagcaaatcgatttatcaagagaatgacggtcaaggacacttatctgattggcgaagatgtgcttccagccaggagcttgctgtaccaaaaattcgaggttctcaacgagctgaataacatccgcgtgaatggtaagcggcttgaacccaaatttaagcagaaagtcttcaacgagctgttcaagcagaagaacaaagtgacaaagaaggcttttaaggagttcatcttgcagaataccgggatgaaaactgccgaaattgacggactcgcagatcctacaaagtttaacagttctctgtccagctactatcatttaaagtcgaccaaagtattcgacaagcaactggatgacccacagtaccaggcggattttgagaaaataatcgaatattcttccattttcgaggacgctgaaatctaccaagagaagctacacaaagaaattaagtggctcacgcccgcccagtttaaagcaatcgccaattggagactgcagggctggggcaggctttcacgcaagttgctggttgagctcaaggggaaaggaggtgaaaacataatctatcagctgtggaccacacaaaagaatttcatgcagattgtgaacgagccggagttgaaaaaggctatcgtcaaagaaaatcatcaggccactgaggaaaagggcattgagaagatcctggatgacagttttaccagccctgcaaacaaaaaggctatacgacaggtgattaaagtcgtggacgatgttgtgaaggccgcagggggcaaaaagcccgcccaattcgctatcgaatttacacgggagccaaagtggaatcctcacctttccaacattcgtggaactaaattgctccaggtatacgaggacaccgcaaagaaactggtcgatcagtctctaacagacagcctgagagaaaatatgaccaacaggaatctcctgaaggatgagtatttcctttactttatccagggtgggcgcgacgcctacactggcaaaaagatagatatcgacgatattcccaagaaatatcaaatcgaccacattttgccacagtcattcatcacggatgacagtctggacaaccgggtgttaacagaaatagagattaatcagaagaaaggaaagaaatacgcttcccatctcttcgcccccaagcctgcatttggcctgaaccaaagcatctctgagatgtggaagacctggcagaaagcggggcttatctcacagagaaagctgaacaatttactcttcgatccagacctggttaaagataagcagaaaaagggatttattaacaggcagctagtggaaaccagtcaaatcattaaactggtcagcataatcctccaggacaagttcccggatactgagattatcacagtgaaggccggttataataccgctctgcgaaaagaacttaagttgtacaaatcccgcgaggccaacgactatcaccatgcaattgatgcttacctgactgccatctgcgacaactttttatatcaggtataccccaatttccggccatttttcgtgtacggccaatttaagaaattctctcaggatacagacaagcagaagaaagcagttaagtattacgggctcaaaaattttctgcttcctctgctagatgactcgacgggagatgaagtcatggtgaaccacaccaagcacgtggtcttccataaacagagagacatattcaataggctcatccaagcctataactacaagtatatgctggttagccgtgagactacaaccgaaaattccaacatgtttaatatgacaatttacccccgcggcgaacgggacagaaagaaaactaggaagttgatccctaaaggtaaggatctggacccagctatttatgggggctactcaggaaacaccgatgcgtacatggtgatcgtgaaaatagagaagacgaaggaaaccttatataaagtagtcggcgtgcccatgcgagccctcgcaagtctgaagaaagctcagaaggaggggaattacgaccaggaacttaacaaagttctggagccgttgattatgttcaacaagaatggaaaatctaaggccggtatcaagggctttacagtggtcaaagatcacgtgcatttcaagcaggttgtgatcgacggggatagcaaatttatgctctattccgcccaataccgggctaacgcaaagcagctgactctatcacaggagaccatgaaagtagtcacagacaatactgatgacatggatcaaaagaacgccgacaaggatcagctgcttctcaatgcgtatgacgaaattctggagaaagtggaccagtacttgcctctgttcgatataaacggatttcgccagggcttacacgacggtagagctaagttcgccgcactcaaaaccagcgaaaagaaatatacgctgaagaatgtgcttaacgggctgcatgataatttggtcacaccaaacctcaagaatatcggcattaaaaccccctttggactgatgcaatcttccagtggcatcactctaagccctaacgccaagctggttttccagtctcccacagggctttttgagaaaagggtgaagctcaccaatctgtga

SEQ ID NO: 3291 - RNA, 4203 nt, synthetic construct
  misc_feature 1..4203: note = Cas9 variant
  source 1..4203: mol_type = other RNA
atgggcaagcagaaattcaacgactactatctggggtttgatatcggaaccaatagcgccggttgggctgtgacagacctccaatacaaacttctgagattcaacaaaaaggatatgtggggctccaggttgtttgacgaggcacagacttctaaagaacggcgcgtctatcgaaattcacgtagaaggttagatcggcgcaagaagagactgaaactactcgaggaactgttccttgacgagattagtaagatagataacacgtttttcaaaaggctgaaggaaagcaatttgtacaacgaggacaaatccatcaagtttaattatcccctcttcaacgataaggactacaccgatattgacttttataatgagtacaaaacaatctaccatctgcggaaggatctgattttcgaagacaaaaagtttgacatccgcctcgttttcatagccttacaccacatcctgaaatatcgagggcattttattttcgagggacagtctttcgaagagatcaagtcgtttgattcaattttcactcagcttagcagttactttttggagaacttcgactttaatatcgatgtgtccataaaagaaaagctggaggaaattatcctatctgacaacaccaagagcattaaaaagacagagttcaaaaagatcttttccgataataaagtactctcagtgctgaacatggcgatcggcagtaaggtcagccttaaggacgtgttcaataacgaggaactgaaagagcaaaagatttctttttccgaaatagattatgagaacgaaaagagagacgagttctaccagttgctcggtgaagatatctttctgattgacttagctaagaaaatctatgatttcatggttctgaagaagatactcaaaaataccgactcatttagcgccagtaaggtggcactttactgcgagcacaaaaaggacctggatgacttgaaatatattttcaagaagtacctaactaaagaggattacttcaagtttttcaggtctaacgtcgaaaagatcaattatccttcctacatcgggctgaacaagattaaaagcaagaaaatcattaaggagaataagtgttcgatatctgacatcaacaaagaactcaagaataaatatctgaaggatattaaacttgaggccaaggacaaggaactgtttaaccggatcttcaataaattggatgagtttaagttcctcgagaaactgaagtcctcagaaaacagtacagtgccataccaggtacatgagatcgaactgaaaaagattctggacaatcagcgtaagtattacccgtttctaaacgagaaaatagatggaaagagcgtttatgagaaaatcattcaactcttcgaatttaagatcccctactacattggccctctgaataccgacccaaacgtgaaaggcaagaatacgtgggtcgtgcgcaaggatgagaacaacaaaactcccatcaccccttggaatttcgaacagaaggtggacatgcagaaatccgctgaggaatttataaagagaatgacaaacaggtgcacttatcttaaagcagaggatgtcatcgccaaaaattctttgctgtacgaggagttcattctcctgaacgaacttaataaagttaccgtggacaacgaaatcctgcacccaacattgaagaccgagattatcaatgaactctttaagacgactgtaaaagtgacaaagaaaaagttcatagagttcctgaaaaagaagcaggctgtcaacgacgtggagagcattaccgggatcggagttgaatttaattgtaaattacaaggttataacactttccggaagattctgggcaaaaagatcgagaatgtgaacgtcaaaaattttgtggaaaagtgcatagagctaaagtgtctctacgggtcagataaaaagctgttcgaaaacgccatcggaaaaatttatcgagagtacaatatcacagacgaggaatttaacaagattaaccgccttaatttcaacaaatgggcgagattgagtaagaagtttctgaccgagatctccttcgagaaaacggatggcaccaagaggtttgaaagcgtaatagaggcactccggtctacaaattataacctgatggaattactgtcagacaaattcaatcttcagagtaagattgatgagatcaacggtgaagacgattttagcaatatcgacattaaagagtacgttgataagttgtacgtgtccccctctgtcaagcgctcgatcattcagacttataaaatagccatggaaatcaagaaaattaccaagaaagaccctaagaaaatcttcattgagatggctaaggataagggggagaaaggaaagacaactgagaaaagaaaggacaaaatcaagaagctctacaaaaacataaaggataccctgagcgactattgcaataacctacaagacctgacactccaggtggaaaaatacgatgacaataggctgcgtcagaagaaacttttcttgtattttatgcagatgggcaagtccatgtacaccggccggtgtatcgatctggaagacttattcaacaataacgtctatgatattgaccacatctacccacaatcaaaggtgaaagatgacagttttgataatattgttctcgtggagaaggaagagaaccatcgaaaatctaacgagctgcttaaggaagagatccagagcagaatgaataactactggatattcctgagggaaaataaatttatttccaaggagaagtataaccgcttgactcggaaaaaggacttcacggatgaggaactcggggactttgtagccagacagctggtcacaaccaggcagtcaactaaagagatcgcaaagttctttgagaaaatcttcgaaaagaccacagtggtttacagcaaggcttctctagtgtccgaatttcgcgagaagtatgacattataaaggtccgagaggtgaatgatgcccaccatgcgcaagacgcctacctgaacatcgtagtgggaaatgttttcaacaccaaatttactaagaattattggaaattcacaaaggatattaaacggcagaacgaagagaatccgaacgaaaagaagggttacaatctccgtaaaatctatgagagtgacgtcttctgcaacgatagcgtggcatgggtgtactctaaggaaaatcccaaatacaacacgattaataccgtcaaggacatggtttatagaaaaactgctaacatcacaaggatgctggtggagggcaaggggcagctttttaacttgaccataaaggataaaacacagctgaagaaaaatgtgggaaacatcgtagccaatactcctatttccttaaagaaccgcaaactccacttaaattcagtcgagatcgctaagaagtacggctatttcgacagtcttaacaatgcctactttgtgctgttcaaatatgaagagaagggtaaagaaaagattgggtttgatagcatcaccatagcatacaaagagcggctaaagaaaaacctcgacattgaaaagttcctggagaataagggctataaaaactcgaagttgatcagaaaaatctttaagaatcaaaaagttctgattaacggatacccatacttactcaagtccttcaataagcagtctcagatcaaatttaacaatttcaagatactgtatcttaacgagaacaatctgaaatttgccaaggatgctattaaattcgaaaagaacaatgcgaacgtggacttgaagaaacagaagtacatcgtcagctttctcaaaaagaaaaagcaaaatgagattaacgaaacgtatgaggaatgtatcgataggctgaatgacgagttcgacaccctattcctgaaactttgcgatatacagaaatcaagtatttacacaaactataagctccaggacttttcctctaataaaaagagcatcgagatcaaagataagttcgacatttttaagtccctggatttgtacaaaaagtcaaaactgatcaaggagttcttaaactattacaaatacgaaaagaatgacctcgattttagcctgattgacatagataaaaaggcaaactgtatccaaaagcacttcactgaagaccttgtgaaagattttgttattgtggacgagagtgtaaccggcctgttcgtcaagaaagagcgattgaagtga

SEQ ID NO: 3292 - RNA, 4203 nt, synthetic construct
  misc_feature 1..4203: note = Cas9 variant
  source 1..4203: mol_type = other RNA
atgaagaccatcacagaggactacattctgggcctcgatatagggactaacagctgcggatgggccgtgatggacaaaaagaatagacttctgaggttgcggggtaaacgcgctatcggctcccacttattcgaagaggggcattctgcagccgatcgacgttcatttagaacgaccaggcggcgcctgaagagaaggaaatggcggctacgcctcctggaagagattttcgcggaacccatggctaaggtcgaccctgcctttttcgttcgacttcaccagagttgggtgagcccactggataaggaccggaaaaagtatcatgcaatcgtatttccgacagccaaagaggatcacgagttctaccatgactatcccactatttaccacttgagggatgctctcatgcgggaagaccgtcaatttgatctgcgcgagatcttcctggcaatacaccatatcgtgaagtatagaggaaactttctccaggacacccctgtcaattccttcgtggcctctaaaattgatgttgcttcgtttttaacaaacgtgaatcaggcctacgcggacaagtatggcgaggaacagaacttcatcgagctgaatgaaaacaatgcagccgctattgaggccgtcatcaggggtaaggacaaagataagaccactaaacaacttgacaaggcgaaaaagataacaaaattgctgcagtcaagcaccaacaagtacgaaaagaatgtgacgcggcagattgctaacgccatcattgggtacaaaactcagtttgagaccatcctaggaaaggatatcgacaaaaatgataaggcggactgggagttcaaactcagtgatggcgacgccgatgacaagctggaaaaccttctgccagagttcgatgacaatgaccaatatattgtagcagaaataaagaaattgtttggctccatcgctctctctcagattgtttacgagaacatgacactgagccagtccatgaagtgtaaatataaggatcacggggacgattaccatttactgaaacagtatatcgccactctctcagaccacggacaagtgcgaaaacttctgttggcttacgatctatatgtcaacaatcgccacggtagactgctcgaagccaagaaagagttcaagcaggacaaagcactgacccaggatgaattttacaagatagtgagggagaaccttgacaatagtcaactggcccagaaaattttgcagaagatcgaggaagagaagttcatgcccaaacagcgggtgaacaagaatggctttatcccttaccaactccatcagattgaactggatcagatcattgctaaccagagcaaatattacccattcttagcggaggaaaatcccgtcaaggagcaccgcaaacaagcaccttataagctggacgagctagttagatttagggtgccatactatgtagggccgctcatatctcccgatgacaaacgtaaggataagcagcagaacaaaaatcatgaaatgttcaagtttgcctggatgaaacggaaggacaacaatggagctatcacaccttggaacttcgcccagaaagtggaccgagagacctccgcaaatagatttattaagaggatgacggtcaaggatacttacctgatcggcgaagacgtgcttccagcccgctcattgctgtatcaaaaattcgaggttctcaacgagctgaataacatccgggtgaacggtaagagacttgaacccaaatttaagcagaaagtcttcaatgagctgttcaagcagaagaacaaagtgacaaagaaggcttttaaggagttcattttgcagaataccgggatgaaaactgccgaaatagatggactcgcagaccctacaaagtttaacagcagtctgtcttcctactaccacttaaagagcaccaaagtattcgataagcaactggacgatccagaatatcaggcggactttgagaaaatcattgagtactcgtctatcttcgaagatgctgagatttatcaggaaaagctacataaagagatcaagtggctcatacccgcccaatttaaagcaatcgccaattggaggctgcagggctggggccgcctttcccgaaagttgctggttgaactcaaggggaaaggaggtgagaacattatctaccagctgtggacgacccagaagaatttcatgcaaattgtgaacgagccggaattaaagaaggctatcgtcaaagagaatcaccaggccacagaagagaagggcatagaaaagattctggacgattcatttactagccctgcaaacaaaaaggctatcagacaggtgattaaagtcgtggacgatgttgtgaaggccgcagggggaaagaagcccgcccagttcgctatcgagtttacccgtgagccaaagtggaatcctcaacttagccacataagaggcacaaaattgctccaggtatatgaagacactgcaaagaaactggtcgaccagtccctaaccgattctctgaaggagaacatgacaaataggaacctcctgaaagacgaatacttcctttattttatccagtgcggtcgcgatgcctacaccgggaagaagattgacatcgctgatattcataaaaagtaccaaatcgaccacatattgccccagagcttcattactgatgactcactggataatcgggtgttaacggagatcgagatcaaccagaaaaagcataaaaagtatgccagtcacctcttcgcaacaaagccagcgtttggcctgaaccaatccattagcgaaatgtggaaaacctggcagaaggccggacttatctctcagagaaaactgaataacctactcttcgaccccgatctggttaaggacaaacagaagaaaggctttattaataggcaattggtggagacttcacagataatcaagctggtcagtattatcctccaggacaagttccctgataccgaaattatcacagtgaaagctgggtacaacaccgccctgcgaaaggagcttaaattgtataagagccgcgaagcaaatgactaccaccatgctatagatgcctatctgactgcaatcaacgacaactttttataccaggtatatccaaatttccggccgtttttcgtgtacggacaatttaaaaagttctcccaggatacagacaagcagaaagaggccattaagtactatggtctcaaaaattttctggagccccttctggatgactctacgggcgatgaagttatggtcaaccacaccaagcatgtggtgttccacaaacagagagacatcttcaataggctaattcaggcttacaactataagtacatgctcgtctcgcgtgagactacaaccgaaaatagcaacatgtttaatatgacaatctatcctcgcggggagcgggatagaaagaaaactaggaagctgataccaaaaggaaaggacttggatcccgcgatttacggcggttattccgggaacaccgacgcctacatggttatcgtgaaaatcgaaaagacgaaggagaccctgtacaaagtggtaggcgtccctatgcgagcattagcttcactcaagaaagcccaaaaggagggaaactatgaccaggaactgaataaagtgcttgagccactgattatgttcaacaagaatggcaaaagtaaggccgggataaagggatttacagttgtgaaagatcatgtccacttcaaacaggtggttatcgacggtgattctaaatttatgttgtacagcgctcaatatcgggcaaacgccaagcagctcactctgtcccaggaaaccatgaaagtggtaacagacaatactgatgacatggatcaaaagaacgcggacaaggatcagctactgcttaatgcttacgacgagattctcgaaaaagtcgatcagtatctgcccttgttcgacatcaacggctttcgccaggggctgcacgatggcagagccaagttcgcagccttaaaaacctcagagaagaaatacacgctcaagaatattctgaacggacttcatgacaatctggtgacaccgaacttgaagaatatcggtataaaaaccccttttgggctcatgcaaagttcttccggcatcactctgagtccaaacgctaagctagtgttccagagccccacaggactgtttgagaaaagggtcaaacttaccaatctctga

SEQ ID NO: 3293 - RNA, 4203 nt, synthetic construct
  misc_feature 1..4203: note = Cas9 variant
  source 1..4203: mol_type = other RNA
atgaagaccatcctgggcctcgaccttgggacaaacagcattggatgggccctggtgaaagagactgaaaattccaacgagaagtctgaaataatcaaattgggtgtcagagttaatcccttaacggtggatgagaagaccaacttcgaagctggcaggcctctgtcaacaaatgcagaccggactgccaaacgcagtgcgcgacgtaacctacagagatacaagctcaggcggaagaatctgattgatcttctgatcaaacaccgcttgattgacaaggataccccactcacagagatcgggaaaaacaccactcatcaaacactggagctgagagctaaggccgcaagggaacggatagagctcgaagacttagcccgcgtatttctggctatcaataaaaagcgaggatatagaagctccaggaaggtgaacaatgaggaggaaggccaggtcgtggatggtatggcagttgccaaaaagttgtacgacgagaaccttaccccggggcagtatgcttacgaactgctatctaaaggaaagaaatatgtgcccgatttctaccggtcggacctccaggccgagtttgattcaatttgggaatatcaaaagcagttctacgcggacatcctggatgacgagctttacaatgcactgaaaggccagggccagcaaaacagccgtaagcgctttttggccattaagggggtctatacggctgagaataaaggaaagagagacgaagtgaaactccagcactacaagtggaggagtgaggccatcactcagaaactgtccatagaagaggtagcatatgttttagtggaaattaacaacgatctgaataagtctagcggttacctcggcgctatctccgaccggtcaaaggagctttatttcaacaaagagaccgtcggggaaaatctgtggaagcagattcaaaagaaccctcatacaagtttgaagaatcaggtgttttaccgacaggattatctagacgagttcgaacaaatctgggagactcaggcccagtttcacccacagctgaccctcgcgctgaaagaacaaatccgcgatgtggtcattttctaccagagaaaacttaagagccagaaaggactgttgtctttttgccagttcgagtcctgggagatagaaaggaaggacgagaacggcaatgttatcctcaacaaaacaacccaactgcccaagcggcagacggtgggtcgcagagtagcccctaaatcaagcccattatttcaggagttcaagatttggcagaatatcaacaatctggagatagcaaagattagtgatgggaactctaaaaataagaaagagactgaagctctatccgacgatgagaggaagctcctgttcgaagaacttaacttgcgtggaaatctgagccaaaaagaagtgctccagatcctgggccttaaggacaaagagtacaagacaaactttcccgagggcctggaagggaaccggaccaatgccgctttgttcaacatctatcagcagattgccgagaatgaaggatacggtgattggactaagaaatcggcacaagagatcaaggaggaactcaaagccgtctttcctcagattggcatacaggctgacatcctggacttcaacgcggagttagatgggaaggaatttgagaatcaagcatcttatcagctgtggcatctactctactccgccgaagaggacgataaaattaacgaagaggaccagatcatctatggaaattcagctgtgagtctgaagaagaaactttgtgagaagttcggctttacaccagaatacgccaaatggattgcaaacgttagcttgcaggatgactatggtaatctgtccaccaaggccatgcgaaaaataatcccgtacctcattgatgggaacgactactctgaggcttgcgccctggcaggctataatcacagcaactcattaacgaaggaagagaatgataacagagagaggctgaataaacttgaattgctccccaaaaacagtctgcgcaaccctgtggtcgagaagatcctaaatcaaatggtgaacgtagttaatcaggtgattgaaacctacggaaaaccagacgaggtccggatcgaactggcgagagagctcaagaaatccgctgaggaaagggccgagatgacaaagggcataaacgaagcaactcgccgaaatgaggatatcaagaaactgattaccaagaacttcgggatccccaatcctacaaagaacgacgtggtccggtatcgtctttgggaagagttggccccactggcttacaaggatgtgtttactggaagacagattaaaaaggaggacttattcagctctaaaatcgacatagaacacattatccccaaggccctcctgtttgatgactcattcagtaataagacccttgcatttagggagacaaacctgaaaaaggctgatcgcaccgcctatggtttcattgaaagcgactacaatgcgactttggatgactatatccagcgggttgagacgctctacaacaatgccaaaggcacaatatccaaggggaaaagaaacaagctgctaatggctcaaaagaatctgccggatggattcatcgaaagggacctccgaaactctcagtacattgccaaaaaggcaaaatcgatgatcgagaaggtgtttaacgatgtaaatgtcaccagcggctccattactgaccgcctgcgggaggattgggaccttatcaacgtgatgaaagaattgaatttccctaagtataaggctctgggtttaaccgagatagaagagagatacgatattgggcaggagaaaacaaagaaagttgaagtgatcaccgactggactaagaggaacgaccatcgtcaccatgccatggatgcactcacagtcgcgtttacgaccaaatcacacgtgcagtatctgaataaccttaatactatccacagtctgaagggcgacgaggtagatctagaactctctaagctgtacggattgaaaaacacaattaccgaggtggttaataagaaacgcaagttcattcccccaatgcctaactttcgggaagaggccaaaaagcatatcgagacaatactggtcagcatcaagaataaaaacaaggtgtatactaaaaatattaacaagaccaaaaaggaatccggctaccacacgaaagagcaattaacccccagagggcagctccataaggaaacagtgtatggaaagtcaaaaaggccaatgaataagcccactaaaatcaacaagaatttcagcctggagcaggctcaacttattatcaacgtccaggaaaaagagctggttttgcgacacctcgcccagtttgacaacaatcctgcagtggctttcgataccaagacactgaagaaaatgccactactgaagaacggtgagccgcttaaagaagtgctctgttttgaggaaatattcactatccggaaggacattacccccgatctgaaaatcgagaaggtagtcgacgaaaagattaaagccatcttggagcagcgcaagaaagattttggcgggaatgcaaaggaggccttctctgacctggataaaaaccctatatggttaaataaggaaaagggaatttgcatcaaaagagtgacgatcacaggcgtttccaacgctgaggcgctccatcaccaaaaggaccacctgggtagggaaattcttgacgataatgggaacccaatacccgccgactttgtgagtaccggcaataaccatcacgtcgcaatctacgaggatgagaaaggaaagctgcaggaaaaagtggttagcttgtacgaggctgtggcccgggccaatcagggcctccctgtagtcgacaaggggctgaacgaagatctaggatggaaattcctgttcactatgaagcagaatgagatgtttgtgttcccaaacgacgattttgacgtgaatgatattgaccttctcgatgaaaacaacgctaagatcatttctcaacatctgttccgagtccagaaattggcaacaaagaattatatgtttagacaccacttagagaccaacgttcaggaggtgaaagaactgaatgacatcgcctacaagtccatacgctcaactgagcccctcaaaaacatcaagaaggtaaggattaatcatatcggcaaaattgtgcaggtcggtgaatattga

SEQ ID NO: 3294 - RNA, 4209 nt, synthetic construct
  misc_feature 1..4209: note = Cas9 variant
  source 1..4209: mol_type = other RNA
atggccaagaaagactacaccatcggcctggatattgggacaaacagcgtgggatgggctataatcgacgataatctcaaacttctgaaaagaaacatgactattaagggtaatacggacaaaaagtccgtcaagagggatttgtggggctctttactgtattcagggaacagtgacaaaaccacaagcgcagccgatgcgcggtccaagcgcggactacgacgtagactcaggcggcgcaaatacagactggacaggcttaagcagatcttctctgagattatcaatgataaagctcccaactttttcgacaagctgaatgaatcgtttttgaaccctaaggataaaaagtatggcaaataccaaatattcgacactgagaaggaagagaaagattattaccggcgctatccaaccatctaccacctccgaaaggacctgattgaatcaagcaaaaagcaggacatcagactggtttacctcgccttagcacatattctgaagagtaggggtaattttcttttcgaggggaacatcgatgacttgaaaaatgattttgccggaatatatgaggaagtggtagagctgtgcatgacaattaacgctgaagacgtggatctagagttcgaggaagtcgacaagcagtccctcaattctatcattaaaaacgaggatatcagcgaaatcgagcagggcctggaaaattttgcagacgagcacgtgattttcaaggagcaaaacaaaaagaagaacgatctgttttccaattgttgcaaaataatctgtggccataccgttaaggccaacaaattcgcttcagaacttgacagtgagttgtttattagcttcaagtctgatgactacgtggacgtcatcgatgtgatacagtccgggaatgaaaacattgccaatctcctgttagcgtgccggaaagcatatgactacatcatgttcaaccgtctggtagatctcaatatcgactcaccggccaaacttagcagtaacatggtttctctgtataatcagcacgagaaggatttgaaggcttacaagaaactaattaaggaatttaacaaattcaagcgctccaatggatgtaaggacctggagatgatcattctcactgccgatgacatagatagctttagaaagaaggtggacaaaaaggagggtaaactgaacggcatcaataagaaaattacacatgaacaggcacttaagaagcaactgaaagatatgaagaaaatcttggaggacaagaacaccgaagctgaggataaacagatcaatgacattctcaagatgataacgtcgatcgaagagagggtcaacaagtcttgcttcctgaaaaacttacggtccactgacaatgcctcaattcccaaccagatccagcgacaagagatggaagcgattctggataagcaggccaaattttatcctttcctaaatgagcacaaggacgaactcctgcagcttttgagttttcgcatcccatactacgtggggcccctggtgaacaaaaagtatagcagattcgcatggctcgtcaggaaggagggacaagttcagaaaataacccctacaaattttgatggcgtggtagacaagcacaaaactgctgagaagttcatggaacggctgatcggtaaagatgtgtaccttccaaacgagcgcgtcctgcccaaggcctccttgctctatcaggaatactgtatttttaatgagctgaccaaggtggcttatatcgactctacagggaaaaagaacaatttcagctcagaagagaaattaaacatttttgagaagctgttcaaaaccaagagagaagttacgaaaactgatctatgcaagtgtctcaataacgtgtgcaagctgaaagagaaggtcaaagaaacagagatcataggaattaaggccaaattcaatgcaaagtacagtacctatcatgaccttaagaaaatcaacggcatggaacagttgattgccgatgaggagggcaagcctctgtgtgaagacatcatatccatcctcactatttttgaggataaagacatcaggctggtgcgtttaaaggaactgctttgccaaaataaagatttgattaacaagttcagcctctctgctgagaagctggcgaaagtactatcaacaaagcactacaaagggtttggaaacgttagtgcaaagctgatcaatggtatacgggacaaaaactgcaagaccattctcgactacctgatcgaagatgacaaggaggcctattacggccgaaataacccaaatagaaaccttatgcagttggtgaatgatagcaggctggctttcaaagggcagatcgaccgcgagcagaacacgcatttagaagatctctccctggacgagtttcttgatgacctgtatgtctctccgtcgattcggagaggaatcaggttgaccattcgcctcgtggatgaactggtcgagataatgggctacctacccaagaatatcgtgattgagatgcctcgagaagacggtgagaaagggaagatcgccgatacacggtatagcaaactggaaaagatgctcaagaaagacgcagccctggaggacctttaccgtgttttgaagacttatgagaaaaacaagaaagctctggccaatgatgcattatacctctacttcctgcaaaacggcagagacatgtataccggaaaggaaattaatctttccgagctgcactcatacgatatcgaccacataatcccaaaaagttttaagtatgatgactctctagataacaaggtgctcacagcgaaaaagatgaatatggacaaaaggactggcgctctggatcataacattatcgaaaaccagtgtgggttctggcgcgtattgctgcagcaggacaagattagcttagagaaatacaccaatctcatgaagacagaatttaccgaggccgataaggcaggattcatcatgcggcaactggtcgaaactagacagataacgaaatttgtggccaggtatcttgacaacaagttcaatggtctgatttccgatcccaacgacaaagttaatatcttgctccctcgagcttcactgtgccaccagtttcgcgagacattcggcttctacaaggtgcgggagctaaacgacatgcatcacgcccatgatgcatatctgaatgctgtcatcgccaacacccttaataaaaacgcgtacctcagcgacctgttgaagtacggggcctattctaagtacaaaaagaatggatttaacaattccaacggcattatggattatttcggtaatactcagtttaactgtctgttcgtggtagaaagaaccttagacaaatgcagggtgaatatagttaagcacccagagacagctagtggggaattttacaacgagaccatccagaaaaacaaggtcaatggcggaagctctactcgttccctcaagtcaagtgtgaaagtgctgcaaaacacagaacagtatggcgggttcacgaatgtcaacaatgcatactttattcttttcgattataaggccaaaagcaagctgaaacgcaagttgatcggagttcccattgtggaccggcaaaaatttgagcaggatccggtgacctacctcgaggctaagggtttcgacgaacctaagctggtacagaaactactgaagtacactcttctcgagtatgaagatggcaaaagaaggtacctgacaggggtcaccggaaagcgatgtgagttggtgcgggccaaccagttactgctcccccgcaatatgatggcactgcttcaccatctgcaagagtggcagaaacacgactttggcatcaaggaaatgacaaaggttatcaaaaacactaataacatagaggcgaagttcgataaattgttcgaacatatgatgaagtttattgacaaatattcggagccacctaagatcgtgtcctctaagattagcgaagagtaccacaaactaagagagtcactgtgccaggatgacaataagatcaaaatatatgccgaaattggtaaggctctcctgagtcttttacacctggtcgactccaaatctgcctgtgtgttcaagtttagcgggctcgagatcaacaggatccggtaccagtccattaatgaaaagaaagagcccgttatcatattccaatcattgagcggcctgcgagaaagtagatataagtacaaccagtga

SEQ ID NO: 3295 - RNA, 4209 nt, synthetic construct
  misc_feature 1..4209: note = Cas9 variant
  source 1..4209: mol_type = other RNA
atgaagctgagaaacgccaaagactacagcatcggcctcgatgtggggaccggatccacaggttgggctgtcactacgcttgacggcgatctgttcacctttaatcacaggcccacattggggtctcggttattcgagtcagcaagtactgcccaggaaacccgcgaggcgcgaggagctcgtagaaggctgaagcggcgcagatggaggattagcctactccaagaacagtttgccgcagagatggaatcctgcgactctaacttctttatacggctgaatcagtcgcgcctttggcaggaggatcgaacagagcaaggcaaaggttatctgttcgggggaaagcctatcttgtgtggcgcccagatttttgctaacgaacaggagtactatcagcaattcccaaccatctttcatctcagaaaattcctggttgaatgctcagaacaggtggacctgaggctcatttacttagcactgcacaatatcgtaaagtatcggggcaactttctttaccaggataataagactttgaacgtgcgtaatttcaacctggacagccagatagccgattttctagaccaactccagctgtggtgtgagaataacgatctttgcttccatgaaatcgacgggacaaccacgctggctagtcagttgaatacttgtttccaccaacagtccaaccagcagaaaaaggataccctcaaaacatttttcgccacttgcattgagaatgacaagatcgcgggagaactgaccaaagcattactgggttataagacagactttaagattatcttcaacatagagggcgaaaaagatgagtacaaggccaaatgtaacgaggaagagaagattctcaaacttcaagaaaccatcgacgatgctaatcaggtcctgttgcagtctattctaaacctgtacagcgggatcatcgtggagaagattctcaataacacggccgttaaaaatgaatccgcacagtgcactctgtcagcttatcattgttacagttatgccctttacagcaagcaactgcgcacattgaagaaactcgtgagaaagtataacccgcagaggtacaatgagtgctttaacctgtctgcggaggaccccaaagccaagaaacagttatgtacctatgcacggtacaatgctcagcactccactgattacgacgagttcaagaagtatataaaagatctgtttgagaacacagacgccgtcaatgatgctgcctaccaacagatgaagcaggacttcgatgaagagaaatttctacgacgccagaagacctcagacaacggagtgtatccttaccaattccacctcgaagagatgcagctgatcattgagaatcaggcacaacattatccatttcttacgaaaatcaagcccaagttggaaagcctggtaaccttcagaataccttactatgttggcccactcacacagaaaggtattcagaggaacgggcggaagtttgcctggagtaaacgcaataaggacgctgagaaccagagaatctacccctggaactgggattctatcattgacaaatccgcgagcgcagaagccttcatcctgaggatgactggaaagtgcacctacctttatggcgaggatgtgctgcctaaggagtcgttgctctaccaagagttctgcgtcctgaatgaattaaacggcgctcgttggaattgtgacggggaacggcgaatgccactgtctaacaaagattgcaaggccatttatagacagctatttctcaaaaagcagaaagtgtcctacgcagacgtgtcaaattatctgaaggcccagggacacataaacaatagtgtcgctggtggccaaggggagcatggattcgaaagcacactttcctctcaccactttttcaggaaattgtttaacgttgatgccgcaaatgacctgactgcgcagcagatcgagaccgctgagcagctcattctgtggggcacaatcttcgaagataaggagatctttgaacaaaagattaaagagcgcttcggtgacatgtttagcaaggatgaaataaaaaccatcgcccggagaaagttctcagggtggggcaaatgtagtaagcagttactgtccggacttactgtggagacgccgaggggccgcgagagcattatcgacgtattgcgaaacgggcatcccgaaaatggacggacactcgtgtttatgcaggtcattaccgataagaaactggagttcgacaagaaaatcgaagagtacaacaatgaacacctagcaaagactaacgagtctgtgctggacaccgccataatgagtcctgctatcaaacgtggtgttaatcaagccctccatattgtgggcgagatcagaaggattacaaagcacgatccaacctgcatctatatagaaactacacgcgacgagaaggatgggaaacataacacgcggacctcaagcagatactcctctctgaagaaaaaccttgaaactttgaagtcgattgacaaagcaaatgctcccgccatcaagcacagcctggagttactcgagacatacaagaaacagaacattgatgacaagctgtttctttatttcacccagaatggaaaatgtatgtactccggcaagtcactggatatcaacaatttgagttcttatcagatagaccacgtcatccctcaaagctacattacagataactccttcgacaatagggtgctcgtatatgcgtcagaaaaccagcgaaaaagcgattctctgctactgtccagtgttatccaggccaagcaggagccattttggactagcctcgaaaaagctggtctgatttctgagaagaagcataataaccttaaacgcaagtccttgtcagacgcacaaatcaaagggttcataaatcggcagctggtggaaaccagtcagattgtcaaggtgttaagagatgagctcagcaggatcctgcccgacacgaaaatcattccggtcaaggcctcgctttcccacgacgtgcgtatcgcttgcaacctgtacaagtctcgcaccgccaatagctttcatcacgcacacgatgcgctactcgcctcaacaatgggccggttcgttcagactagatttcctgacatgtatgagaaccccgtgaggtacgtaaaaattctgcgagcttacatagcccaaagtaagttgcagcattccgcacagacccggaatttcgattctcgcagctttatggctcactccttcttttgtgactattcaaacgaaaacggagatacaatctggaatagcgccagtgagattgaaagactgaggcgggcattatcttacaaaaacctctatctgactcgaagaccattcatcgacgccggccagttttgggatcaaaccatttactcccctcatgacaagaaaaagacgcccgatagccttatcccactgaagaaaaatttggacacacagaagtatgggggatactcgggtaaagattatgctcacttcttcatatactcagtcctcaacaagcagggcgacgtggagtaccgctttgacggggttcccctgtatatcgcggccaatattaacagggatgaccgtggagcactagctcaatacgccaaacagctggtggaacatgagaatgtccctaacgccaagcggaagaccaaagatcttgtgttccagagaatcgagagggcttgcgtaccaaagtatcagctcatttgtatctctcaatgcagtggcgactccgatcgcagcgtgtctgactactattacataactggtaaaaaggaagttcgaaatgcactgcagttggcctttccgatgcacctgtatggggcgattaacgctatcgaggataaaaaggaattagacgatagcgccctcgaggaactggtcgtgtacatccttagaaatgcaccccggattgcccctgacgtgttcaggcgcctgaacttgacagagaagctcgctgattgtctggacataccagatcgtatcgagctacaaaattccatttacggcctgtttaaccttatcaatgcagaatcaaacgtcgttaatctccagattttcggaggcgccaaaaccgcgggggtgaagctgatcaacttgaacagtttactgaatgaccccgctactaccgtgacatttatagaccagagcgtaacgggaatgttcgagagaaaagaaaccatcggcatttcttga

SEQ ID NO: 3296 - RNA, 4209 nt, synthetic construct
  misc_feature 1..4209: note = Cas9 variant
  source 1..4209: mol_type = other RNA
atgggcaagcaggagttcaacgactactatctggggtttgatatcggaaccaatagcgtgggttgggccgtcacagaccaacagtacaaactccttagattcaacaagaaagatatgtggggctccaggctgtttgaagaggctaagactgcaaaagaacggcgcgtttatcgaaattctcgtagaaggttggaccggcgcaagagaaggttaaagctgctagaggaactcttcctggatgagattcttaaagtggactcaacgtttttcaagcggctggaggaaagtaacttgtacaatgaggataaaagcataaagtttaactatcccctcttcaatgacaaagattacaccgacatcgatttttataaggaatacaagacaatttaccatctgcgcaaagccctggtattcgaggaccgaaagtttgatatcagactcttattcattgcgctgcaccacatccttaaatatagggggcattttatattcgagggacagtccttcgaagacatcaagtcttttgactacattttcactgagatccaggattggattttggaaaactttgagatcaatatagacattaacctgaaagaaaagctagaggagatcattctctcgaataacaccaaatcaatcaagaagatcgagttcaaaaagatttttagcgataatcggatactggctatccttaacatgggcgtgggttgcaaagtcgacctgaaggatgtgttcaataacgaggaattgaaagaccaaaagattagttttacagagatcgattatgaaaacgagaagcgtgacgagttctaccagctcctgggggaaggaatatttattgttgatttagccaaaaagatctatgacttcatggtgctgaaaaagatcctcaaaaattccgattacttttctgagagcaaggtcgcactttatgaggaacacaaggaagacctgaaccgcttgaaatacattttcaagaaatacctaaagtcctcagactattacaaatttttcagaagtaatagcgagaagaccaactatccttcttacatcggcctgaataagattaaaactaagaggctcatagagaacaataaatgttccatctcagatattaacaaggaactgaaaaataagtatcttaaagacatccaggtggaggccgaagatgaggagctgttcaaccggatcttgcataagattaatgaaaacaagtttctcgagaaactaaagagcagtgaaaattctacagtaccataccaggttcacgagatagaattaaagaagatcctggacaaccaacgaaaatatcactccttcctaaatgaaaagagcgatggcatgaccctctgcgagaagattatcaaactgtttgagttccgcattccgtactacgtggggccccttaacacgaaccctaatatgaacaagaaaaataagaacacttgggtcgtgaaaaaggaagaaaattcgaagtcttccatcaccccatggaactttgagaaaaaggtggacgaacagaaatcagctgaggagttcataaagagaatgacaaataggtgtacttatttgcggggagaagatgtcatccccaaaaacagtctgctctacgaggaatttgttctgcttaatgagctgaacaaggtgaccgtagacaatgaattgctccatcctacactgaagaacgagattatcgatgagttattcaaaaccacggtgaaggtcactaaaaagaaaattacagaatttctgaagaaaaagcaggcaatcagcgacgtggagtccataaccggtattgatgttgagttcaatggcaagctacaggggtataacacttttcgcaaaatcctcggagaaaagattgagaatctgaacatcaaaaagttcgtggaaagatgcatagagcttaaatgtttgtacggctctgacaagaagctgtttaaaaacgccgtcggtaagctctataaagaatacaatgtgacagatgaggagttcaccaagatcaacaaactgaatttcaacaagtgggggaggttaagcaaggaatttctgacgggcattcgtttcgagaaaaccgacggaacagaacggtttgagtcagtaatcgctgcccttcgaagtactaattataacttgatggaactcctgtccgacaagttcaatctacaaagcaaaattgatgagatcaacggcgaagacgatttttctaatatagacattaaggagtacgttaacgagctgtacgtgtcaccaagtgtcaaaagaagcatcatccagacctataagattgcgatggaaatcaagaaaattacagggaagaatcccaaaaaggtgttcatagagatggcaaaaggaggtggcgaaaaggggaagaggactgagcgccggaaagataagatcaaagaactctacaagaacatgaaagactccctgtctgattattgcaataaccttcaggacttgtcgagccaagtcgagaagtacgatgacaatagactgaggcagaaaaagttatttctctatttcatgcagatgggaaagtccatgtacaccggcaacgatattgacctgtcagagctttttaacaataacatctatgatattgaccacatctaccctcagagtaaagtgaaggacgattctttcgacaatatagttctggtggaaaaacaagagaaccatagcaagtccaatgaattgctcaaaccagagatccagtcaaagatgaacaattactggatttttctgcgcgagaacaagttcatcagcaaagaaaagtataatcgactaacacggaaaaagaacttcaccgatgaggaactgggtgactttgtagcccgtcagctcgtcactacgagacagtctacaaaagaggtggctaagctgttcgaaaagatttttgatgggaccgaggttgtgtactccaaagccagtcttgtcagcgacttcagggagcgctttgatatcataaaggtgcgggaagtaaatgacgcacaccacgctcaagatgcctatttgaacattgtggttggcaatgtcttcaacactaaatttaccaagaattactggaaattcatcaaggagaacaatagaaagaacgaagagaacccgaataaaaaggaaggatataactttaaaaatatctacgagtctgacgtgttcaggaacgaggatgtggcgtgggtcttttccaaggaaaataaagagattaacacaataaagaccgttaataaaatggtgtatcgaaagactgtgaacatcacagaaatgctggtagagggcaaggggcagttattcaatctcacgattaaagaccgcacccagctgaagaaaaaggtcggaaacatcgtggccaatattcccaaatcacttaagaaccggaatactaagctgaaaagtgacgaactagcaaagaaatacggttactttgatagcctcaacaattcgtatttcgttctgttcaagtacgtggagaaagagaaggaaaagatcggctttgacgggataacaatcgtcgataaagagaagttgaaaaagaactccgacattgaaagattcctggagaacaaaggaaataagaacgctaagttaatcaggaaaatttttaagaatcagaaagtgctcatcgatggctatccttacctgcttaagtcttgtaacaaagacaaggccatacgtttcgataattttaaaagcctgtatttggacgagaacgatctcaagttcacccgcgacgctattaagtttgagaaaaataacgccgatatcgacctgaagaaacaaaagtacatcatttcattcctgaaaaagaagaaacagaatgaaatcaacgaaacatatgaggaatgcatagagcggctgaataacgagtttgatactcttttcctcaatctgtgtgacattcagaagagtccaatctacaaaaactacaagttgcccgactttatttccaaaaagaatgttgtggaagtaaaggataaattcgaggtctttaagaacctggaattatataacaaatctaagctcatcaaaaatttcctgaactacttcaagtatgacaataacaaacttgatctgatagcaattggtatcgacagcaaagccaattgcatccagaagcattttaccgaggatttgattaaagacttcgtgatcgtggatgaatccgtcacggggctctttgctaagaaagagagactggagtga

SEQ ID NO: 3297 - RNA, 4209 nt, synthetic construct
  misc_feature 1..4209: note = Cas9 variant
  source 1..4209: mol_type = other RNA
atgacctacagaaactatcacatcggcctggacattgggacaagctccgtgggattcgccgtcaggtacgataatggtgagctcgttcataagaaaggctctaaccttgtgggggctcggctgtttaaggaaggagagactgcagaagaacgccgattgaatcgtggcgccagaaggcggtataaccgcagaaaatggaggttaaatctgctaaaccagatattcaagcccctcatcgaagtaaatgaccctacgtttttcaaacggctggagcaatcaaaccttgtgaattacgataagagtgagagcttttccctgttgaacaatcagtctgacgataagctccaccagcagttcccaaccatttatcatctgcgcgactacctgatgaaatcgacagaaaaggcggatatccgactcatttatttagctgtccaccatatcgtgaaatacagaggtaactttctggacgcctcaccggttgatagcttcgaggcaagtaatcttaaggtggacgaaatattgactcaaatcaacctgctactcgataatctgaccgacgatcttaggctgaacacacagtacgtcaccgacattgagcagactttgctctccaacacagagtctaataaagacaaggaaaaggtgatccagaaactgttactgcacaaggaggccattaaaatcgataaggaccggaccgctcaaatagcaaaactcgtacttgggtataaggccgatattgctaaactgtttggaatcacggaaaagttgcagactcccaagctagagctgagcgccgcgaactccgacgatgcactcatggaactgtcagccgagcttaatgaggaccagattggcatcctgttgcagctcaaaaccctgtacagtcgtgttcgcttaaaccaaatcattcctagcggcacatctctgtccaagtcaatgatagaaaaatatgagctacaccatactcagctcaagagcttcaaagaaaatatcctgcttaagttgagaaggaacaccgctgtgcggcgaaatctggagctcgcctacgcactgtatgtcgggaacgctcagacaaagcaagaagtgtttgagcccaaaaaggcccgcttcaccagtgatgactttgcgtctcttaaagccaatgcaaagtccgctagctcggtgaaagaggccccaaagaacacgaagactaaactgacaaccgatgacttctacaatattttgactgaactcttcgctacatttgagtctgaactgtccgccgatgaggacatgatcaaggaagtcgagcagattaaaaaggcaataaccggagacaactatttacctaaacagagaacggatcagaatggtaacatcccacaccaactgcatcagatcgagctaaggcagattctccagaatcaactgccccactaccctgaaatggacaagatcaacgagcagaagccaattgaaaaacttgttaccttccgggtgccgtactatataggccccttgatcacacctgaggatcagcagaagtcaagtgccgctaactttgcgtggatgaaacgcaaggagcaaggggcaattactccatggaatttcgacgataaagtagacagaatgcagagcgccaccaactttatcaagaggatgacagtgaaagatacttacctgatcaatgaagacgtcctccccgatcgttccctgttatatcagcggttcaaggtgctgaacgagcttaatttggttaaggtgaacaatcagctcctgtctattggagaaaaacaagctatataccacgacctatttgagaagcagaaaaccgtcagcacaaagaaactgcagtcatatctccaaagtgaacagggctacggtgataacatcgagatttccgggctgagcaatcctgacaagttcaacaatggacttaccacttatatcgattttaagaacattttcggcgacttggtggaggacacgacaaaacagaaggaatttgagcagatcatagaatggtctaccgtattcgaggatcgagccatctttaaagcaaagctgcaagaagttaattggttaactgaggagcagattaaagccctcgtggctaagagatactcaggctgggggaggctgagttaccgccttctggccgaattggtcaacgacaatggagagcggatcattgatatcctctggaacaacaagggtagcaatctgatgtccatagtgtctcaggacgagttccagcaacagattgcaagaatcaactcgcatgaggtccaggaactaggcatggagagcgtgctggcgaatgcttatacctccccacagaacaaaaaggccattaggcaagttatgaaagtggtagatgacatccagctcgcaatgaatgggcaggcccccacatcaataagtatcgagttcacccgcaagccggaagagaactctgaaattagcaaatcccgatacgagactatcacatcaatttatcaaagcctgtctaaggatatcgagaaggaagtcaaagacaatcttaacaagaataaatccagtttgaagaaaaacctgagcgataagtactatttatactttacgcagctcggacgggacatatataccaatcagcctattcccttcaacgagatcccatactacgatatcgaccacattgtgcctcgttctgttgaaatgaatgattccctgaacaatagagtgcttgtcgctaaatcaatcaaccagattaagaagaacaatgcccccatagacagtagcctgaaaatcacttcggagacaaggcaactatggaagaaactcctggactccggcttgattaccaagcagaaatattacaagctgtctagctcaatcaagaacacagtgagtccatatgtaaaacagggttttattaatcgccagttagtggaaacttcccaagttatcaagctcgtcgcaaacatactggggaccaaataccagaatgatgacacggagatcattgaggtgaaggctcatcttaactctgaaatccggaaaaccttcgagttttataagctgagagaattgaatgattaccaccatggcttcgacgcctatctcacaactctggtgggaggctacctatacaacaggtatcccaagctgcgaagctactttgtctatggggatcacaaacgccttgacaaggcgcagctctccgagctgaaaaatttcaactttttgcacggactgaccaatcctaagtcaggtagcgatggcttaattacagccagtgggtctcagcaagttgtgctcgaccggaacgaaactatcaaaagactgaataagatatacaggtataagtacatgcttatttcccgtgaggtgttcaccaaacagggacagttttataacgagacgatctacccagctaagccgaatacagcaaaaatgatccccctgaaggataacaaacctagcgaagtatacggcggttattcgtcatctaatgtcagtaagattgccttgataaaggagaaaaacaccgacaactaccagttcatcgggattccaatccgctccattgctaagctcaaacaagccaaggcaaatagcaaaactgtgtatcagacagaactgaaccgggttatcaagtctgtgctagcgagccagaaaaccaagaagcaaaaagagtttgaagtcatactggataatgtgaagtacaaccaggttgtggtagaccagggcgagaaatattaccttggatccccctattacaagaaaaatgccaagcagctcgtcatctcacctgagagtgtgaagattctggctgacaaagccactgcagatttgccagaacaagaggctcataacaagttaatgaccgtgtaccaggaaatcgtcgacgttctgaataaacacttcgccctctatgatattaacaatgtgagaaagaaactgaacgacggccttatcaagttcagccagctgcccaattacgatgagacatctaagaacaggtttgacatatccaaatcaattaagacgaaatatgcagtaatcatgcgaatcttgagtgggattaagaatcagaccagcgaggtgccggaactaggactgaaatcccctctcaacaagatgcaaactaagggtggcatcaaaatatctccagaggccaagatttactattcgagccccacagggatcttctcacattttaaacaggtcaagaatctgtga

SEQ ID NO: 3298 - RNA, 4209 nt, synthetic construct
  misc_feature 1..4209: note = Cas9 variant
  source 1..4209: mol_type = other RNA
atggagagaatcctgggcctcgaccttggggtgagctccattggatgggccctggtcgaagaggatgttaagaaccccgaaaataacaaaataatcaagttgggtgtgagggtaaatcctttaaccattgacgagaaaacaaacttcgaaaagggcaaatctatcactacgaatgctgggcggacctcagcacgcagtgcccgacgtaacctgcagagatttaagctaaggcggaagaaactcctggagattcttatccactacaagataatcaaaaatgatgcggtgctggctgagacaggaaagaacactaccttccaaacacagtatttgcgcgccaaagcagccagagaaaagattgagctcgacgaactggctagggtcctgctcttaatcaataagaaacggggctacaagagctcccgcaaagtgcagaacgatgacgatggtaaggcaattgacgggctgtctgttgccaaagagctttatgagaagaattacaccccaggacagtatgcttacgatttgctgaaacgaggcaagaagcaaatcccggacttttatagatcggatctacagaacgaactcgacaggatatgggagttccagaaacagtaccatcccgatattctgactgacgaatttaagaaagagcttgaaggcaaggggcaacgggccacagcggcaatcttcctgaatcgttacaaaatttataccgccgacaacaagggaacgcgcgaggagaagaaaatccaggcttaccagtggagagtggaagccttgtcacagcctctcgatgtcaaggaggtggcatatgtaatcgctgaaattaataacaacctgaataacagcagtggttacttaggcgccatatccgacaggtctaaaaagctgtattttaatgggcaaactatcggagagtacctcttcgaggagcttagcgcgaacccacacacccggctgaaaaatcaggtgttttatcgacaggattaccaagacgagttcgaaaagatttggaagatccagacaaaatttcatcccgagttgactaaggaactaaaagaacaggttcgcgatatagtcattttctaccagagaaagctgaaatcccaaaagggcctcatctcattttgcgagttcgaaagtagggagatcgaaattgaggaaaacggtaagcggaaacgcaagaaagtggggctgaaggtggcccctaaaagctctccacttttccaggagtttaagatctggcaggtcctgaataacattgagataaagaatgaagacgagagaaggtatttggaacccgaggaaaaggagctcctgttcaacgagttaaattgtaagggaaacctgacctcccagaaatgcctagaactcctgggctttaagtcaaaagatgcaaaacttaatttcaaagttgtggagggcaaccgtacaaatgaaaagttgtacgacgcttttctgaagatcctcgagctgcaagggtataacgtattcgaacttctgaaaattaaggaggataaagacgaggccaagttgagcgaactcaaagctagtgccgatgagatcaagggaatgatcaaggaaatttttaacgcaaatctgataaacacctctatcttagacttcaatgccgagctggaaggtaaagactttgagaaccaggcttcctaccagttctggcacctaatgtatagctacgagggcgataattcgccttctgggaacgaaaagctctatgagctgcttgaaaagaagtttggattcaaaaaggagcattccaagattttgtcaacgatcgtgtttagtcaggagtacggcagcctgtccactaaagcgatgcggcgaatttacccatatatcaaggacaataaatactctgaagcatgtctcctggccggttataaccacagcaagcactcattaacaaaagaggaactggagaatagaaaacttaaagaacaattggaggtcctcccgaagaacagtctgaggaatcccgtggttgagaagatactaaaccagatgatcaatctggtgaacgctaccatttccgaatacgggaaactcgatggcgtccgcatcgagctggcccgggaacttaagaaaagcgcacaggagagagaagacatggccaagtctattaatgaggctactttgctgcatcagaaatatgccacaatcttaaagcaagagttcggagtggtaaacccttcaaggaacgatataattcgctacaagctctatatggaactgaccgttaatggctacaaagacctttacacgaacaccaagatcgagaaagaaaatctgttcacagataagtatgacattgatcacatcataccacagagtcgatttttcgacgatagcttttccaacaaagtgttggtcccccggcagtctaatctcgacaaggggaacctgactgcatacgatttcatgtcgaataagggaagcgagcgtgaggaacattttctaaacgtgatcaaagagctgctcgacaagggttccatttcaaaagcgaagtatgaaaaactgaagaagaaaggccttgagatcggggacggattcattgaaagagatttgagggacacccaatacatcgctaagaaagccaaggagatactgtttgagattacaaatagtgtcgtgactacctctggccgcatcacagataaattacggaaggactgggatctcgttaacatcatgaaggaactgaatcttgacaactatagaaggctgggtctaaccgagattgtgcgaaatagcaaaggggaagagaaggaactcatccctgattggactaaacgcaacgaccaccggcaccatgcaatggatgccctgacggtagctttcacaaccagaaatcacattcagtacttgaactatctgaacgccaggaaggacgagaaacataaggagcaccagaatatatacgcaatcgaaaacattatcactgaggtcattgagaaaaagaatggctccaagacccgtcgctttaaagctccaatgaactcattccggcatgaagccaagcagcacttaaaagaaatcctcgtgagccacaagaccaaaaataaggttgtgacatctaacataaataagactaaaaagaaaggaggcatccataagaaaacagagctgacgcccagagggcaacttcacaaggagaccgtctacggatccaagaaatttctgcagagtagggaagagaaggtgagcgcgaaattcgattatgaaactattttgatggtagtgaacccgatccatcgaaatgccctcctgaaccggctaaaggagtacggtaatgaccctaaaaaggctttttctggcaagaacgcaattaataaaaaccccgtttatctggatgactccaagacagacatcctttcagaaaaagtcaccctcagttggtacgagacagggtatactatacgcaagagcgtgaccccagataatttcaaagactacaagaacctggagaaaattacggatttgggaatcaagaagatcctgaaagaaagattagaccagttcaagggcaatgccaaagaggctttttcgaacctcgataaggaccctatttggctgaacgaagagaaaggtatagccatcaagaccgtgacaattactggggtctccaatgcagagtctcttcacttcaagaaagatcacctgggcaaggaaatcttggacgagaacggaaataaaattcccggcgattttgttagcaccgggaacaatcatcacctcgcgatctatctggacgaagaggaaaagctagatgacaaaatggtgacattctacgaggccgtgctgagggtaaaccagggacttccagtcatagacaaggattacaataaggagaaaggctataagtttctcatgactctgaaacaaaacgaaatgttcgtgtttcccaatgaggacttcgatcctaacgaaatcgacttgttagatgagcggaatctggaacgaatttcaaagcatctctttagagttcagaaaatcagtaaggtgggttacgggaactccttcgtccgcgactttgtgttcaggcaccatctggagaccacggttgaggaacgtaaggagcttcggaatattacatatatccagctgaaatctttggaaggactaagaaacataattaaggtgaggctgaatcacctcggcaaaatcgtacagatcggtgagtactga

SEQ ID NO: 3299 - RNA, 4215 nt, synthetic construct
  misc_feature 1..4215: note = Cas9 variant
  source 1..4215: mol_type = other RNA
atgaccaagaacatcctgggcctcgaccttggggtgagctccattggatgggccctggtccaggaggattctaaaaatcccgaaaacaatagaatagttaagttgggtgtgagggtaaaccctttaacagtggacgagcaaatcaatttcgaaaaaggcaagccaattactacgaacgcttcacggaccctggcacgcagtgcccgacgtaatctacagagatttaaattcaggcgggcgaacctcatcgatgtcctgaagaagtgcaatattcttaaacagggggacctgttgacagagatcggaaagaacagcacttttcagacccaagaactccgcgctaaatccgccaaggagaaagtggagctgtctgatttcgttagagtgctgctcttaatgaataagaagaggggctaccggtcgtcacgcaaagcaaagaacgaagacgagggtcagataatcgatgggatgagcgtcgccaaaaagctgtatgaagagaatcttacaccgggagagtacagttatcagttgctgattgaaaacaaaaagcagctacccgacttttaccgatccgatctccaatctgagttcgacagagtgtggaaatttcagaagcagttcaatcctgaaatcctgaccgatgacctttataaggagctgcagggcaaaaacaagaacgctacttgggcagtattgaaagaaccatttagcctcgttggcattaagcaaatcgggacaatacaggagaaaaaggccgagaagtacttctggaggtccgaagctgtgaaacggcagctggattttgagtcattagccgtcgtgttccaagaaattaatagtaacctgaataacagctctggatatctcggtgcgatctccgaccgttcaaaggagctttactttaataaccagaccgtgggcgaatacctgttccagcagttgaaagagaatagccacacgaagctgaaaaaccaagtcttctatcgccaggactacctagatgagtttgaaaagatttgggagactcagagtaagtattacaaagaactcaccaaggagctgaaagaagagatcagagacatcattatattctatcagaggaaacttaaatctcaaaaggggctgatctccatttgtgagtttgaaaatcgggagatcgaaataacagagaacggaaagattaaaaagaaaactgttggcttgaaggtggcacccaaaagctcgcctctcttccaggagtttaagatctggcaggtactgaataacttagtgttccagtctatcgaatccaaagagctgtttccactagatctcgacattaaggaatcaatcttcaatgaggtcaacattaagggtaatctgagtgccaaaaacgtgcttgatttgatggggtacagcggaaaggaatggaaaaccaactttaagaatatagagggcaaccgaacaaatgagaacctgtataccgctttcctcaaaatcattgcctccgaaggcatcgagtttcccaaggagttcaagctgtctatcgacgatgacattaaagttagcaagatagatatctcaagtgagaaaattaaggaatttatcaaagaaaatttccttaagctggggattaacacgtccatcttggacttcaatcctgagctcgatggaaaggactttgaaaaacaagagagctaccagctgtggcatttactgtactcttatgaaggtgacgattcagcaagtggcaacgtgaagctatacgagctcctggagaaaaagttcgggtttaaaaaggaacacagcaagatacttgctgacgtcggattctccccagattatggctctttgtcgagcaaagccatgcgcaagatctacccgtatattaaagagaataagtactccgacgcgtgccatctggccggttataaccacagtaaaaattcatttactaaggatcagctcgcaaacagaatcctgaaagaacagttagagattctgcccaagaatgctcttaggaaccctgtggtagaaaagatcttgaatcaaatgataaacctcgttaacgaggtgattaaagcctacgggaagccagacgagatccggattgaactggctcgcgagctgaaaaagaatgccgaagagagagcaaacatgacatctgatatcagcaaagccaccctactccatcagaagtacgctgaagtcctgcagaaggagttcggcataaaagcgccctccaggaatgacatcattcgttataaactttacttggagctggagaagaacttatttaaggatctctatactgacgtgcaaatcaaacgggaagaactgttcacagataagtacgacattgatcacatcatacctcagtcacgatttttcgacgacagcttttctaataaggtccttgtgccaagaggagcaaacctgaaaaagggcaatttcaccgccttggattatatggagattgaagggaaagagaagctcgagaaatttctgaacatcatcaaggaactattcgacaagggagctatttccaaagccaagttcgagaaactgcagaagaaaggtagtgaaatcggcgaggggtttattgaaagggatctccgcgacacgcagtacatagcaaagaaggccaaagagatcctgttcggaattaccaatagcgttatctctacatccggccggattactgataaacttagagaggactggaacttggtgaataccatgaaggaactgaacttagagaagtataggaaactcggtctgacagaacttatcgtaaattcaaagggggaggagaaagaacgcataatcgattggactaagcgaaacgaccaccggcatcacgctatggatgccctgaccgtcgcatttacaacccataatcacattcaatacctaaactacctcaacgcgcgtaaggacgagaaacacaaggaacatcagaatatcttcgctattgagaacactatcacggaaatagtggagaaaaagaatggcagtaaagagagaaggtttaagctgcccattaagaacttccgcacagaagccaaaaagcagttggaggaagttctgatcagccacaaagcaaagaataaagtggtcaccaagaacatcaataagattaaaaagaaaggatcgataatcgccaagactgagttaaccccgcggggccagctccataaagaaacaatttatgggtcctctaagtttctgaagaccaaagaggagaagatcagcggaaaattcgatcttgaaatgattcaaaaggtgcagaacgagaaatacagaaatgctctgttgaagaggctccaggaatttggtggcgactcaaagaaggccttcactgggaagaacgtaatcagtaaaaatcctatatttctgaacgcagagaagacagaacagctacccgagacggtgaccctggcttggtatgagactggatacacaatccgaaaagttgtcaatccagataacttcaaggacttcaaaaatattgaaaaggtgatcgacaagggcgtgcgcgatattcttaccgagcggctcaaagaatttaacggtaattccaaggaggccttctctaacctggagaaaaaccctatctggttgaataagagcaaagggatatccattaagacagtcactatcaccggcatcaacaatgcggaagccctgcactataagaaagaccatttaggaaaggagattctcgatgaaaacggccaaagaatcgctgttgactttgtgtcaacggggaataaccaccacgtggcaatatacgaggatgacaatggaaacctgcaggaaaaagtagtcagcttctatgaggccgtggagagggttaatcagaaccttcccattatcaataaggaatacaactttgagctgggctggaaattcttgtttaccatgaagcaaaatgaaatgttcctctttccaagtgatgacttcgatcccaaggaggtggacctgtttgatgacaaatacctatctctgatttccaagaaccttttccgtgtccagagcatctcgatagtgcagtatggtaattcagttattcgcgactttaaattccggcatcacctcgaaacatctgtgagtgatgagaagaaactgcagggggtaacttaccaacagatcaagtccttgcagcctttaaaagacatcattaagatcagactgaacaacctcggaaagattgtccagataggcgagtattga

SEQ ID NO: 3300 - RNA, 4215 nt, synthetic construct
  misc_feature 1..4215: note = Cas9 variant
  source 1..4215: mol_type = other RNA
atgaagggcaacatcgagaaaaagaaacaggagttcaatgactactatctggggtttgatattggaaccaacagcgtgggttgggccgtctccgacctctcttacaatcttctgagattcaacaagaaagatatgtggggcgctaggttgtttgacgaagcaaagacagccaaggatcggcgcgttaaacgaaattcacgtagaaggttagaacggcgcagtaagagactgaaatatctagaggaaatattcgagactgagatctgcaagattgacaaaaactttttcaggcggctcgaagagagcacgctgcacaatgaagataagacctttgacttccgctttcccatcttcaacgatgagaattacacagacaaggagtattacaaagattttcctactgtgtatcatcttcgaaacgaactgattaagaatgagaacaaaaagttcgacatcagattgatatacctcgcgatccacaatattctgaaatacagggggcattttatcttcgaaggacaagatttcgactccgtaaccgactttaaggaggtgttctctgaactgtcggcttatctctcagagaacttagaggaaaatctggatattaacctttgtgacaacatcaaagatataatttgcagcaaggagaataagacaagtaaaggcaagtcctttgtctctttgatcgacagcaaagtgattcagtccgttctgcggtgttgcatcggttaccgtgtgaagttcaaagatatctttattaactatgaagagaaggaaaagaatgaggggataaacctatcagagatcgaatacgacgagaaacgcgatgaaattgccctcagtctgggagagaatatccttctgatagacatttgtaagaaagtctatgatttcatgatcttgaacaatatcctcaagggcaacaaatacattagcgaatctaaggtgaatctgtatgacgagcacaagtgcgatttatgtaacctgaaatacatctttaagaaatacctcccaaagaaagactatttcgagtttttcagaaatgaaaacaaggagaagaattacgtatcctatatttcaagcagtcttaacaatggcaaaaagaaaaatacctgcactcaggaagacctgaacaaggagataaaagagtacatcgcaaagattaaagaatatgaggaaaacgatgccgttttggagaagatcaacctaaagctgaatgaaaacaaactcctgccgaaacttaaaacaaatgacaacggggtgatcccctaccagattcataagatagagctggagaaaatcttgcaaaatcagtctaagtattacgattttctcctggaaaagattgacggaatcaccaacattgagaggatcgaaaaattattcacgtttcggataccttactatatcggtactctgaagggcaaattctcctgggctaagctaaaagagaataagaagattaccccatggaacttcgaaaagatcgtcgatatggaggagagcgcaaaggcctttattgaacgaatgtcgaatcgctgttcttacctcaaaacagagaacgtgctgcccaaaaattcccttttgtattcagaatacgagctgctcaacgaactgaataaagtgaagatcaagaacgagttcataaacgtcgttcttaaaaatgagattatcgacgaactgtttaagactaccagtaaagtgacaaagaaaaagttcgtagattatttgaaaaccaagcagatttttgtggagaaggaagacatcagcgggctcgataacgagttcaaatccaagctggactcttacataaaatttaagaaagtcatcggagataagattgacacgttaagaggctataatttcgtggagaagtgcatcgaatttaaatgtttctacggtgatgacaagaaactgtttaagaacgctattaataacactgagttcaaagactacgttagcgatgacgaactaaagaagatcaataaaatgaagtttaacaaatgggggaggctctcaaagcggctgcttacagagatatgcttcgaaaatgtgattgagagtgagtccttcgaaaacatcatcgtcgccttgcgcagcaccaattataactttatggagttcacttctaaaaagtttaatctgtcagaaaaggtggcggaggaaaaccaggagaatacactcgagaaattcaacattaacgaatacgtagatgagctgtatgttagtcctagcgtgaagagatccatcattcaaacctacaaaatagcaatggaaatcaagaaaattacgggaaagaatccaaagaaaatctttattgagatggccaggggcggcggggaaaaggggaaaaagaccgagaaacgtaaggagcggatcaaaacattatatgctaacatgaaggactctaatgaagagttcctgaacaatcttgataacttgaagctctcggtcgacaattacgatgacaaccgactgagagaaaagaagctatttctgtatttcatgcagctcggtaaaagcatgtacactggcaagaatatagatctgaacgagcttttgtttgccaatacctacgacatcgatcacattatcccccagtccaaactgaaggacgattcattcgacaacattgtgttagtcgagaagacaatcaataaagacaaggataacagggactatctcgatgaaagtatacgcctgcggatgaataaattttggaacttccttagagagaaggggttcattactatcgaaaaatacaataggctgcgccgaaacacctatttttctgacgatgagttgagcggattcatctcccggcagctcgtgacaacccgtcaatcaactctggaagttaagaagctatttgagttcatttttcagaacacggacgtggtatgcagcaaagcaaatctggtctctgatttcagagagaagtacggcataatcaaagtgagggacctcaacgatgctcaccatgcccaggacgcgtatctgaatattgttgtgggtaacgtctttgatacaaagttcaccaaaaattactggaagtttatcgaagaccgccggaaggtggacaacattagagagacttataatttcaaaaagatctttgattacgacgtatccaggggagaaaacgtggcctggcttaaagattacagtataaataccatcagcgagatgattaacaagaaaacagcaaatatcacccaaatgattactgaaggcaagggacagttgttcgacctgacaatcctcaaaaagtctaagatagataaaaagttaacggttattcctaacaccccaaaaatcctgaagtcctcacttaaagacagttgtaagatcgctgagaagtatggctactttagcactctgatgccggcctatttcgtcgtgttcaaatacattgataagaataaagaggtgtttgggttcgaccgaatctttatattcgatcgcgaaaagattaactcgaatgaggacatcgaaaaatatctagaggataagggatacaactcccccaagtttattcggaaagtcaacctcaagcagaaaatcctgttgaatggttatccttacagaatagttggcttcacagacaacaagctggaaattaaaaattctaagcagttttacagcgatggggagcacttaaagtatatcaaacatctctcagctttctacaacaataacaataacgtgaagaatggagagtataggatcaactttctgaaaaagaccagtgaaaatgaccgtaacgagacaactgacgaagccaaagagcgccttaatattgagttcatcaagctgtacgaatatttttgcgagcggttgaactccaaaatttacgcaaattattacaactctaagaagtacgatgaactcatagaggtgttcgactgttttaaaaacctgaatctactggataaggccaaacttctcctggagttcttgaagatcttcaaaaaggacacctatggcaactttaagctgttagaaaaaccagagctcgataagaatggtaaacaaaagctggacaaaaacgggaatcttagcttcgaaggcctgtccatggcttttggaaagttgaacggcaagaaattcaagcagctcgtagagaaagatattcagtttgtcgacgaatcagtgacggggctgttcgagaagaaagaaggactagagaagtggcaggatggtgagcaatga

SEQ ID NO: 3301 - RNA, 4215 nt, synthetic construct
  misc_feature 1..4215: note = Cas9 variant
  source 1..4215: mol_type = other RNA
atggccaagaaaatcctgggcctcgaccttggggtgagctccattggatgggctatagtcgaggaagatgcagagaacgttatgaataacaagatcgtgaaactgggtgtaagagtgaatcccttgaccgtcgacgaacagattaacttcgagaagggcaaacctatcacaactaatgccgggaggacgttagtgcggggagcgcgccgaaacctgcaacgttttaagctaagaaggctccacctgattgatatccttcagaagcggaatatactgaaacaggctgacttgctcgccgaatctggccgcaactcaaccttccagacacaagagatcagagcaaagagtgccaaacagaaggttgagctgagcgaactggctagggtgctcttactgattaataaaaagcggggttacaagtcctctcgcaaagcaaagaacgaggatgaagggcagatcgtcgacggaatgtcggtggccaaaaagttgtatgaggagaatactaccccaggcgaatactcatatgagttgctgaaaagcggcaagaaacagctaagtgatttttaccgatccgacctccaagctgaatttgatagagtatggaactttcagaagcagttctatccggagattttctctgacaatctgtacaaggaacttcaggggaaaaacaagaatgccacatggaaaatcctggagatacccttcagcttggttggaattaagcaagtgggtaccactcaggagaaaaagatcgaaaagtatttttggaggtccgaggcggtcaaaaagcagctcgatttcgaatcactggcagtggtgtttcaagagattaacagtaacttaaataacagctctggctacctgggggccatctccgaccggtcaaaagaactctacttcaataaccagacagtcggagagtatcttcattgccagctgaaggagaatcctcacaccaaattgaagaaccaggtgttttaccgtcaagattatctagacgagttcgaaaagatctgggaaattcagagcaaataccatacggtgctgactaaggagctcaaagaagagatacgcgacgtaatcattttctatcagagaaagctgaaaagtcagaagggccttatctctatatgtgagtttgaaaatagggagattgaaatcaccgagaacggtaagatcaaaaagaaagaggtggggctgaaggtcgctccaaaatccagccttctcttccaagaatttaagatttggcaagtgctgaataacttacagttccagaatatcgagtcgaaagaaatttttcccctggatctagactgcaaggagtctatattcaacgaagttaatatcaagggacggatttccgccaaagcagtgctcgatgtcctgggctactcaggcaaggagtggaaaacaaactttaaggacatcgaggggaataacagtaacgaaaatctttataacgcttacttgaaaatcattgccaatgagggaatagagttccctaaggaatttaagtgtaacctggatgacgatatcaatgtgagcaaaattatctgctccgcgggtaagattatcgagttcgtacgagaaaaattttctgagctcggcataaacactagcatcctggacttcaattcagaacttgaggggaccaactttgaaaagcagaaaagttaccagctgtggcacttgctctattcctacgatggagacgatagcccatctggcaatcagaagctgtatgagttactggaaaagaaattcggtttcaagaaagagcattcaattatcctagccgacattgggtttccccaggagtacggcagtctcagcacaaaggcaatgcgcaaaatcatacctcacctgaagaccggacttccattcgctaagaaatccgacaacgatacgattttgtctgccactgctatggccggctataatcacagcaagtcgctgacaaccgaggaactcactaaaagagttctgaaggaacatttagagatcctgccgaaaaactcccttaggaatcccgtggtcgagaagattttgaaccaaatgatcaatgtggtcaacgaagtgataaaagagtacgggaagcctgacgaaatccggattgagctcgcacgcgaactgaagaaaaacgccgaggagagagctaatatgacatcagaaatcggaaaggcgaccattcagcaccagaaatatagtgagatcctacaaaaggaatttggtataaaatctccaagcaggaacgatattatccgttacaagctgtacctcgagctgtccaataacggcttcaaggacctttatacggatatccagattaaacgggaagagttgtttaccgacaagtacgatatcgaccatattataccccagtcacgattctttgatgacagcttctctaataaagttctggtgcctagaggggcaaacttaaagaaaggaaatctcacagcctttgattatctggagtccgaaggcaaggacactcttgagaagttcatcaacaccattacagaattttacgataaaggtatcattactaaggctaaatatgagaagctgcagaaaaaggggaccgaaatcggcgacggattcatagagagggacttgcgcgatacacaatacatcgccaagaaagcaaaggagattctctttggcatcaccaatagtgtagtcagcacttctgggcggattacggacaaactgagagaagattggaacctagtgaatacaatgaaggagatgaacctggaaaaatataggaagcgcggactcaccgagactgttatcaattccaagggtgaggaaaaagagaagataattgactggtcaaaacgaaacgatcaccggcaccatgccatggacgctctgaccgtggccttcacaacccacaatcatatccagtaccttaactacttgaacgcacgtaagaatgaagatcacaaacagcataaggtcatcagtaacattgagaatctgataactaaagtgttcgaaaagaagaacggcagcaaacagagaaggtttttagagccaatccacaatttccgcattgacgcgaagaaacacctcgaggaaatcctgatttcgcataaggctaaaaacaaggtagtgacaaagaatatcaacaaaataaagaaaaaggggtccatcattgccaaaatcgagcttacgccccggggacaactgcacaaggaaaccatttatggctctagcaagtacctaaaaactaaggatgagaaactctcaggtaagtttgacctggaaacaatcaataaagttcagaacgagagatataagaatgcattgctggagaggttaaaggtcttcgggtacgatagtaaaaaggcctttaccggcaaaaacatactcgctaagaatccgattttcctgaacatcgagaaaacagaacagcttcctgaagtgctgactttggcctggtatgagaccatctacacgattcgaaagtccatcaattctgacaactttaaagattataagaatatagacaaggtgaccgacaaaaaggtccataacattctcacagatcgcctgcgggagttcaacggaaatagcaaagaagcattttccgacctagagaagaaccccatctggctgaataaaccaaagggcattgctatcaagactgttaccataacaggggtgaacaatgtggaagcccttcactacaaaaaggatcacttcggaaaagagtttctcgacgaaaagggccataaaattcctgtagatttcgtctcaactggtaacaatcaccatgtggcgatctacgaggacaccgccgggaacctgcaggagagagttttgagcttctatgaagctgtggagagggtcaatcaaggactgagtgtgatcgataaggaatacaactcttccttaggctggaagtttctcttcacgatgaaacagaatgagatgtttctgttccacagcgaagactttaacccccaggagattgatctttatgacgagaagaatctgcgtttgatctcgaaaaacctcttccgcgttcaaaagtttacagtgaaagattacttctttcggcatcacctggaaaccaatgtagaggacaactcaaagctaaagggtgacacttggaaaagagaaggcctgaacgggattaggggaatacttaaggtccgactcaatcacctgggcaaaatcgttcaggtgggggagtattga

SEQ ID NO: 3302 - RNA, 4215 nt, synthetic construct
  misc_feature 1..4215: note = Cas9 variant
  source 1..4215: mol_type = other RNA
atgagcaagaaaatcctgggcctcgaccttgggaccacatccattggatgggccttcgtgagagaggctgaagattttcaggaggaatcttcaatagagaggatcggtgtccgggttaaccccctgactacggacgaacaaattaatttcgagaagggcaaacctatcagtgtgaacgcagatcgcaccttgaagcgaggggcccgtagaaatttacagaggtacaaacagcggcgcacaaacctgattcagctactcaagcaatataagatcataaatgagaacactatcctggcggaagacgataaaaataccacacacagcacctacgctcttagagccaaggcagtatccgagaaaatttctaaggaagcctttgctagggtgctgttgatgatcaacaaaaagcggggatataagtcgtcacgcaaagcaaagaatgaggacgagggccaggccattgatggtatgagcgtcgctaaacgactctacgaagaggacatcactccagggcagctgtgcctgcagctcttaaaggaaggcaaaaagaaactgccggatttctatcttagtgacttgcaagccgagctggaaaagatatggaactttcagaagaaattctaccccgagattctaacagatgagtttaagaaagaaatcgagggaaagggccagagagcgacctccgcatctttctgggccaaatataagtttaatacggctgaaaacaaggggagcagggacgagaaaaagatgcaggcctgggaatggcggtccaaagcaattaatactcaactcacccgtgaggaggtggcttacgttatcacagaaatcaacaataacattaacaattcaagtggatacctgggtgccataagcgatcgctctaaggagctttatttcaacaaagaaactgtgggcgagtacctgtttagacagttgaggtattcccctcatacccgggtcaagaatcaggtgttctaccgacaagactatctcgacgaatttgagacaatctgggagaaccagtcacgctaccacaatgaactgaccaacgagttaaagagcgaaattagagatgtagttatcttctatcagaggaaactgaagagtcagaaagggctcatatctttctgtgagtttgagtccaagcaaattgaaatccagaaagacggaaagatcgtgaagaaaattatcggccttaaggtcagcccaaaatcgtctcccctgttccaggagtttaagatttggcagatattgcaaaatctagagttcacgaacaaagaaactaaggagaaaaaggtgcctgattttgaagcgaagaatctactcttcgaggaactgaacatcaaaggtaatcttaagggggagaaagccattgaaatcctgggatacaagccaaaagagtggttggtgaactacaaggaactcgacggcaatcggacaaaccaggtcctgtatgagggctacttaaagatcctggaggttgaagggtatgatattaaagacctactcaagataaaatccaataaggatgaggtgaacctgtcagaacttagtaaacccgtaagcgagatcaaggacttgattaagtccatctttgaatctctgaacattaataccgcaatcctcgatttcaaccctgagctggagggaaaagactttgaacgccaggctagctaccagctttggcatctgttgtattcatacgagggtgataatagtaacactggcaatgacgaactctatagactgttataccaaaagttcgggtttggaaaagagcacgcccagatactggctaacctatccttcagccaggactacggctctctctcagccaaggcaatgaggaaaatctatccatttattaaggagaatagttacagcgaagcctgctccctggctggttataaccattcttcgagcatcacaaaggaggaaaatgataaacgtgagcttaaggaaaaattggagctgctcccgaagaactccctgcggaatcccgtggtcgagaaaattttaaaccagatggtgaatgttatcaacgcgataattgcagacccttcaatggggcgaccagatgaaatcagaattgagctggccagggaacttaagaaaaatgctgccgagcgcgcagaaatgaccatccacataaacaaggccaagagtgagcacgacaactaccggaaaatcttgacgaccgagttcggcattcccaatcctacaagaaacgatatcattaggtataagctctacgaggaactgaaagtgaatggatataagactctatactctaacacctacatcccacgcgaaaaactgttcagcaaggagtttgacgtcgaacatataattcccaaggctctcctgttcgatgactccttttcaaataaaacaatctgtgcccgacaagagaaccttgataagggcaataaaactgcattcgactttatccagagcttctatgggaaggagaaatttgaagagtacttgcagcggattgaatctctggcgaagatcaaggagggagataccttcgtgatttccaaagctaagtataaaaagttactcctgccggagatagaaatcggtgagggctttattgaacgtgaccttagaaacagtcaatacatcgccaaaaaggcaaagagcatgctgttggatatttgcaaaacagtagttcctaccactgggtctatcacggacaggctccgcgaggactggggactgataaatatcatgcaggaactaaacttcgagaagtataaaaagctgggcctcattgagatggtggagaaaaaggatggttcctttaaggaacggatcacagactggaccaaaagaaatgatcacaggcatcacgccatggacgctctgactgtcgccttcaccaagcacaaccatattcagtaccttaattatttgaacgcacgcaaaaatgaaaaccacaagatgcatgggaacgtgatcgctatagagcagaaagaaacagagctgttagtcgattcagtgggcaagcgaaaacggaagtttaagctccccattagtaatttcagagaggttgccaaaatgcacctggaaaacatccttgtgagctacaaggcgaaaaataaggtagccaccaaaaacaagaataggttcaagactaaaaacggagagaaggtcaaaatcgaactgacaccacgtggccaactacataaggagacggtgtacgggaaaatgaagaagtatgaaaccaaagaggagattataggatcgaagtttgacgaagctactatcctcaaagttgcaaatctggagcagcgcaacgccttgctgcagcggttaaaggaaaataacaatgatcctaaaaaggctttctccggtaagaactctctcaaaagcaatcccctgtactatggcgtggactcaaagccaattcccgagagaatcaaaattgtctggcttgaggatgactacacaatcaggaaggaaataacccctgatctgaaaatcgacaaggtgattgatatcgggattcgacggatcttggagaaccgcctcgccgaatttaatggaaacgcaaaagaggcgttcagtaatctggaaaagaacccaatatggctaaacgagggcaagagaattgccatcaaaagggtaacaatctccggtgtgaagaatgctgagactctgcactataaaaaggaccaccttgggcatgaaatgctcgacaaacagggcaagcggattccggttgattttgtctctaccggaaacaatcaccatgtggccatctacaaggacgataaaagcgacctgcaagagaaggtggtctccttctatgaagcagttgagcgaataaaccaggaattgcccattatcgataaatcatttaatcacgacctgggctggcagttcttatttacgatgaagcagaacgagtacttcgtgtttcctagagatgggttcgacccatacgagattgatctcctgaatcccgacaactataaaatcataagccctaatcttttccgcgtgcaaaagattgctaccaagaactacgtatttaatcaccatctggaaacaaaagccgtcgatggagagttgctcaagactaaaaaggacctgagtgacatcacctataggttcatccagacaccagtgaacctgaaaaatattatcaaggttcgtattaaccacataggccagatcgtgaagattggtgaatactga

SEQ ID NO: 3303 - RNA, 4218 nt, synthetic construct
  misc_feature 1..4218: note = Cas9 variant
  source 1..4218: mol_type = other RNA
atgaagaccatcctgggcctcgaccttgggacaaacagcattggatgggccctggtgaaagaggctgaaaattccaacgagaagtctgaaataatcaaattgggtgtcagagttaatcccttaactgtggatgagaagacgaacttcgaagcaggcaggcctctgtcaaccaatgccgaccggacagcgaaacgcagtgctcgacgtaacctacagagatacaagctcaggcggaagaatctgattgatcttctgatcaaaaaccaattgattgacaaggatactccactcaccgagatcgggaaaaatacaacccaccagactctggagctgcgcgccaaggcagccagagaaaggatagagctcgaagacttagctcgggtatttctggcaatcaacaaaaagcgcggatatcgaagctccagaaaggtgaataacgaggaggaaggccaggccgtcgatggtatggctgtggccaaaaagttgtacgacgagaatttgacaccggggcagtatgcgtacgaactgctatctaaaggaaagaaatatgttcccgatttctacaggtcggacctccaagcagagtttaacgccatttgggaatatcagaagcagttctacgctgatatcctggacgatgagctttacaatgccctgaaaggccagggccaacagaactcacggaagcgttttcttgcaattaagggggtgtataccgctgagaacaaaggaaagcgcgacgacgtcaaactcagacattacaagtggaggagcgaagccatcagtaaaaagataaatattgaggaagtggcgtatgtactggttgagatcaacaatgatttaaacaagtcctctggttacctgggcgccattagcgaccggtccaaagaactctatttcaataaggagacggtgggggagaacctttggaaacagatccagaagaatcctcacacttcactgaaaaaccaagtcttttaccgacaggattatttggacgagttcgagcagatctgggaaacccaagcacagtttcatccacagctaacactggctctcaaggagcagattcgcgatgtgataatcttctaccaaagaaagctgaaaagtcagaagggacttctgagcttttgccagttcgaatcttgggagattgagaggaaagacgaaaatggcaacgtgatcttgaataagactacccagctccccaaacggcaaacagtcggtcgcagagttgcccctaagtcctcaccactgtttcaggagttcaagatatggcagaacattaataacttagaagtgaccaaaatcagcgagggggctagtaagaataaaaaggagacggaaactctgtctgatgacgagaggaaactactcttcgaagaactgaaccttcgtggaaacttgtcccagaaggaagtactgcaaatcctcggcctgaaagataaggagtacaagacaaattttagcgagggccttgaagggaaccggaccaatgccgcactgttcaacatttatcagcagatcgccgagaatgaaggatacggttttgactggtcgaaaaagtctgctcaggagattaaagaagagttgaaggcggtgttcccccaaataggcatccaggcagatattctcgactttaacgccaatctggacgggaaagagttcgaaaaccaggcttcctatcaattatggcatctgctatactcagccgaggaagatgacaagatcaatgaggaagatcagatcatttatggaaacagtgcagtcagcctcaagaaaaagctgtgtgagaaatttggcttcactcctgagtacgccaagtggatagctaatgtgtcccttcaggacgattatggtaacttgtctacaaaagccatgcgaaagatcattccatacctgatcgacgggaatgattacagcgaagcatgcgcgctcgctggctataaccactcaaatagtctgaccaaggaggaaaacgacaacagagagttactggataaacttgagttgctcccgaaaaattccctgaggaaccccgttgtggaaaagattctaaatcagatggtcaacgtggtaaatcaagttatcgagacgtacggaaagcctgacgaagtgcgcatagagctggcccgggaactcaaaaagagcgcagagaagagagccgagatgaccaaatctatcaacgaagctacaaggcgcaatgaggatattaagaaactgatcactaaggactttggcattccaaaccccaccaaatcagatgtcgtgcgatatcggctttgggaagagttggcccctctggcatacaaggacgtcttcacagggaaacagatcaagaaggaagacttatttagtagcaaaatagatattgagcacatcattccaaaggctctcctgttcgacgattccttttctaataaaactcttgtgttccgtgagaccaacctgaagaaagccgacagaacagcgtatgatttcatcgaatcggactacaatgccaccttggatgactatatacagagggttgagactctctacaacaatacgaagggaacaatcagcaagggtaaacgcaacaagctgctaatggctcagaaaaatctgcccgatggctttattgaacgggacctcagaaactcccaatacatcgcaaagaaagccaaggctatgctgtatcaggtgttcaaggatgtaaacgtcacctcagggagtattactgacaggcttcgagaggattgggacttgatcaatgtgatgaaagaactgaactttccgaagtacaaagccttaggactcaccgagatagaggaacgctatgacattggccaggagaagacaaaacgggttgaagtgatcaccgattggactaagagaaatgaccacaggcatcacgcaatgaacgcgctgacagtcgccttcacgacctctagccatatccagtaccttaattatctgaacgctcgtaagaatgagtcccacaaagagcacaagaacattaaaggtatcgaaaataagattactcataaacaaaaggataagcgcaaatttatacctcccatgccaaacttccgggaggaagccaagaaacacatcgagacaattctagtgtcaatcaagaataaaaacaaggtatacaccaaaaatattaacaagacaaagaaaaagagcgggcataatactaaagaacagctcacccctagaggccagctgcacaaggagacggtgtatggaaaatctaagaggcccatgtccaagccaaccaaaatcaacaagaattttagtttggagcaagcacagctgataatcaacgttcaggaaaaagagttagtcctccgacatctggctcagttcgacaacaatcccgccgtggcatttgatacaaagactcttaaaaagatgcctctgttgaagaacggcgaaccactcaaagaggtgctgtgtttcgaagagatttttaccatccggaaggacattacaccggatctaaaaatcgagaaggtcgttgacgagaaaataaaggccattctggaacaacgcaagaaagatttcgggggaaatgctaaggaagcgtttagcgaccttgataaaaaccccatctggctcaataagaaaaagggtatctgcattaaaagagtgactataaccggcgtgtctaacgccgaggcactgcaccaccagaaggaccatttggggagggaaatcctggacgataatggaaaccctattccagctgacttcgtatccacgggcaataaccaccatttagccgtctacctcgattcagagggtaagctgcaggacaatatcgtgagtttctacgaggccgttgtgcggacaagccaggggcttcccgtcgtggataaaggcctgaacaaggacttgggatggaaatttctcttctcgctgaagcaaaatgaaatgtttgttttccctaacgatgactttgatattaatgacttcgatctactggacgataaaaaggctgagcttatctccaagcacctctatcgagtgcagaaaatatctaaggtaagcgcaggcaactcatttgtcagagacatcgtgttccgccaccatctggaaaccactgtgaaagaggtcaaggagttgaaagacattagttacatccagttaaagtccctggaagggctcaggaacattaagaaagttcgtatcaatcacataggaaagattgtgcaggtaggcgagtattga

SEQ ID NO: 3304 - RNA, 4221 nt, synthetic construct
  misc_feature 1..4221: note = Cas9 variant
  source 1..4221: mol_type = other RNA
atggagaagaaaatcattggcatagacctgggggtgaccagcatcggatgggcctacgtcattgaagatgagaacggtcactccagaatcctcaggattggcacacgggttaatccccttactacggaggaactgaagaacttcgaacaggggaaacctatcaccgagacagctgagcgcactttgaagcgatctatgcgtagaaatttacaaaggtataaacagcggcgcaccaacctgataaatgtgctactcaagaacaagctgatcacagaaaccactgcacttgccgaggacggaaaaggcacaacccatctgacgcacgcgttgagagctaaggccgcatacgcccagattccactcgaagattttgctagggtactgctgatgctcaataaaaagcggggttatcgctcaagtcgaaaagtgaagactgaggcagacgggcaggccatcgatggaatggctgtcgccaagaaattatacgaggaaaacattaccccgggccaactgtgctatacacttttgctgcagggcaagaaaactctacccgacttctacagaagcgatctccaggtggagatggaaaaggtttggacctttcagaaacaattccatcaggcgatcctgacagacgagtttaggaagtatatagcagggaaaggacagcgggccaccgctgcctccttctggggtaagtacggctttaatacggcagagttcaaggggtctcgtgaagagaaaaagctaaaatcgtacgaatggcgctcacaggctattactacacctctgagccaagaggaagtggccgcggtcatcaccgatattaacagtaatatcgccaactcctctggatatttgggcgcaatcagcgacagatccaaggagctctttttcaataaacagactgtgggtcagtaccaatataacctgttacagcagaatccacacacaaacctgtcagggcaggtattttacaggcaagattatctcgacgagttcgaaaccatttgggagacgcaggctacctttcatacaatgcttactcccagtctgaaggaagagatacgggatatcgttattttctaccagcgaaagttgaaaagccagaagaaacttgtgtctatctgtgagttcgaaaagcgcatactggaacctctccaaggagacaaagtcgtgggctataaggtggccccaaagtcctcacccctgtttcaggagttcaaaatttggcaggctcttggcagaatggagatccagcacaaggtcaccaaagaaaggcactttctggacttggatgccaagcaactcctgttcgacgagttaaacgttaaaggggatctgacaaaggaaaatgcactaactatcctcggatttaagcctaaagagtgggagtgcaacctgcttaagttggaaggtaatcggaccaaccaggccctgtacgaggcttacctcaaaattctggaacttgagggctatgaagtgaaggacctgttggggctcaaactggataaggacgatatcaaattaagcgagctgccagtagacgcggcagatattaagaagatggtgcgcgagatattcgaaacactaaatatcaaaaccagtctcctggactttaacgccactcttccgggaaagtctttcgagcagcagcatgcttaccaattgtggcatctgctctattcctacgaaggcgataatagcccctcgggtaacaaaaagctgcaggacttactgcaggccaaatttgggttcacgaatgcacacggccaaattcttgccaacgtctctttggagacagactatggatccctctcagctaaggccatcagaaagatctttacccacattaaagaaaatcactacagtgcagcgtgtgctctggccggctataaccatagctcctacctatctaaggaggagaatgaacagaggatactgaaagatcgtctcactatcctgcctaagaacagccttcggaatccagtggttgagaaaattttgaaccagctgatcaacttactcaataccattttcgacgatccctacctggggaagcctgacgaaatccgaatagagcttgcaagagaactgaagaaaaacgtgcaggagaggcaacgcttgaatacagagatcaccaagaacaatactgaacacgagcggattacaaaaatcctcattaaggaagataacatcaaaaatccaacgagaaacgacataattaggtataagctgtaccaggagctaaagcataatggatataaaaccctgtactcaaacacttatatcccccgcgaggaactctttggtaagaatttcgatattgagcacatcataccgcagagtatcctgttcgacgattcctttagcaacaaaacactttgcgtccgaaaggaaaatattgacaaagccgatcggaccgctatggacttcatcggcccttactttggggaggataaggtgcaggaatatattaaccgtgtagagatgttgcatcaaatcaatctgaaaaaccccgaggaaggaataggcaagggtaagtacaaaaagttactcatgaaagcctctgagattgggcagggcttcatcgaaagagacctgagggacacacagtacatcgcaaagaaagctcgccagatgcttctggaggttactcggaccgtggtcgccacgaccggatcaattacaaagagactaagggaagattggggcctcgtgaacgtcatgcaagagctgaatatggacaagtatcgacagcaggggttgactgagctgatcgagaaaaaggatggaagtaccaaagaacgcattacagactggactaagcggaacgatcacagacaccatgcgatggacgccttaaccatagcttttacgaaacacagccatatccaatacctcaataacctgaatgcaaggaagtccgatgacaagaaaggtaaggaaattttcggcatcgagcagaaagaaacagagaaggtgaaagatgacaccgggcagactcagcgtcgctttaaacttccaatgcctgatttccggcaagccgctaagcaccacctggagcatttgctcatttcttttaaagccaagaacaaagttttcacaaagaataaaaacaagtataagaccaaaaatggagaacaggtgaagctggagctaactcccagaggccagctgcacaaagaaaccatctacggtaggataaagaaatatgtaacacatgaggagaaggtctcgagcaaatttaacgcacagcttatccaaacggtggccaattccaagtaccgatatgcgctcctgaagcggttggaagagaacgggaatgaccccaaaaaggctttcaccggcaaaaactcactggataagactccattatttgttgacgccacacagcaggagaaaattcctccagtggtcaagctcgtgagtatcgaacagggatacaccattcgcaaggacatcacaccggaaaatttcaaagatgcaaagtctatagagaaaattgtagacgtgggcatcagaaacctgcttcaccataggctggagacttacaacgggaatgaaaaggaggctttctataacttggataaaaatcccatctgggttaacgaaagcaagggaatttgtataaagcgggtcaccatcacgggcgtgacaaatgccgagcctctccactacaaacgagaccaccatggtaagccaattctggataacaatgggaacagaacccccgcagactttgtgtccactggaaataaccaccatgccgctatctatcgcgatgcggccggcaatctacaagacaacgtcgtttcattctacgaagcagtggctagggtgaatcagggtctgcctattatcgataaaagccttaacaaggagctcggctggcagtttctgttctctttgaaacagaatgagtgctttgtattcccaaacgaagggtttgaccccttagagatagatctgtataatccggccaacaacaagctcatcgccgctaatctgttccgtgtccaaaacttttcccggcttcagtacggaaataacattatcagagactataatttcaggcacatttacgaaaccagtgtggagaaccgcaaggaactgaaagacatcgcatacaagcaggttaagagcttgcctatatttgagaagattatcaaagtgcgaatcaatcatattggccaaatcgtcaagacaggggagtattga

SEQ ID NO: 3305 - RNA, 4224 nt, synthetic construct
  misc_feature 1..4224: note = Cas9 variant
  source 1..4224: mol_type = other RNA
atgatcagaaacattctgggcctcgaccttggggtgagctccataggatgggcctacgtccaggaggattctaaaaattcagaaaacaataggatcattaaactgggtgttcgggtgaaccccttgaccgtagacgagcaattaaatttcgaaaagggcaaacctatcacaactaacgctgggcgcacgctggcacgaagtgcccgtagaaatctacagaggtttaagctccggcgcagcaacctgatggatgtgcttaaaaagaataacattctgaaggagaccgacttgctcgcggaagtcggcaaaaattccacattccagactcaggagctgagagctaagtctgccaaagagaagatcgaactgtcggagtttgcaagggtgctcttactgataaacaaaaagcggggatataagtcaagccgcaaagccaagaatgatgaagacggtcaaatcgttgatgggatggctgtggcaaagaaacttttcgaggagaacttgaccccaggagaatacagttatcagctgctacagcagggcaaaaagcaactcccggacttttaccgatccgatctgcaggccgagttcgacaaaatttgggattttcagaagcagttcaatcccgaaatctttacaaacgagctttatgaaaagctgcaaggcaaaaacagaaatgctacctggaaggagttggagttccctttttctctcgtcgggattaaacagactggaacaatgcaggaaaagaaagtggagaagtacttctggaggagcgaagccgtaaagaaacaactggactttgagtccttagcggttgtgttccaggaaatcaactcaaatctgaacaatagtagcggttatctcggcgcaatatctgatcggtccaaggagctttacttctacaaccagaccgtcggggagtatctgtttcagcaattgaaaacgaatccacacactaagctaaagaaccaggtgttctaccgtcaggactatctggacgaatttgagaagatttgggaaacccagtcaaagtaccataaagagctcacaaaggaactgaaagaggagatccgcgatattactatcttctatcaaagaaaacttaaaagccagaagggactgatcagtatttgcgaatttgagaatagggaaatagagatcaccgagaacggcaagactaaaaagaaaaccgtgggtttgaaggtcgcccccaaatcttcccctctcttccaggaatttaagatttggcaggttctgaataacttacaattccagaatatcgagacgaaagaagtgtttccaatagacctggatttcaagcagagcatttttgacgaggtaaacatcaaggggaaactatcggctaaggatgtgctcgacctggtcggatactctggcaaagaatggaagactaatttcaaagagatcgagggcaactatacaaacgaaaatctttacaccgcctttttgaagattatcgcatccaaggagattgaatttcccaaagagttcaagataactatcgatgacgaaattaaagtgtcaaagatcaacgctagtgccgagatcattaaactgttcgttcgggagaagttcagcgaactcgggatagatacatccatcctggactttaatcctgagcttgaaggatctgatttcgagaagcaggcgagctaccaactgtggcacttgctctattcatacgaaggtgacgacagttccagcggcaacgagaaactgtatgagttactggaaaataagtttgggttcaaaaaggagaactctaaaattctagccgaaatcggattttcacaggattacggcagtctcagctccaaggcaatgcgaaagatttatccatacatcaaagagcataagtattctgtggcttgttcgtacgccggttacaatcacagcaaaaactccctgaccaaggagcagcttgaaaatcgcatattgaaagagagactggacatcctcccgaagaactcactgaggaatcccgtcgtggagaaaattttaaaccaaatgatcaatctggtaaactgccttattgatgaatatagtgaaaaggacaaggatgggcagatcgttaaatacttcaagtttgacgagatacggattgagttggctcgcgaactcaaactgaatgccgaggaaagagcaacgatgacctctgagatcaacaaggccacaattcagcatcagaaatatgctgaagtgctacaaagggagttcggcctgaaggcgcctagccgtaacgatatcatacggtacaagctctatctggagcttgcaaataacggatttaaagacttgtacactgatgccaagatcgaacgagagaatctgttcaccgacaaatatgatattgaccacatcattccacagtccagatttttcgatgactcattcagcaacaaggtcttagtgcccaggaatgctaacctcaaaaagggcaattttacagccttcgactacctggaaatcgaggggaaggaaaaacttgagaagtttctgaacataattaaagatttgtacgacaagggagcaatcactaaagccaagtatgagaagctccagaaaaaggatttcgaaatcggtgacggctttattgagcgcgatctgcggaatacccagtacatcgctaaaaagtctaaagaaattctattcgggataacaaactccgtcgtgaccacaagtggaagaatcacggacaagctgagggaggattggaatctcattaacacaatgaaggagctgaatcttgaaaaatatcgcaagttgggcctgaccgagactgttatcaacagcaaaggtgaagagaagcaacgaattatcgactggaccaaacggaatgatcaccgtcatcacgccatggacgcattaacagtggcgtttaccactcataaccacatacagtacctcaactatctgaatgctagaaaggatgaaaaacacaaggagcatcagaacatcttcgccattgagaatcttatcacagaaattatcgacaagaaaaacgggtctaaggagaggcgctttaaagaacctgtaaagaatctgcgggcagaggccagaaaacacctagatgaaatactcatttcccataaggtcaagaacaaagtggttacgaagaatatcaacaaaatcaagaaaaagggctcagtgattgctaagaccgagctgactccaaggggacagttgcacaaagagacaatatacggcagtagcaagttcctgaaaaccaaggaagagaaaatctcggggaagtttgacgtcgaaacaattcaaaaggtgcagaatgagcgatatcgcaacgccttactcaaacggctgcaggagttcggaggtgactccaagaaagcattcactggcaagaatgtaatctctaaaaaccccatttttcttaataacgaaaagaccgagcaactgccggaaacggtgaccttggcttggtacgagatggggtacacaatcagaaaagccgttaatcctgataacttcaaggactttaagaatatagaaaagactatcgataagggaattagggacatcctcaccaaacgtctgaaggagttcaacggcaacagcaaagaggcgttttcagatctagacaagaatcccatttggctgaacaagagtaaaggtatctccataaaggccgtcacaattactgggatcaataacgctgaagcacttcattataaaaaggatcacctcggcaaagacttcctggatgagaatggaaagcgcatcgccgtggactttgtgtctaccggcaacaatcaccatgtcgctatttacgaagatgagaacgggaatttgcaggaaaaggttgtgagcttctatgaggccgtggagcgggtaaaccagaatctgccaatcatagacaaagaatacaactccgagtcaggatggaagtttttattcacgatgaaacagaatgaaatgtttctcttccctagcgaggactttaaccccaaggaaatggatctgttcgacgagaaaaatgtcaaccttattagtaagaacctgttcagagtgcaaaagtttacaatcaaagattatttctttaggcaccatttggagaccaatgttgaagactcttccccactcaagggcattacttggaaacgagagggtctgaacgggatcgaaaatatactaaaggtgcggctgaaccaccttggaaaaattgtccagatcggcgagtactga

SEQ ID NO: 3306 - RNA, 4227 nt, synthetic construct
  misc_feature 1..4227: note = Cas9 variant
  source 1..4227: mol_type = other RNA
atgaccaagaacatcctgggcctcgacgtgggggtcagctccattggatgggcccttataaatgaggatatcgaaaaccccaaaaataacaagattatcaaactgggtgttagagtgaatcctttgacagtagacgagcagattaacttcgaaaagggcaaaccaatcactacgaatgctgggaggaccttagcacggggagcccgccgaaacctgcaacgttttaagctaagaaggttccacctcatagatatcctgcagaagaataacattcttaaacaggcggacctgttggctgaggtgggcaaaaattctacatttcagactcaagaaatccgggccaaatcagcaaagcagaaagtcgagctcagtgagctggcccgcattttcctgctcatcaacaagaagagaggttacaaaagctccaggaaggctaaaaatgaagatgaggggcagataattgacggaatgtttatcgcaaagaaattatatgatgaaaagctgaccccgggcgagtactcttatcagcttttgaaagagtcgaagaagcaactgcccgacttctaccggtcagatctacagagcgaatttgacaaaatttggaacttccagaagcagttttatcctgagaatttcagtgataacctctacaaagaactgcaaggcaagaacaaaaatgccacatggaagacccttgagatcccattttccctggtggggatcaagcagactggaacattgcaggaaaagaagctcgagaaatattcttggcgcagcgacgctgttaagaaacaactggattacgagaagttagccgtggtcttccaggaaattaactccaatatatacaactcaagtggttatctgggcgcgatcagcgaccgatctaaggagctctactttaataaccagaccgtgggggaatatctttacaatcagattaaagagaacccccatacgaagctgaaaaatcaagtattctatagacaggactacttggatgagttcgaaaagatctgggagactcagtccaaatatcacaccacactaactaaggaactgaaggaggaaataagggacattatcatcttttaccagcggaaactcaagtcacaaaaaggactgattagcatctgcgagttcgaaaaccgtgagattgagataaaggaaaatggcaaaatcaagaaaaagaccgttggtcttaaggtggcacctaaaagttctccactgtttcaggagttcaagatttggcagatcttgaacaatctccagtttcaaaacatcgaatccaaagagattttccccatagatctggactttaaggagagcatcttcaatgaagtcaacattaaagggcgcatctcggccaaggctgtgttagatctgctaggatactctggcaaggagtggaaccctaattttaaagacattgaaggcaacaatacaaacgagaatctctataacgcctacctgaagatcatagcagatgaagagttcgagcttccaaaagaatttaagttgaatggggacgatgacctgtatgtgtccaaaatcgcttgttcagccagtaagattaaggatttcgtcaaagagaagtttagcgaaatcggaattaacacctccatcctcgacttcaatccggagctggaaggtaaagacttcgagaagcaggcgtcttaccagttttggcatcttctgtatagctacgagggcgatgactcacagagtgggaacgaaaaattgtatgagctcctggaaaagaagttcggatttaaaaaggagcactccaaaatattaagcaatattggcttccccctggattacggtaacctatctacgaaggccatgagaaaaatcattcctcatctcaaggcagggctgtcatttgctaaaaagagtaaggaagacaatatccttagcgccactgctatggccggctacaaccactccaattcttatacaaaagaggatttggcaaagagggttctgaaagagaagctcgaagtgttccccaaaaactcgctgcggaacccagtagtggagaagatattaaatcaaatgatcaacctggtcaatgaagccgtggaggagtacggaaccattgacgaagttcgaatcgagcttgctcgcgaattgaagaaaaacgcggaggaaagagcaaatatgactagcgagattggcaaggccacactcctgcaccagaaatatgctgagatcctaaagaaagaatttgatatacctgtgccatccaggaacgacattatccggtacaagctgtatctcgagctggccaataacgggtacaaggatctttataccgacgtccagatcaaacgcgaagagttgttcacgaataagtacgatattgaccatatcattccccaatcaagatttttcgatgacagtttttctaacaaagtgctggtaccgaggggagcaaatttaaagaaagccaaccagaccgctttcgactacctcgaaaatgaggataagcagaagctggagaaatttcttaacataatcaagaatctgtatgacaaaggtgaaattacaaaggccaaatacgagaagttgcagaagaaaggcagcgatatcggggaaggattcattgagcgtgacctccgggatactcaatatatcgcaaagaaagcgaaggaaatactgttcggcatcacccactccgttatttcaacaagcggtaaaatcactgacaagctacgagaggattggaacctggtgaacaccatgaaagagctcaatctggacaagtacaagaaacttgggttgacagaaaccctgttaaactctaagggcgaggaaaaagagagaattatcgattggtccaagaggaatgaccatcgccaccacgctatggatgccctcactgtcgcatttacgacacataaccacatacagtatctgaattaccttaacgcccggaaagacgaggatcataagcagcacaaggtgattagtaatatcgaaaacctgatcaccaaagtcttcgagaagaaaaatggagctaagcagagaaggtttattgaacctataaacaatttccgcgtggacgccaaaaagcatctagacgagatcctcattagccacaaggctaaaaacaaggttgtgactaaaaatatcaacaagattaaaaagaagggctctgtagtcgcaaaaaccgaactgacaccccgagggcaattgcacaaggagaccatctatggatcctcaaaatttctgaagactaaagatgagaagataagtggtaaattcgacttagaaacaatcaataaggtgcagaacgagaagtacaaaaatgccctcctgcagcggcttcgtgaatttggcgaggatagcaagaaagcgttcacggggaagaacgttatttcgaaaaacccaatctacctggacgaagagaagaccttgcagattcctgagtccgtgactctcgcctggtatgaaatgatctacacaataagaaagcccgtcaatccagataactttaaagactataagaatattgataaagtgaccgacgagaagatcagggctgtactgacagatcgcctacggaaattcaacggaaattctaaggaagcatttagcgacctggagaagaaccccatctggcttaataaatcaaagggcattgccatcaaaactgtgaccataacgggtatgagtaacgttgaagctctccattacaagaaagatcacctggggaaggagattttggacaagaaaggcgacagaatgcctgtcgatttcgtgtccaccggaaataaccatcacgccgcaatctatgaggacgcgaagggcaatctgcaagaaagggtggtctctttctacgaggccgttgaacgagtgaaccaggggttaagcgtggtaaataaagattataacgctggactcggctggaagtttctgttcacaatgaaacagaatgagatgtttcttttcccatccgaggactttaacccgaaggaaattgatctgtacgacgagaaaaacttgaagctcatcgccaagaatctgttccgcgtccaaaaatttggtgaactatcaaagagcgggttctggtttcggcaccatctggagaccagtgtggatgttaaaaaggaacttagaaactactcttatctcgacttctactccaaagattttatgaagactatagtgaaggtcaggctgaatcacttgggaaaaattgtgcaggttggcgagtattga

SEQ ID NO: 3307 - RNA, 4230 nt, synthetic construct
  misc_feature 1..4230: note = Cas9 variant
  source 1..4230: mol_type = other RNA
atgagcatcattaacttccagagaaggggcctgatggagacccaagcctccaatcagctcatatcttcacaccttaaggggtaccccatcaaagactattttgtgggactggatattggtacaagtagcgtcggctgggctgttactaacaaggcatacgaattgttaaaattccggtcccataagatgtgggggtctcgcctgtttgacgagggagaatcggccgtggcgcgacgtggcttcagatcaatgaggcggcgcctagagagaaggaaactccggctgaaacttctggaagagttgtttgctgatgccatggcacaggtagaccctacgttctttatgcgcctccgagagagcaagtatcactacgaagataaaaccacaggtcatagttccaagcacatcctgttcattgacaaaaattatactgatcaggactactataaggcctacccaaccatctaccatctgagagctgagctcatgaaagatgggacagacgatataaggaagttatttctggcagtgcaccacatccttaagtatcggggaaacttcttgtacgaaggcgccacctttgactctaatgctagcactctggatgacgtcattaaacaagccctagagaacatcacattcaattgctttgactgtaactccgcgatttcaagtatcggccagatactcatggaggcagggaagaccaaaagcgataaggccaaagctattgaacatctggtggacacgtatatcgccactgataccgttgacacatcttccaagactcagaaagatcaggtgaaggaggacaagaaacgtcttaaggcattcgctaatctggtcttgggactcaacgcctcactgattgatttattcggtagcgtggaagaactggaagaggacctcaaaaagctgcaaatcaccggcgatacatacgacgataaacgcgacgagcttgcgaaggcctggagtgacgaaatctatattatagatgactgcaagtctgtatacgatgcaatcattttgctatccatcaaagagccggggctgaccataagcgaatcgaaggttaaggcttttaataagcacaaagacgatctcgccattctgaagtctcttctgaagtccgacagatcaatctataacacgatgttcaaagtggatgagaagggattgcataattacgtccactacatcaaacagggcaggactgaagagacaagttgtaaccgggaggacttttataagtacaccaaaaaggtggtggaaggtctccccgatagcaaggacaaagagtatattctgtccgaaatcgagttacagactctgctacctctccagcgaattaaggataatggggtcataccataccaactgcaccttgaagagttgaaagttatcctggctaagtgcggacccaaattcccttttctcaacgaggtggccgacggcttctctgtagcagaaaagctgattaaaatgcttgagtttcgcatcccatattacgtgggccccctgaacacacatcacaatgtcgataacgggggattcgcctgggctgtgagaaaggcgagcggtagggttaccccttggaattttgacgacaagatcgatcgggaaaaatcagcagccgctttcattaagaacttgacgaataaatgtacctatctcctgggcgaggacgtgttaccaaagagttccctgctatacagcgagtttatgctcctgaacgaacttaataacgtccgcatagatgggaaaccgttggagaaggccgtgaaggaacatctgatcgaggcagtattcaaacaggaccacaagaaaatgacaaagaatagaattgaacagtttctcaaagataacaattacatccccgagaagcataagcctgagattactggactggacggcgaaatcaaaaacgatttagcctcttatagggacatggttcgtatactgggtaataacttcgatctttcaatggctgaggaaatcattaccgacatcacaattttcggggagagtaagaaaatgttgcgggaaactctccgaaataagtttagctccagactggatgacgaggccatcaaaaagctatctaagctgaggtaccgcgattggggccggctctcgagaaaactgcttaacgtgatagagggatgcgacaaggcaggcgacgggaccccagaaacaattatcattttgatgaggaacttcagctataatctgatggagttactcggagataaattttccttcatggaacgcatccaagagataaacgcgaagctgatcgaaggtcagattgtcaatccccacgacatcattgatgaccttgctctgagccctgccgtgaaacgagcagtctggcaggccttgcggatcgtggatgagatagttcacattaagaaaaccctcccagctcgtatctttgtggaggtaactagaagtaacaaggccgaaaagaaaaagaaagactctaggcagaagcgcctgagcgatctatacgcagctatcaaaaaggacgatgccctgctctccggcctgacgaatgaggagttcgggggacttaagtcaggcttggcgaaatatgacgatgccgctctgcggagcaagaaattatacctctattacacacaaatgggtagatgtgcatacaccggggaggtcattgacctgtctcagcttaacactgacaattatgatatcgaccatatttaccccaggtccctgaccaaggatgacagttttgataacctagtgctctgcaaacgaacagccaatgctcagaagtcagacacctatccgatatctaaggagatccagaaagcccaaaaggcattctggatttttctgaaacagcagggcttgatctccgaacgcaagtacgagcggctgactagaattacacctttaacggcggatgacctctcaggattcatcgccaggcagctggttgaaaccaaccaaagtgtgaaagctgccactacacttctgcgtcgcttgtatcccggcgtcgatgtggtatttgtgaaggcagagaatgttaccgacttccggcacgataacgactttataaaggtcagaagcctcaatcatcaccaccatgctaaagatgcctacctgaacatcgtggtggggaatgtctatcacgaaaggttcacacgaaacttccgggcatttttcaagaaaaacggagccaatcgcacttacaacctagctaagatgtttaattacgacgttaactgtaccaatgcgaaagacggtaaggcctgggatgtgaagacgtcgatggacaccgtgaaaaagatgatggcatccaacgatgtaagagtcacaaaaaggctgcttgagcagtctggcgctctcgccgacgccactgtgtataaggctgcagttgccgagaaagcgaaggatggggcttacattggaatgaaaaccaagagctcagtgttcgccgacgtcagtaagtatggcggtatgacaaaaatcaagaatgcatactccattatcgtgcagtatgccgggaaaaagggcgaagttgtgaaagagatagtaccactgcctatttacttgactaaccggaataccacggatcaggacctgatcgattatgtcgcttctatcattccccaagcaaaggacataagcatcatttaccgaaagttatgcatcaaccagctcgtgaaagtgaatggattttactattacctgggcgggaagacaaactccaaattctgtattgataatgccatccaggtcatagtttcaaacgaatggatcccatatcttaaggtgctggagaaatttaataacatgagaaaggacaacaaggatttgaaagcgaatgtaattagcacccgcgctctcgacaacaagcatactatcgaagtgaggattgtcgaggagaaaaatatcgagttctttgactacctggtgagtaagctaaaaatgcccatatatcaaaagatgaagggaaacaaagccgcagaactgtctgaaaagggctacggtcttttcaaaaagatgtccctcgaggaacagagcattcacctgatcgagttgttaaatctgctcacaaaccagaaaaccacttttgaggttaagcctctggggatcaccgcctcgcgttcaacagtgggatctaaaattagtaatcaggatgagttcaaggtcatcaacgaatccataacgggcctttatagcaatgaagtgaccattgtttga

SEQ ID NO: 3308 - RNA, 4233 nt, synthetic construct
  misc_feature 1..4233: note = Cas9 variant
  source 1..4233: mol_type = other RNA
atgaccaagaacatcctgggcctcgaccttggggtgagctccattggatgggccctggtccaggaaaattctaaaaaccccgaaaataacaagatagttaaattgggtgtgagagtaaatcctttaacagtggatgagcaaatcaacttcgaaaagggcaaaccaattactacgaatgcttcaaggaccctggcacggagtgcccgccgaaacctacagcgttttaagctcagaagggcgaatctgatcgacgtccttaagaaagggaacattctgaagcagggagatttgctcacagagatcggcaaaaatagcactttccagacccaagaactgcgggctaagtccgccaaagagaaggtggagctgtctgactttgttcgcatactcttactgatcaacaagaaaagaggttacaagtcgtcaaggaaagcaaagaatgaagatgaggggcagattatcgacggaatggccgtggctaaaaagttgtatgaagagaacattacaccgggcgagtacagctataaacttctgcaggaaggccggaagcagctacccgatttctaccgcagtgacctccaagcagagtttgataagatctggaatttccagaaacagtttaaccctgaaatattcaccaacgagctgtataagcgacttcaggggaaaaatagaaacgccacttggaaggaactggagattccattttacttggtcggaatcaaacaaattggtacaatgcaggagaagaagatcgaaaggtatttctggcggtccgaggctgtgaaaaagcagctcgactttgaatctctggccgtagttttccaagagatcaatagcaacttaaataactcctcaggctacctgggggcgattagtgatcgtagcaaagaactctactttaataaccagaccgtgggagagtatctttacaatcagctgaagataaacccccacacgaaattgaagaatcaggtcttctatcgccaagactacctagatgagttcgaaaagatctgggagactcaggcaaaatatcataagaaactgaccaaggaactcaaagaggaaattagagacatcgtgatattttaccagaggaagctgaagtctcagaaaggccttatttccttctgcgagtttgagaaccgggaaatcgagatcacagtgaatggtaagactaaaaagaaaaccgtcgggctgaaggttgtgcctcgatcaagcccattgttccaagaatttaaaatttggcagcgcctcaacgacctggagttcaagaatgtagagacaaaggaaatctttcccttagagctggaacacaaagagattctattcggaaacctcaacataaagggcaatctgagttctaaagaacttatcgagcagttgggctatccttccaaggagtggaaatgtaactttaaggaaattgatgggaataagacccatgagaacctgtacacggccttcctcaaaatcatcgctaatgaaggaattgagtttccaaaggagttcaaactgagcatagacgatgacatcaaggtgtcgaaaattgatgtctcttccgagaagatcaaggagtttattaaagaaaacttccttaagctgggtatcaatacttcaatattggacttcaacccggagctcgatggcaaagactttgaaaagcaggagagttaccaactgtggcacttactgtatagctacgaaggggatgactccgcctctggaaatgagaaactatatgagctcctggaaaagaagttcggctttaaaagagagtacagcaagatccttgcagatgtgggtttctcacaggactatgggagtttgtccagcaaagctatgaggaagatttttacatacatcaaagaaaacaagtattctgaggcctgccatctggcgggctacaatcacagtaaaaacagtctcaccaaggagcagctggccaatcggattttaaaggaacagctggagatccttcccaaaaacgcattgcgcaatcctgttgtggaaaagatactcaaccaaatgattaacctggtcaatgaggtgatcaaagaatacggaaagccagacgagattagaatcgagctagctagggaactgaaaaagaacgccgaggaacgtgctaatatgactagcgatatatccaaggccacactcctgcaccagaaatatgcagaggtacttcagaaggagttcggcatcaaagccccctctcggaacgacattatccgatacaagttgtatctggaattagctaataacgggtacaaagatctctataccaatcaaaagattgagaaggaaaacatctttacggacaaatacgatatagaccatattatccctcagtcgagattctttgatgacagcttctccaataaggttctggtgccaaggtgtgcgaaccaggataaagacaattataccgcagtcgattacatcgagaagaaatacggagaacgcggtaaggaggactttcttaaccggattcacctggtgttcaagtcaaaagaagccatcgctggcaagagtgagtctcagattagctccatgaatacaaaatttttgaagctccagaaaaaggggtcagagataggagaaggcttcatcgagagagatctgagggacactcaatatattgccaagaaagcaaaggaaatcctattcggtattaccaacagcgtcatctctacatccgggcgcataactgacaaactgcgagaggattggaatctcgtgaacaccatgaaggagctgaaccttgaaaaataccggaagttgggcctgacagagttaatcgccaatagtaaaggagaagagaaggaacgtattatcgactggaccaagagaaacgatcataggcaccacgctatggacgccctcactgttgcatttacgacacataatcacattcagtatctgaactaccttaatgcgcgcaaagatgagaagcataaagagcaccataacatcttcgctatagaaaatattatcaccgagatcgtggaaaagaaaaacggcagcaaggagcggagatttaagctgcccattaaaaatttcaggactgaagccaagaaacagctagaggaggtactcatatctcacaaggccaaaaacaaggtcgtgaccaagaatatcaacaaaacaaagaaaaagggaggagttgtgtccaaaattgtcctgaccccgcgaggtcaattgcacaaggaaactatctatggctcagcaaagtttctgaaaacaaaggaggagaaaattagtgggaagttcgacttagaaacgatcaataaagtgcagaacgaaaagtttaaaaatgctctcctggatcgccttaaggagttcaacggagacagcaagaaagcctttaccggcaagaatgtacctgctaaaaaccccatatacctgaacgagcagaagactgaacaggtgccagagtcggttgtcttggcatggtatgaaacaggttacaccatccggaaagccgtgaatgcggataacttcaaggactacaagaatctcgagaaaattatcgataagggggtgaaagagattctgaagaacagactaaatgcctttaacggcaatgctaaagaagcattctccgacctggagaagaagcctatctggcttaaccaatctaaaggaatagccgtcaagacagttactattaccggcatcaataacgctgaaacgctccattataaaaaggatcacttcgggaatgagctgttggacgaaaacgggaaaaagatccccgtggactttgtgagcaccggcaataaccatcacgtagccatttacgaggatgcagacggtaatctgcaggagagggtcgtgtcattctatgaagcggttgagcgtgtgaaccaggggttaagtatcatagataaggaatacaaccaagacctcggatggaaatttctgttcacaatgaagcagaatgagatgtttcttttcccatccgaagattttaaccccaaagagactgacctgttcgatgagaagaatttgaacctcatttctaaaaatatgtttcgcgtccagaagttcggcagcctgctatccggtttttggttccggcaccatctggaaaccacagtggaccttaactcaagcctcaaagatacttcatataaggttatccagtcttgcaataacctgaagttgattgtgaaagtaagattaaatcacctgggcaagatcgtccaaataggggagtactga

SEQ ID NO: 3309 - RNA, 4236 nt, synthetic construct
  misc_feature 1..4236: note = Cas9 variant
  source 1..4236: mol_type = other RNA
atggtgaagaaagagtacttcatcggcctggacatggggaccagctccgtcggatgggccgttgctgatacaaactataatctccttagagcaaagggtaaagacatgtggggcgtgaggctgtttcccgaagcctctactgcggctgatcggcgctcacaccgaacggcccgtagaaacaataagaggaaagcagcccgggaggggttcttgcgcgaaatttttgaggacgaaataaacaagatcgatcctggattctttgagagattaaaggagagtaaatactatctggaagacaagctaaccgatacaccattcgtactctttgctgacaaaggctacactgataaggagtattacgacgaatatccgaccgtgttccatctgattaaagagcttatcagcgagaagggtctggaaccccacgatattaggttggtctacctcgcatgcctgaatatctacaagcatcgggggcactttctgaacgacacactctccggagatggcatagacaatatcaactctttatgtaatgacttcacctcgtatctggccgattacaaccaaaattcagaggacgatggcactgagaaaatggaccttgatagcacagtgttggctggggtttttgaggaaaccctgtgcaacaagcatctaagtaattccgccaaaaagcgcgacctcattgataaactgggaatcacgaacaagactaaatatcttaccgagatgatggcgctgatttctggtttggcaagctccgtgtcaaatatgttcgccaaggacacatacgatgaggaacagaagaaatttaagctcagtttccgaagctctaacctggacgaggatatggtcaaagtgcaggctatgttaactcctgaagagtatgaaatgatctgtataatgaagaaaattcacgactggtccgtagtttcagtgatcatgggcagccacaagtacattagtgacgccagagtcgagctgtatgagaagcataaacaggatctcgcaaaacttaaagctatctacaaggaatacctgccagacaaatatgatgccatgttcagggagatgaccgacaactcttactccgcgtatgtggggaaggtgagctcgaataagaaatctcagacaggaaaccacaaggtccggatgcaacgtcgcggcgccaaatgcaagcaggaagatttttacgacagaatcaaaaaggagattaattccgttccccaggaagagaagatagatatcttgcaggacatggagaccaactcattcctacctaaacaactgacgaatgaaaacggtgtgattccatatcagctccatctggcagagcttaagaaaatcctggataatgctagtacttacttgccctttctcaacagcgccgacgaaacagggatatccaataaggataaaattatccagctgttcgagtttaggatcccttattacgtaggaccattattcaagtctgagaaaaacaagaccaatgcttgggtggtccggaaggaaagcggcaaagtgtacccgtggaactttaatgagaagattgacgaaaaacagtcagccgagatcttcattgaacgaatggttcgccactgtacttatctgaacaatgagagtgcactacccaagaactccctcaaatacgagagatttagggtgctgaacgaacttaataacttgcggataaatggcgagcgcatcagccctgaactgaagcaaagaatttataacgaactcttcaaggtcaaaaagaaaaggatcacaaagtctatgctgtgcgaatacctttataaaaatgggatcgccgataaggactcagagctgagtggatttgacggtaccttcgctaacgcgttgctcagctacggcaagtttcgtgagctgttcaatgtggatacgttaaccgacaaacaggaagcagccgctgaggatattataaagtggtccacagtatatggggactctaaaaagttcctgcaggagaaaatcgaagaaaactacggaccagagtcggagaatcccctactcgataacaagcaaattaagcgggttatgggctacaaatttactgactggggtaatctgagccgagagttccttaacttggaaggggccgataaggacaatgataccacaactggcgaagtgatgcctctgatcaccagaatgtgggaggagaactataatctcatggaactgatgtccaacaaattttcatacagggacgcattagccgagaagacagaagagattgagaaaaccctgactgatatcgaatatgaggaccttgaagatttgtacataagtgctccagtcaagcgcatgacgtggcagacactcctgatcctaaaagagatttatcagatcatgggatacgcccccaagaagattttcgtggaaatggcacgggaggaagaggagaaagtcaacggcaagggggcgagaaaatctagcaggaagaaacgcctggaagacctctatcgaaattgtaaggacgcttccaaggagctgtcaaccggaatcaaaaacgccgatgaagcaatacttcggcgtaagaaattgtacctgtactatttacagaagggtaaatgcatgtacagcggcaagactattgactttaagtctctcttcaccaataactatgatatcgaccacatttacccgcaatccgtggttaaagatgacagtctggagaataacatggtgcttgtagaaagaaattataacaataagaaaagcgatacatttcctatcttctctgactggcagaacaagatgaaacccttttggaccatgctgaaggagcaggggttcataaatgaggaaaagtacaaaaggttgactcgcacagatgagctcacggacgatgaactggccaactttgtcaatcggcagctagtggagaccagacaagctactaaggttatcgccgagctgctcaaaaactccttcgacgacattgattcaaagatcgtgtatgcaaaagctggaaatgtcagtgaatttaggcataagttcagcatgaagtacgacaaagagacagaaaagtcgtccgtgattcacccagagctggtaaaatgtcgaatcataaacgatttccatcacgccaacgactcttaccttaatattgtggttggcaacatctatgatgtcaagtttacccagaatccttacaactatatcaaagaatacaagaaacagaagaataacagcgcgttgtcagagcaggagaaggaaaaatatcatatggacaagattttcaattttgatgtgaaacgcaacggtgaggtggcctggatcagtagaggggacaataagacactggaaactgtcttaaaagttatgcggaagaacacccccattgtgacgaggatgaatttcgaggaacacggccaactcgctgatctgaccatatactccgcatctgacgcccttagcaagaaaggagtgggctatatcaaggtaaaggcttccgatgcccgtctggacgtcctaaagtacgggggatacaaaaagtataagggtgcatactttttcctcgtggagcacacagagaaaaacaagcgcgttcggactattgaaaatatgccactgtatttgaaaaacgagctgaataccaaggagaaaatcgaattatggtgcgcggataaggaaaacggcctcgggctggtggaccccgacgtcagacttggaaagattaaactgtactcaaagatcaggatagatggctttgacttgtatctcacaggtcgaactgggaataacctgctaaccagcaacgccgtgcagctgaaaatcggcagtaataagccttctgataacgacaaacttttctggcggtactatattaataagctctccaaatacacggagaacagcgagtttgtttcgatccagaataacattaagctgtacgatttgttcgtggaaatcaataacgctggagtatattcaaagcgccagaatccaataggcgacaaactgttagaggggagatctaagtttattaacctcacactgagtaaacaagtcgaaacccttctgggaatcatcaggatttactccttggagaatcagggcgccgatctcagcaacataggtgggcaggagaagaatggaactatgaaaccgcataagcggatctctgacaagaaagaagtgctgctaattaaccaaagcgtgacaggcctgtatgagtccaagatcgatcttctcaaaatttga

SEQ ID NO: 3310 - RNA, 4236 nt, synthetic construct
  misc_feature 1..4236: note = Cas9 variant
  source 1..4236: mol_type = other RNA
atgaagaacatcctgggcctcgaccttgggaccaatagcattggatgggccctgataaaacagaacgctgaggaaagacaaggttccatcttgggcatggggacaagggtgttacccatgtctcaggatgtcctgggagacttcggcaagggtaattcagttagtcagactgcagcccggacggggtaccgcggcattcgacgtctaagagagaggtttctcctgcggcgcgaaagacttcacagggtgctgaacatcttgggattcctcccttattactatgcggctcagattgattttgacaaacggttcggcaagtttaaagccgagaccgaaccaaagctgccgtacaataacgaggggttcatctttaagaatagcttcgaggaaatgctgtccgattttaaaatatctcaacccgagctcttatcgggaaacaagaaagtaccttatgactggacaatctactatctgcgcaagaaagcagtgtcacagaagattgaaaaggaggagcttgcctggatcttgctgaatttcaaccagaaacgaggttactaccagctaagaggcgaagattttgacgaggaaaaggataaaactttcgtcaccctcaatgtggacaaggttattgatagcggggagaaagtgaagggaaacatcctgtttgacatatatttcacaaatggctggaaatacgaaaagcaaaccactaagccagaggattggcttggtaggagtaaagagttcattatcacagaatccctgttgaagaacggggaggtccggcgtacctttaaagctgtggactctgaaaaggactggattgcaatcaaagccaagacggagcaggaaatcgagactgctcataagaccgtaggaagctatatttacgatgccatactccagaatcccaaacagaagatcaaaggcaagctggttcgcacaattgagagaaaattctataaggaagagttaaggaagatcctggaaaaacaaaaggactttcacctcgagcttcagaacgaagatctgtactccgactgcgtgcgggagttgtatcgaaacaatgatactcatcagctatcactggcgaaaaagagtttcatacacctctttctggaggacattatcttctaccaacgccctcttaaaagccagaagtcttccgtctcaaactgtaccctggaatgcagaaagtacagggataaaaatggcgcagaggggatccagtttttgaaggtgattccaaaaagcaacccctattaccaggagttccggatctggcaatggatgagtaatctcaagatttatcgcagagacgatgacgtgaacataacatctgaatgtctgaaaaccgccgaggattacgaagacttatttgtcttcctgaatatcaggaaggaggttgaccagaaagcatgcctacgtcattttaagctctccgaaaagacgcaccggtggaactatgtggaggataaaaagtacccttgtaatgaaactggaacaatgattagcgagcgactgaaaaaggtaggtgactcgccagataacatcttcaccagagagatggaacagcagatctggcacattatatattctgtgaatgacaaaactgagtacgaaaaggcccttaagtcctttgctaaaaagaacgagttggataatgactcattcttcgaggcttttaggaaattcccgccctttgatagtgaatacggcagcttctccgagaaggccatcaaaaagctgctccctctgatgcgcattgggaagcattggaactgggaagcggtcgacgagaaaatcaagaatcggattcagaaaatcataatcggagaatatgatgagaacattaaggacaacatcagagagaaaacactttctctgcaaaaggaaagcgattttcagggcttgccactctggctggcccagtacgtggtttatggtaggcactcagaggcaagtgtggctgggaagtggaactccgtcgacgatattgaagagtacttaaaagagttcaagcaacatagcctgcgcaatcccatcgtggaacaggtaataatggagaccgttcgagtggtcaaagacatttggatcaagtatggcaatggagccgctgactttttcgatgaaattcacatcgagctaggccgggaaatgaaactccctgccaaggagcgtaacaaaatgacgcagaagatatctgaaaatgagaacaccaatctgagaatcaaggcacttttggccgagatgatgaacgactcagaagtgcagaatgtcaggccatacagtcccatgcaacaggagattctgaaaatctatgaagatggggctctcaacagcgagatttccgtggacgatgacatcctgaagatatctaaaacagcgcagccgtcgcctagcgatttaaagaaatacaagctgtggcttgaacaaaagtaccgctccccctatactggagacattatcccattgaataaactctttaccacagagtacgagatcgaacacattatccctcagtcacggtatttcgatgacagtttttctaacaaggttatttgcgagagcctggtgaatagactaaaagataactacataggtctgggcttcatcaagcagtttcatgggtataaaatttccgacaagactaaggtattcgaagtcgaggaatacgaggatttcgtgaaaaagaattatgcaaacaacaggtcaaaacgaagcaagctcctgcttgaggaaatccccgaggaaatgattgagcgccagttgaatgacacccggtacatctctaaatacatatccggaatcctgagtaacattgttagaaagaaggagaatgacgaaggcgtgaacagcaaagatatcattccaggtaatgggaagatcacatctcaattaaaacaggactggggcctcaacgatgtctggaatgacctgatacttcccaggtttgagcgtatgaacgaactgaccaagtcctcatatttcactgtgtggaatgagaaataccagaagtttttgcctacggtaccagtggagttcagtaagggatttagcaaaaagcgcattgatcaccggcatcacgccctcgacgctctggttatcgcctgtgcaacaaaagatcatgtcaacctactgaataacaagtcggccaaatccgaaatgaagagatatgacctcaaaaggaagctgatgaagttcgagaaaaagacctaccagcactctcaaactggcgaacgaatcgtgaaagatgtgccggtcgagtttcttaagccctggaatgacttcaccgttgaagctaaagagaacttggaaaagattatagtgagctttaagcagaatctgcgggtgatcaacaaagccacaaaccactatgagaagtggattgagaaagataatgtaaaggtcaaagggttagtggaacagcagggactcaactgggcaatccgcaagcctctgcataaggacaccgtttcaggtaaagtggaccttccaggcattaaggtccccaaagggaagatcctgactgcgacaagaaaaagtatagatacgtccttcgacctaaagaccatcaattctattactgatacaggagtgcaaaagatcctcaaaaactacctggagtataagggcaatagctccgaagaggctttttcaagcgaaggtattgaggacatgaacaataacatcgagaaattcaatgaagggaagttgcaccagcctataaccaaagttaggattttcgagctgggcagtaagtttccattaggacagatcggcaacaaaaagcataagtacgtggaaacagccaaagggactaatctcttctttgcaatctacgaggatgacaagggaaaacggacctatgagacgattcccctgaacgaagtaatcgagcgacaaaagcagggccttgccccggtcaccctgaaatctaagaatgatttctacttgtgccctaacgacctcgtgtatgtggctgccgaaggtgagtccgtcaataagatagattttaaatacgcaagccaggaatttattcacaacatctataaggttgtgtcgttctcagggtctcagattttctttgtaaaacaaaatatcgctgtgagtatagtcaacaaggccgagttctccacactgaacaaaatggagagagcggtggacggaaagatgattaaggattgttgcatcaaactaaagatcgaccgcattggcaatatcactaaaagctga

SEQ ID NO: 3311 - RNA, 4239 nt, synthetic construct
  misc_feature 1..4239: note = Cas9 variant
  source 1..4239: mol_type = other RNA
atgatgaccaagaacatcctgggcctcgaccttgggacaaatagcattggatgggccctgataaaacagaacgctgaggaaagaaagggttccatcttgggcatggggactagggtgttacccatgtctcaagatgcactgggagacttcggcaaaggtaattcagtcagtcagacggccgcgcggaccgggtaccgcggagttcgacgtctaagagagaggtttctcctgcggcgcgaaagacttcacagggtgctgaacattttgggcttcctccctgattattacgctgcccagatcgactttgataagcggttcggcaaatttaaggcagagacagaaccaaagctgccgtataataacgaggggttcatttttaaaaatagcttcgaggaaatgctgtccgactttaagatctctcagcccgagctcttatcggaaaacaaaaagataccttacgattggactatctattacctgcgcaaaaaggccgtatcacaacgaattgagaaggaggaacttgtgtggatcttgctgaatttcaaccagaaaagaggatattaccagctaaggggtgaggactttgatgaagagaaggacaaaaccttcgtcacactcaatgtggataaggttattgacagcggcgaaaaagtgaaggggatcgtcctgtttgatgtgtacttcaccaacggatggaaatatgagaagcagataactaagccagaggactggcttggccggagtaaagagttcattatcacagagtccctgttgaagaatggtgaagtaaaacgtacctttaaggctgttgactctgagaaagattggattgcaatcaaggccaagacggaacaagagatcgagattgctcataaaactgtggggagctacatatatgacgccatcctccagaaccccaagcagaaaattaagggaaaactgatccgcaccatagaaagaaagttctacaaggaggaattaaggaaaattctggagaagcagaaagaatttcaccctgagctccaaaatgaggatctttattccgactgcgtccgggaactgtaccgaaacaacgatgcgcatcagttgtcactagcaaagaaagacttcatccacctgtttgtggaggatatcattttctatcagcgcccactcaagagtcaaaagagctctgtgtccaattgtacactggaatgcagaaaatacaaggacaaaaacggcgaggagaggatccagtttcttaaggtcattcccaaatcaaatccttactatcaggagttccggatatggcagtggatgagcaacctgaagatctaccgcagagatgacgatgttaatattaccagtgaatatttgaaaactacagaagactaccaagacctctttgtgttcctgaacaccaggaaggaggtagatcagaaggcctgtttaaaacattttaagctgaatgagaaaacgcaccgttggaactatgtggaagacaagcggtacccatgcaatgagactggcacaatgatcctagaacgattcaaaaaggtcggggattctgctgacaacatctttaccagagagatggaacagcagatgtggcacattatatattccgtgaatgataagactgagtacgaaaaagccctcaagagcttcgctaaaaagaacgacctggataatgtttcgttctttgaggctttcaggaaatttccgcccttcgactctgagtacggatccttttcagaaaaggccatcaagaaacttttgcctctgattcgcacaggtaagtattggaactgggaggcggtggatgagaaaaccaagaaacggatccaaaagatgattacgggcgaatgggacgaagatatcaaggacaatataagagagaaaaccctcagtctgcagaaggagagcgatttccaggggcttccactgtggttggcccagtacgcagtctatggaaggcattccgaagcatctgtggccggcaaatggaacagcgtaaacgacatggaggaatacctcaaggagtttaaacaacactcactgcgcaatcccatcgttgaacaggtgattacagaaactatccgagtcgtgaaggacatttggatcaaatatggtaacggggctgccgatttctttaatgagatacatattgaattaggccgggagatgaagctgcctgcaaaggaacgtagtaaaatgacccagaagatctccgagaacgagaatacaaacctaagaattaaagccctcctggtcgaaatgatgaatgacagcgaggtgcacaacgttaggccatactctcccatgcagcaagaaatccttaagatatatgaggatggagctcttaattcagaaatcagtgtggacgatgacattctgaaaatcagcaagactgcgcagccgtccccttctgatctcaagaaatacaagctgtggttagagcagaaataccgctcgccctataccggcgacattatcccactgaacaagttgttcacaaccgagtacgaaatagagcacattatccctcaaagccggtattttgatgactccttctcaaataaagtaatctgtgaaagttctgtcaacagattgaaggataattacattgggctcggatttatcaagcagttccatggttataaaattagcgacaagactaaagtgttcgaggttgaagagtacgaggattttgtgaagaaaaactatgcatccaattggtcaaagaggagcaagctgctactggaagagatacccgaagagatgatcgagcgacagctcaacgacacgcgctacatttctaaatacatctccggcattctgagtaacatcgtccggaagaaagaaaatgacgatggggtgaacagcaaggacataatcccaggaaatggcaaaattacatctcagcttaagcaagattggggtttgaacgacgtatggaatgatctggtgttacccagattcgagaggatgaacgaactcaccaagtccaatgactttactgtttggaacgagaaatatcagaagttcctgcctaccgtcccagtggaattttcaaaagggttcagtaagaaacgtatcgatcaccgccatcacgcccttgacgctctggtgattgcctgcgcaacacgggatcatgtcaatttgctcaacaatcagagcgccagatcggagatgaagaggtacgacctgaaacgaaagctaatgaagtttgagaaaaaggcttatcagcactcccaaaccggcgaacggatcgttaaagatgtgccggtggagttcctgaagccctgggacaactttatagtagaagccaaagagaatctcgaccgcattatcgtctctttcaagcagaacctgagagtgatcaataaggcaactaaccactacgaaaaatggattgagaagaacaatgttaaagtgaaggcgcttgtcgagcagcagggattgaactgggctataaggaaacctctgcataaggatacagtgagcggcaaggttgacttaccagggacgaaagtgcccaagggaaaaatcctcaccgccactcggaagtcaattgatacaagttttgacatgaaaaccatcaattccattacagatactggtatccaaaagatactgaagaactatcttgaatacaaaggctcttatgaggacgcattcagccctgaagggatcgaggatatgaataagaacattgaaaaattcaatgacggaaagcagcaccagccaatcattaaagtacgaatctttgagctgggctccaagttccccctaggtcaaatagggaacaaaaagcataagtacgtcgagaccgccaaaggcacgaatctctttttcgctatttacgaagatgacaagggaaaaagaacctatgagacaatcccgctgaacgaagtgatcgagcgccagaagcagggcttggcccctgtgacttttaaatcaaagaatgatttctacctgagcccaaacgacttagtctatgttgcagctgagggggaaagtgtggataatctcgactttcagtctgactcccaagagtacattaacaatgtatataaggtggtcagcttctcgggatcacagatctttttcgtgaaacagaacgttgccgtgtctatagtcaataaggcggaatttagtaccctgaacaaaatggagagggccattgatggccgtatgatcaaggaatgttgcgtgaaacttaagattgaccggatcggtaacatgacaaagtcctga

SEQ ID NO: 3312 - RNA, 4245 nt, synthetic construct
  misc_feature 1..4245: note = Cas9 variant
  source 1..4245: mol_type = other RNA
atgaagaaaatcctgggcctcgaccttgggaccaacagcattggatgggccttcgtggaggaagctgagaatgaatccgagaagtcttcaataatcaaactgggtgtcagagttaaccccttgacagtggatgaacagcaaaattttgagaagggcaaaagtattactacgaacgcagacaggaccttaaagcggagcatgcgccgaaatctgcagcgttacaagcagagaagggagaacctaatcgatattctcatgaaaaatgggttcacatccgacgatactatcctgtctgaaaacggaaatcggaccacatttgagacctatcgccttagatcgaaggccgtagcggaaaagatatcactgcaggagttcgctagggtgttgctcatgatcaacaagaaacggggctacaagagcagtcgcaaggccaaaggtactgaggacggggaactgattgatggaatggaggtcgcaaagaaactgtataattacaacctcacacctggccaattatgcctgcagcttttgaatgaaggcaagaaacatctgccagacttttatcgatccgatctacaggccgagttcgacagaatctttgatattcagatgaccttctacacggaatatctcactctggagcttaaggaggaactgagggggaaaaagcgggacgctgtgtgggcaatctgtgccaagatatttaaagagaagggattcgaattgattggtaccaaacgtcaaggctctacagctgagcagaagcacgaaaactacagctggcgcgccaaagggctctccgagaagctggagttagaacagctggttgtggtcctccagcaaatcaatattcagcttaactcaagtagcggatacctgggcgcgatctctgatagatccaaggagttgtttttcaacaaacagactgtgggtcaatatcagatggcagtactagacaagaatccgaacgccgggctgaggaatatggttttctaccggcaggactatctcgatgaatttaacgctatctgggagaaacaggccctgttccaccccattcttaccgacacactgaaggatgaaatacgagacgtgatcatcttttaccaacgcagattgaaatcacagaagggactcattagcttctgcgagctggagagtaggaagatagaagtcgagattgcaggccagaataaaaccaagatggtgggctctcgggtgatccctcgctccagcccattatttcaggagttcaaaatctggcaatcgctgaacaatattgaagtctttgggaagggtaaaaagtctaagaaacagaaggagcagacgctattcgatcagactgaagaccccctcgagtttggaggcagaagggaactgtatgaggaagagaaagagcttttggctctggaactctccatcaagaaagagctgaagaaagccgatattcttaagctgttgttcgacaaccctaaggaactcgatctgaattttaacgcggttcaagggaatttaacacaggccaccctgttcaacgtgtacaaaaagataatcgagctatcaggacatgaaattgacgtagagaaagatagtgcaagcaagatcctcaaatccatcgaggaaatttttaaggctctgaattataacactgagatacttcacttcgactctgaaaagagccaggaccagcaagccatgtacatgttgtggcatctgctctactcatttgagggcgataatagtaacacaggtaacgaaaatctgatcaacaaaatttccaagttatatgggttcgagaaagagtacgctaagatcctggccaatgtgagcttccaggacgattatggctctctttcagcaaaagccattagtaagatcttgccatacctcaaggaaggacacaaaagcgacatagcttgtgatctggcgggctataagcactccgcatcttcgctaacccgtgaggaactggagaacaaaacgtacaaggaccggctcgagatcctgcccaaaaatacccttcgaaaccctgtcgtggaaaagattttgaatcagatgatcaacgttattaatctgatcatagatagcagagagttaaagaaatccgccaaggaaagggaggaactcacaaaatcaattagtgagactaccaagctgcatcaacagtataaagacatccttgctaaggccccatttaacctgacaaatacttctcgcaacgatattatccggtacaaattgtacgaggaactcaaggacaatgggtataagaccctgtacagcaacaaatatatatccccggcagccctattctcaggagattttgacatcgagcacattatcccccagagcagactgttcgatgactctttttccaataagacactcgaactgaggagtattaacatcgagaaaggtaacaagaccgcttacgacttcataaaaggcaagtatggggaaactggagaggataattgccttgacaagtacttgaaccgcattgagacgctgtataaaaatggcatcttaaagaaaagcaagtacaacaaactcaagatgcaggataaggacatccctgatggttttattgaacgagacatccgggatacacaatacattgccaaatatgcaaagaccctgcttggggacctggtgaaattcgtcgtgtctacttccggctcagtaaccgagcgtctaagagaagattggcagctcgttgacgtgatgaaggagctgaattgggaaaaatacatgcagttgggactgacagaggagtttaccaacgaagagggccataggatacgcaagatcaaggattggactaaacggaatgaccacagacaccatgcgatggatgctttaacagtcgccttcacgaagaggcagtttattcaatatctcaacaatctgaacgcacgacgcatcagtgacgaacaggggattagcaattcggagaaagacgagcggaacaatgtgtccatcaccactaacgatatgaaacttaatacaagagacgtcctgggaatagagaaaaaggaattgtacagggataaccgtggtaagctccgcttcaaagccccaatgcccctgctagaatttcgggaggaagctaagagacacctggagaacacccttatctctattaaagccaagaataaagtgacaactatcaacattaataccctcaagaaagcaggcggggtttataagaagacgcagctgacccctaggggacagttgcataacgagacaatctacggcagccaaaaacagtatatagtgaaggaagagactattaatgctaaattcgacgtagaaaagatcgccaccgtcacaaacccagtgtaccgagaggcgctgttaaaacggctcgaacagaataacaatgatcccaagaaggccttcactggttcaaacgctctgaccaaaaagccgatgtggtttgacgagcaacagacggagaaagttcctgaaaaggtgaaaacagtcagtttcgagaccatctacactattcgcaaggaaatatcccccgatcttaagatcgagaaagtggtagacgaaaaggtgagacagattctgaataacaggttgaatgagtataacgggaatgcaaaacaggccttttctaacctcgatgagaatccaatctggctgaacaaggaaaaaggcattacaatcaagcgggttaccataactggaatcaacaatgctcaagccctacacgagaagctggacaaagatggcaagcctattcttgacggggaaggcaaaaagcagcccgtcgacttcgtgaacaccggaaataaccatcacgtggcagtctactgtgatgcggacggtaatctccaggagaacgttatcagcttttatgaggccgtgacacgaagaaatctggggttgccaattatcgataaagactacaagaaagatgacggatggcagttcttattttccatgaagcaaaacgaatatttcgtgtttcccaatgagtcaacgggcttcaaccctaatgaagtagatctgctcaacccagacaattacagcctgataagtccgaacctttttcgcgtccagaagttcaccattaaagattatttctttaggcaccatctggagactaatgtggaatctaactccacattgaagggtatcacctggctacgttgcggcctgaacaatatcgacaacattatcaaagttcggataaatcacattgggcagatcattcatgtgggagagtactga

SEQ ID NO: 3313 - RNA, 4248 nt, synthetic construct
  misc_feature 1..4248: note = Cas9 variant
  source 1..4248: mol_type = other RNA
atggccaagttcaacaaaccctacagcatcggcctggacattggggtgtcctctgtcggatatgctgttataaccgaggattacagagtgcctgcatttaggttcaaggtactcggtaatacagaaaaagagaagatcaaaaagaaccttattggctcaactacgtttgtgccagcccagagtgcgcaagtcacccgggtgttccgcgttaatcgacgtagaatcgacaggcggaaccaccgcattgcttatctgagagatatctttcagaaggaaatagagaaagtggacaagaatttctacaggcggttggatgagagctttcgcgtcttaggggacaaatccgaggatctgcagatcaagcagccgttctttggagacaaagagctagaaacagcctatcataagaagtaccccactatttatcacctccgaaaacatctggcagatgccgacaagaactctcctgtggctgatatcagagaggtatacatggcactttcgcacattctgaaatacaggggccatttcttgaccctcgacaagatcaatccaaacaatataaacatgcaaaattcatggattaactttatcgaaagctgccaggaggttttcgatctggaggtgagtgaagagtccaaaacaattgccgctatctttaagtctagcgaaaatcggcaggagaaagtcaagcagatcctgtcctatttccaacaggaactcttaaagaaagacaagtcaattttcaaacagctgcttcagttgctgtttggtctaaagaccaaattcaaggactgttttgagctcgaggaagaacccgatctgaacttcagtaaggaaaattacgacgagaaccttgaaaacctgttggggactctcgaggaggattttagcgacgtgttcgccaaactgaagatattacgtgatacaatcctgctctctgacatgcttacctatacgggagcgactcacgcacgcttttccgccaccatggtggaaagatacgaggaacacaggaaagatctgcaacggttcaagtcatttgtcaaacagaatttgagcgagcaggactatctagatattttcggccgaaagacacctaacggctttgacgttgataaggaaactaaagggtacgtgggatatatcagtaataagatggtactgaccaacaaacaaaagacaatacagcagaatttctacgactacatttctggtaaaatcaccggcatcgagggggctgagtattttctcaacaagatttccgacggaacgttcctgcgcaagctcagaactacagataatggcgccatcccaaaccagattcatgcatacgaactggagaaaataatcgaaaggcaaggtcgggactatcccttcttgctcgagaataaggataaactgttaagcattctgacctttaagatcccttactatgtggggccactagctaaaggaaacaattcgcgcttcgcctggatcaagagagcgacttctcaggacattctcgatgacaacgatgaggacacaaggaatggcaaaatacgtccgtggaactaccacaagctgatcaatatggataagacccgggacgcctttattacgaaccttatcggcaacgatattatcttgctgaatgaaaaagtcctccccaagcgatccctgatatatgaggaagtgatgcttcagaacgagctgaccagagttaaatacaaggacaaatacgggaagacacatttctttgattcagaattgaggcaggagatcattaataacctcttcaagactaatagtaaacgcgtgagctccgcaatgctgttaaactatctggagaattacaccaacctacaagctgtcgaaatcgtgtctggaattgagaagggtaaaagcctcaattcaacactgaagacttataacgaccttaaaaccatctttagtgaagagttgctggactccgaaatataccagaaggagctcgaggaaattgtaaaggttatcacagtgttcgatgacaaaaagagcattaaaaattatctgaccaagtactttggccggttagagttcctgaacgaagagagaatcaatcagctttctaaattgaggtatactgggtggggacgctactcagccaagctcctgctagatatacgagacgaagatacgggctttaacctgatgcagttcctccggaatgacgatgagaaccgtaacctgagtcaacttatcagcgactccacattgtcttttgattcggctattaagagcatccagtccaaatcaaccgtcgaggacgatgtgttcgacgaaattaagaaactggccggtagtcctgcaatcaagagagggatattaaattctattaaaatcgtcgatgagctcgtgcagatcattggctacccaccccagaacatcgttattgaaatggccagggagaatatgactaccgaggaaggacaaaagaaagctaagacacgcaagaccaaactggagagcgcgcttaagaacatagaaaattccgtgctggagaacggcaaagtacctcactcagacgaacagttgcagagcgagaagctctatctgtactatctacaaaatgggaaagacatgtactctctggataagactggatccccaacacccctctatcgggacagactggatcagtacgaggtcgaccacatcattccgtatagtttccttcctatcgatagcattgacaacaaggtgttgacgcatagggaaaataaccagcgaaaactgaataacatccccgataaggagaccgttgcaaatatgaaaccattttgggaaaagttatacaacgccaaactcatatctcagactaagtaccaacgcctgacaacctccgagcggacacctgacggtgtgcttactgaatcaatgaaggctggcttcatcgagagacagctggtcgagaccaggcagattatcaaacacgtggcccgtattctagataatcgctttctcgacacgaagatcataaccctgaaaagtcagttgattacaaacttccggaacacttttcatatcgcaaagatcagagaactgaatgattatcaccatgcccacgacgcttacttagccgtagtgattgggcaaaccctcctgaaagcatatcccaaacttgcgccagagctgatatacggacaccatgctcacttcaacaggcatgaagagaataaggccacaatccgaaagcacttgtatagcaacattatgcggtttttcaataaccccaattcgaaggtttccaaagacatctggaactgcaatcgcgatctccctattatcaaggacataatctacaactctcaggtcaattttgtgaaaagaactatgattaagaagggcgcattctataaacagaacatcattccaaatgatagctcagtgaccgtcgacaagaggtttccgatcaaaaacaagaaatacctggatcccaagctatacggtgggtattacgaacggaatagtgccctgtccgttttcataattggccagtctttcaacaaaaataacaaacttaaggtggtgaaggagttttatgacatcaacatcattgattaccctctcttcaatacggacccaatgagctttttcaacgatgactccgagaatggatttctgacaaagaacaatttgcaatcagtacaggctttctataaaatccccaagtacagcctgatacagaaaaacgatggcacccgaatgttatttgaaagtactacaaatttccacaaggccacccaatttaagctcactgaggcacagaacgaactgttctttcatatgaaaagacttctgaccaagacagacttcatggatttgaaatctgaggagtccattaaggaaagccaggactttatcatgaatcacaaaaacgagttcgacaatattgtcaacgggcttttcggatatgctgaacgccagctgggttcgaagtcactatttacgcaagcccatgaggcgtacaagctgaggaaataccctgtgttctctcttaatgaagagaccatccgttattactatgataactttctccggctgttcagtttgactaagtccggcacaagctctgggtacgttgtgggattatttgaggccccaaaactgagaaatgtcgtgtatagggctaccaaggacgaaagcaacgcaacactcatacaccagtccattactggcctgtacgagacccgcatcgatctttcaaaactgggtgaagactga

SEQ ID NO: 3314 - RNA, 4248 nt, synthetic construct
  misc_feature 1..4248: note = Cas9 variant
  source 1..4248: mol_type = other RNA
atgaacctgagaaatgtggccaaggagggcatcaactacaatattgggctcgaccttggaaccggtagcgtcggctgggctgttacagatgaacagggggagctgttctcctttaaaggaaagactacgtggggctctaggatattccccaccgcagaaacagccgcggacactcggttgaaacgcggtcaacgacgtagatatgctaggcggcgctggagattagatctgctacagtcactctttgaggaagagatcaagaaagtggaccctgagttctttaccaggctgcggcagagtcaccttctgaaggaagataagacatacgccgcaattttgagctccaaaggggccacccgcccactcttcccggagggagaagctgaggtagagtattacaagaaatatcccactatctaccatctgcgaaaggcactgatggaatctaacaatcaggaggacattagactcatctatttagcctttcacaacatagtgaaagctaggggcaatttcctgcatcaagatacacctggccttaccgcctcgaacgcgaatatgggggacgcagtcgaaaagttgtgctcagccctggaggattggtgtagcagtcagaacatcgaatgcgctattcggaagaatcagaaatccatccaggacctaatggagggaaagacgattgagccatctgaaagcaacgccctcaaagagacttttgatgcatcccgttcaagtcgcaaggacaaagctagcgtgctggccggttggatcgcgatacaacccggcgaacagttcgagcctaagcaggccaaagatgcatctaaggaaattgctaatgccgtttttgggctttccgctaacatgaagaaagtgttcgtcgagctggaggaagaccagaagatctacttgaataacgacgagcaagtggaagccttttacaccgtatgtccagatgagggagttgcactcttcgaagccctgcagtcaatgtatagcgcttacgtgttaatgggcattctgaaaggtgcggacgggggaagtatctcttcctgcaaggtcgcagcctatgagcagtacaaagaggatctcaaacttctgaagacattggtgagagaatttgctcccaagaagtatgacgagtttttcaggggcgatatctttgacgccaaaaagggcttccggactcgaaactacgatcctgcaaccgccaaagggtatacaaagtacaatagcgtgcgcggagcttcgtacgacgcctttaagaaagaagtcgagaagctattcgagggtaccgcagcggaagaggatgttagatatacggacatgatgcaaaggtttgatgaaggcactttcctgcggcgcctcaaaacatctgacaacgggtccattccataccagctgcaccttgaggaaatggtggctataatcgagaatcagaagaccttttatccgttcctggaggaaaacaaagagaagtttgaatcattggtaactttccgtattccctactatgtgggacctctcacacagaagaatgccaggccagacaaccatggcaatgcacgttttgcctggagtcaacggaaagagggtcaggaaaacgctcgagtctacccctggaattgggaggaggtgatcgatagaaagcagagcgccgcaaaattcatggaaaggctgaccgggacgtgtacctatatattagaggaacctgttctgccacgctactccctactctacgaggaatattgcctgcttaacgagttgaatggcgctcggtggagagacatgggaggcgattggcacaggttcgactacgagacacgcatggatattatcgaagacctgtttaagaaaaagaaagggactgtgaagtatgccaccgtcgcggattggctcgtgcgagagaagcaccggtcttgtgccgaagtaaaaggaggtcagggcgagacagggttcgagagcaagctgtcaagttacgttttcttcaaaggagtgcttcatgtcgacgaaatcgatgaggctgacattcccatgatcgaggaactgatttggtggaacactttgtttgaagatcgttccatactcaaggagagcatcgaggacaaatatggcgatagactgaatgacgaacaaattaaggcaatctgcaagaaaaggttcaccggttgggggcgcttatctaagaaactgctatgtggcatcaaggcccagacagacaacggaccgtgctcaattatggatgtgctccgggagggcaatcctaacaacgacgctagaagtgccaccatggtctttatggaaataatcagggatgacaaattcgggtttactaagctgattgaggaagagaataagaaacgaatcagctccgtggatgacttcgatgttaacgaccttcccggatctccagcagtgcgccggacggtaaatcaggcgaagagaattgtcgatgagatcgtgggtatagccggctgtgctcctcagaacatctttattgaagttacaagggacgaggatgggcgtaataaaggacgccggaccaagagaaggtacgacgccatccaagaagcagtgaaagtcttgaagaaggagcagaaagaatatttcgatgctaacgtggccgacctgctcaagaatactgcacccgccgctctggacgatgagcgattagcgctgtactttatgcagaacggcaaatgcatgtactgcggtaaggaccttgatattaatcagttggacaaatatcaagtagatcacatcctcccacagtcgtacgtgaaggacgatagcttcgagaacaaagccctggttcattccgacgataatcagcggaagtcaaacagtatgctactggacgattctataattcgcaagatgaaaccctattgggaagcactcagaagcgctgggctgatcggcgagaagaaattcaagaatcttaccagggtccgggtgtccgacaaagaattgggaggctttattgcccgacaaatggtggagacatcacagagcatgaagctgacctctttactcctggagcaggcctaccctgaaactcaggtcagaccagttaaggctgggttctccagtgaccttcgcaggcgtctgaaattggtgaagtgtcgggagatcaacgattatcaccacgcacatgacgcctacctcgcgtgcgaagtgggacaatttatagctctgagacacaataaactatatgagaacccgatcggctacagccatgccgtaaaggatttcattgcaaaaagggccaagtacgcttctgaacacggtaagcccatggacacatatgggatgcctggatcctcaagttttgtcatcagctcgttcatgacgtccggctttgatgaggagaccggtgaaattttcaaagacgcatgggatgcctctctggcggctgtgcgcatccatcaggccctcaaccgaaaggactgttacataagcagaatgccagaggaaacttcaggcgcattttgggatgccacaatttatagtcccaaacagaccaagaaaaagctgtcccttcctttgaagaaagggctggacccacagaagtacggatcttatagccgggagcaattcgcttactttttcgtttatgaagccaaaaagatcaaaaagaaggaggagacaaaagaatacgtgttcgcatccgtccccgtgcaggttgctgccttagtggcggccgatccgaatgcactcatcgagtttgctaaggccgacgctgaagagaggggcctgaaattcgcaaagattgtacgcgaaaaagtctacaagtatcagcttatcgaggtgaacgatgagagatttttcgtgactgggctgagaaccgtccggaatggactacagattgccttttcagaacaagacaggaacatagttagcggcatcgtggagggtaatagttctaacaataacctcctggacatttacgataaaatcacgaatcgctatgccttgtacgcttcccgattcgggaagctgttaaacctcagcggatatagagaaaattttattcaggcgtcgctggaggaccaggagcgggtagtgcttgcactgatctcattgttcaacgccaggaccaatatgatagatctctctgctatcggcagttccaagacagtcggtaacatgagcatgacttttgccaaagaaatggcaatggccgacaatcgcttcgcttttattgatcaatctgtgaccggcatgctggagagaaagacatacctatga

SEQ ID NO: 3315 - RNA, 4251 nt, synthetic construct
  misc_feature 1..4251: note = Cas9 variant
  source 1..4251: mol_type = other RNA
atgggcagcagaatcattcccatgtcccaggacatactgggggagttcggaaagggtaactctgtgtcacaaaccagtgaaaggacagcctaccggagcactcgccgactccgtgagagatttcttctgaggcgggaacgcttgcacagagtcttaaatatcctggatttcctacctacgcattatgcttcccagattgactttaaaaagaggctcggcaaattcaaggagaacaaagaaccaaagatcgcatacgataataagtcttttctgttccttgactcgtttaacgagatgctgaaagatttcgagcaggaacagccgaatatgttgattaacgagaagggggaaaagaagctcatcccctatgactggaccctgtactatctgcggaaaaaggccctccgcgagaagatatcaaaagaggaattaagctggatcattctgaattttaaccaaaagcgaggatactatcagcttagaggcgaggatgaagaggaaaatcctagtaaattggttgagttccactccctgacagtggtagacgtggtcccagatgagcccatcaagggtaaactagaaacttggtactctattatcctcgacaacgggtgggtgtacaggcggagctccaagaccgagctgtatgattggaaagacaagataaaggaatttattgttacaaccgatcttaattacgacggaactgtgaaaacagacaaggagggcaacgtcaaacgttcattccgcgcgcctagtgaaaccgattggacgctgatcaagaaaaagactgagtatgagattgaacagagctctaagaccatcggcgagtacatctataatacattgctcaaatacccagaacagaagattagagggaaactgataaggactatcgagcggaagtattacaaagaagagttaaagcaaattctgctcaagcagaccgagtttcataacgaacttaaagacgattccctgtactatgactgcttgcgagagctataccgcaataacgaatcacaccagctgttcctcgagaagaaaaacttcgctcagctgtttatcgaggatataattttctatcaaagaccccttaggagccagaagagtctgatctctaattgtcctttggaattttacaaattcaaggactccgtgggaaacgagaaggtacagcatctcaaagccatcccaaagagcaatccgttttatcaagagttccggatttggcagtggatctcgaacctgtctatttactccaaattagatgactcaaattttacaagtcacttctttgatagcaccgacgattgggagtccctgttcgaaatgctaaacggtcgcaaggagatagagcagaaacagctcctgaagtttcttttggagaaaaagggcttcaaggggaaatctctgagctcagaaatcgaaaagtatagatggaattacgttgaggacaaaaagtacccctgcaacgaaacgaggagtctcattcaatcccgtctggacaaagtggcaaatcttcctgagagctttctgactcggcacgtcgagcaggaattgtggcatctcatctattctgtgacagataagatcgagttcgaaaaggccctggacaccttcagtaaaaagtacaaaattgatactccaacatttgtggacgctttcaagaaatgtcccccttttaagtcagagtatggcagcttctccgaaaaggcaatcaaaaagttactgccactaatgcgaaccggaaaatactgggatctcgacaacatagataaggccacgaaacagagaattgagaagatcatttctggtgagtatgacaaggatatcagggaccgcgtccgggaaaaagctataaatctgctttcggagaccgattttaacagattgcagctgtggctcgcccaatacatcgtttatgacaggcacagcgaagcgacatccctggataagtgggagactattgacgacatcgtgacctacttacattcattcaaacagcacagtctgcgcaatcccattgtagaacaggtgatcacagaaactatacgagtcgtgaaggatatttggtctaactacgggaatggaagcaaagactattttaacgagatccacgttgaacttggccgggagatgaagttgccggcagaggaacgtaaaaggattcaggagaagaactcccaaaatgaagataccaacctcagaatcaaggccctgctatcagagatgcagaatgaccctaacgtggaaaatgtccgcccctacagcccagtgcagcaggagatactgaaaatctatgaagagggcgtactcaactctaatattgagatcgctgatgacattctgaagatctccaaaacagcccaacctagtagctctgatcttaagcggtacaaattgtggctggaacagaagtatcagtccccctacaccggggagataattccattaaacaaactcttcactcccgaatatgagatcgaacatatcattcctcaatcaagatactttgacgatagttacaataacaaagttatctgcgagagcgcagtgaataagctgaaagacaactcgcttggatatgagttcattaagggttacaatggccagatagtcgaatgtgggtttggcaaaaaggtgaagatcttctccattgatgagtatgaagactttgtccagaaaaactacgctaataacaggtctaaggccagccgactgatgatggcggatatcccagagaaaatgattgagcgccagttgaacgacacgcggtatatctcaaagtacataagtaatatcctctccaacattgtgagatctgaaagcaatgacgatggagttaactccaaaaatctgatctcagtgaacggtaagattacaaccgtactaaagaaagactgggggatgaatgatatctggaacgacctgatactcccgaggttcattcgtatgaatcaaatcactgatagcgacagtttcaccacatggaacgagcgctttcagaagttcatccccaccgtccctattgaactgtctaaaaatttttccgccaagcggatagatcacagacatcacgcaatggacgctcttgtgatcgcctgcgctactagggatcatgttaacttgctgaataacttatatgccaaaagctcggcacgatacgacctcaatcggaagctgcgcattttcgagaagacaacgtacaaagatatcaagaccggccagattatcgaaagagagataccaaaagcctttcttaagccctggcagaacttcactacagacgctaaagacgcgatcgagtcaattatcgtgtcttataagcaaagtctgagggtcattaacaaatccaccaattactatcagaagtgggtggaaaaggatggaatcgtgaaaaaggagaaaataaagcaggaaggcaaaaactgggcaattcggaagcctctacacaaggacacagtaagcgggctcgttcagctgtcttgggtcaaagtgccaaagggaaaagtgatgactgccacccgaaagagcttggattcctcatttgacctgaaaacgatcgctaccatcacagatactggtattcaaaagatcttaataaagtacctcgagagtaaaggcaataaccccgaaagcgccttctctccggaggggattgaggactttaataacaatatccacctgtataacgatggaaagaaacatagacctattaccaaggtccgcctttacgaaatcggctccaaattcccactgggtgagaaggggaataagaacgcaaaatatgttgaagccgctaagggcacaaatttgtttttcgccgtgtacgcaaacaataaaggagagaggtcattcgaaactatacccctcaacctggtgattgaccgtctaaagctgggccttagtgcggtacctgagaccaatgagaaaggggataacctcctgtttcacttgagccccaatgacctggtctacgtgccatccgaagatgagatggaaaacttaaagctcatcaacctggagcatatctctaaagaccagcttaatcggatttataagatggtttcgagcacgtcaaacagatgtttctttatcaagtccgagattgctctgagtatagtgaataaaatcgaatactctcctttgaacaagatggagaaaagcattgaaggaatcatgatcaaggatgtctgcctcaaactacaggtgaataggattggtaacctggagcgctatttctcctga

SEQ ID NO: 3316 - RNA, 4257 nt, synthetic construct
  misc_feature 1..4257: note = Cas9 variant
  source 1..4257: mol_type = other RNA
atgaaggtgaaaaacatcctgggcctcgacattggggtcaccagcataggattcgcccacgttacagagaatgaaaaggataacaaatcccatatcaagcagcttggtgtgagaattaatcccctgactgtagacgagcaaacgaactttgaaaaaggcaggcctgcttctgtgaatgcagatcggaccttgaagcgcggggcccgaaagatgttatcacgttacaaagacagaaggaagaacctgatcgagattctaagtaaaacaggattcatcaatagcgaatccatactcgcggaggatggcaagaacactacccactctacatgggctctgcgggccaaagcatcgcgcgagagaatcgaaaaggacgagcttggtagggtcctgttggccattaataagaaacgggggtataagtcaagccgcaaagctaagaacgaagatgagggacaggcaatcgacggcatggccattgctaaacgactctacgaggaaaatctgaccccaggccagctggtgtatcagctcttaagagaggggaagaaatacatcccggatttttataggagtgacctgcaagatgaacttgacaaggtttggaacttccagaagcagtttcatcaggagatattgactgatacattctacaaagacattcaaggaaagggtcagcgggccacctccgcgtctttttatggcgtgtacgggttcaatacggcagaaaacaaaggaagccgtgaggagaagcgcctgcaggcctacgcttggagatccgacgccctaactaaacagctcaccagggaagaggtcgcatttgtgatcacagaaattaataacaacctgaataactcaagtggctatcttggtgctatcagcgatcggtctaaggagctgttctttaataagaaaactgtagggcaatacttgtatgaacagctccagcaaaacccccacacccgactgaagaatcaggttttctaccgccaggactatttagatgagtttgagacaatctggaccattcagtccagatactatcctgaactgacggacgatctcaaaagggagatacgggacgtggtcatcttctaccaacgcaaacttaaatcacagaagggactggtgagcttctgcgaattggagagtaaggaaattatgatcgagaaaaacggcaaggccgcggtgaaaaagataggctctaaagtcgccccaaagtccagccccctatttcaggagttcaagatttggcaggttctgcataatgtggatatcaaaaacaagaaagacaagactaaaagacctctcgatgactcggaaaaggagtacctgtttaatgaacttaacatcaaagggaatctgaaggcagctaaggtaattcaattgctcacactgaacaaaaatgagaccgagttaaactatactcagctggaaggaaataggacacagaaggccctatacgaggcttatctcaaaatcctggataccgaaggttacgacgtgaacaaccttttgggcattaagtctaataaagacgaggtcttcctggatgacctcgatgtgaacgccctggaaataaagacgatgatcaagcagatttttaatgcacttaacatcaataccgggatcctggacttcgatgccgagttggacggaaaagcatttgagcaacaggcgtcctatcacctctggcacctgttatactcatatgaagaggatggcagtaagagcggtaacgaacatctgtacaaactactcgagaataagttcgggtttaaaccagaacacgcacgtattctggccggcataacactttccgacgattacggaaacttgtctgctaaggccatgcggaagatctatccccagattaaagagaataacttcagcactgcatgtgagctggttggctaccgacattcaaagaatagtctcaccaaagaagagaaccaggaaagacctctgaagaataaattagagctgcttaagaagaactccttgaggcaaccagtggtcgaaaagatcctcaatcagatgattaacctggtgaacgagctaatcgacaagaatagcgagaaagatgaacaggggtctataatcgagtattttcgcttcgacgaaattcggatcgagctggccagagagctcaagaaaaacacagatgaaaggcgcgacctggacgctgccattcgagagggaaatcttcggaacgaaaagatctacaaattgctgcaagcacagtttggtataaagaatccgactcgtaacgatattatcagatataggttatacgaggaactcaagaataacggctataaagacctgtacaccaattcatacattccccaggagaaacttttcgggaaagagatcgatatagaccacatcattcctcagagtaagctgttcgatgacagcttttccaacaaaacattgacctataatactacgaacaaggataagggaaatcaaacaggcttcgactacatcgaatctaaatatggtattgatgggatcgaggcgtacaccgctcgcatagaaaacctctttgagtcgggcaagaaaaataaggaagagggagtaagcaaagccaagtatcagaagctgctaaagaaggagtccgaaattggcgacgggttcatcgagcgggatctgagagaatcacagtacatcgctaaaaaggccaaagagctcctgcttcagattactaggagtgttgtggctacctctggaagcatcacagcccgattgcgcgaagactgggatctggtcaacgtgatgaaggagttaaacctcccaaagtatcgggcactgggtcttaccgagatggaagagagaaaatacggccaaaaggtcgaagtgattaaagactggactaagagggacgatcaccgtcatcacgctatggacgccctgacaatagcgtttacgaaacataatcacatccagtacctaaaccatctcaatgcccgcaaggatgagcagcacaaggagcacaaaattatcaacgctattgaaaataaggagaccatcctgataactgacaaatccgggaaccggaagagagttttcaaagcacccatgcctaattttaggcagacagccaagcaatatttggaagaggtgctgatctcacataaagctaagaacaaggtagtcaccaaaaataagaacaaaattttaggaaaggagaaaatccaggaaacactcactccacgaggccagctgcacgatcaaaccatttacggtttcaattggtggagccggatcacgctttctaagaaggtgtcccgcaacgagatagagaaaattatcgacaataacaccaagtttttcctgcaggaatttatccagttgaaagggagtattgccaaggcattcagcgatgcggaactcaataaactgatgtataagggcaagatactaaaagagatcgaagttgccattccctgctacacacagagaatcgacatttctaaggtgtttactgattcccaaaaatcaaacagtgctaaggagaaaaatatcaagaacatactggaccttaaggtcaggaacatcctccagaatcggctgagcgagttcaaaggagatttcaagaaagccttttcggacttggacaagaacccgatttggttcaataaagaaaagggcatctccattaaacgagtgatcatatctggggtaaagaacgtggagcctctgcattataagaaagatcacttaggaaatgacattctcgatggcaaggaaaacagaatccccgttgactttatcagcaccggtaataaccaccatgtcgcaatttaccaggatgagaaagggaatctgcaggaaaaggtggtgtcacttttcgacgctgtcaaactggttaacgccgatgagccagtgatcgacaagacatataatcaaggattgggctggcagtttctcttcactatgaagcagaacgagatgtttgtgttccctaatgataacaccggttttgaccccaaagaaatagatctgctagacccaagtaataagaaactgatttcccccaaccttttccgcgtacagtctatcagcattgtccaatacggcaacaatatcgtgagggattttaagttccgtaaccacctcgagtccgttctgaatgacgacaaagtgttgcatgggataacgttccagcagattaagtcattaggacctctgctcaacatcgtcaaggtgcggatcaatcacctgggcgatattgttagcgtgggggaatactga

SEQ ID NO: 3317 - RNA, 4260 nt, synthetic construct
  misc_feature 1..4260: note = Cas9 variant
  source 1..4260: mol_type = other RNA
atggccaagccccagaactacaccatcggcctggacattgggacaaatagcgtgggatggactgtcacggatgaccaaaacaatatactcagaatcaaatccaagaaagctattggtgcaaggcttttcgaggaaggcaaggttgccgcggagcggcgctcttttcgaaccacacgtagaaggctgtcacggcgcaaatggagaatcaagttgttagaggagctgttcgatgaagagattagtaaggtggaccctaactttttcgctaggagccacgagtcctggatctctccaaaagataagcgggaacgctattcggccatagtatttccgactcccgaggaagacaaaaagttccataatgagtaccctaccatctatcacctacgagatagactcatgaaagacgatcagaagcatgacattagggagatctacgtggcaattcaccatatcatgaagtatcgggggaactttctgcacgatgaatcaatagagacataccgtagcggaatgagttcccttggcggtggggacgaacgcaccattctgaatactaaaatcttggatgacctcaacgacgccttcgctgataatctggcaacacagggaatttctgtcaacagcgcctccgctgaccagatcaatgagatcgtgacctcaggccacctgaacgttgatagtcaaaaggccattgcgaaactcttactgccaacgactcttagctctgacgataagaaacaggacaagaaaataaagaagttggcaaccgatgccgctaaaaatgtggcctccgcatggctgggctataaggctaactttgccgcgatcctaaatattcaggaagtcgacaaagataagaaaaagatctactcattcgccctccagggggcagacgaggaggataaggtggaaacactggagagcgtacttagtcaagaccagatagaaattgttgacagaatcatcaggattcggcatgctatcgtgctgggagagattatacccgtcggtatgactttgtctgaagccatgatcgagaaatacgatcagcacgctaaggacctcaaaaacctgaagaccgtgattcgaaacttaaaagatcgcaagaatgccgtgaagctgcaggcaatctatgacctctacgtcaacaatagacatgccgatacagctaaagcgatgaaacttgcaggcgttaagaagaggaccgagctgttggaacctgaggaatttaacaaatccatcgagaagctactggacgatagcccagtgtcggccgaaattaagaaacggatagctgagaaggacttcctccccctgcaacgctctaattccaacggggtaatccctaatcagcttcaccagattgagctggatgaaatcattaaaaagcaatcaaaatattacccatttttgggagagacgaacgaacacgccagtgcagacgtggccagaaaggctccgactaaactcgatcagctgttaacattcagggtcccctattacgtgggccctctgatcaccaaggaggagcaggaggaacaggacggtcatagcttcgcctggatgatacgtaagaatccaaaagatcacgaaaagatcactccctggaactttgacgagaaagttgaccggatggcatccgcgacacaattcattaagcgaatgaccacgaaagatacctatctactcggggaagacgtgctgccttctagctcacttaagtaccagttgtttacagtcctgaatgagctcaacaatctgagaatcaaccataagaaacttactagggaggaaaaggaacaggtgattgaagatctgttcaaaaagtacaaaaccgtaaaggctgacaagtttaaaaattattggcagaagggacacgccggcttggatgttaaaatccaaggcatggcagacccagagaagttcaacagtacaatgtccacttacatagatctccagaaaatttttggggaccagctggatgacgcccagcgccaaaacgatttcgaaaagatcattgagtatagcaccatctttgaggaccggaagatattaggagaaaaactgagagctgatttcgtgtggctatctgaggaccagatcaagaggctctgccgcctgcgacttcagggttggggccggttgtcactgaaactcctgacacgtttaaccgacgccgatgggcagaatgtcctggaaagacttttgaacagtaatgacaactttatgcaaattgtgaaggatcccgtcatcaaagcaaagattgagcagaaaaatcagaagctcctgagggctgactggagcgaaaacgccactgagtccatcctagatgaggcgtacacgtctccgcaaaataagaaagccatacgccaggtgatgcgggttgtgcatgacattgtaaaggcttgtgatggaaacctgcctgcaaaattcgccatcgaatttgctagatcgcaggacgatgaccccaagaggacagtcgcccgagcagatcgcctccagaaaatctatgcgcaaattagcgacgaggtggtttcccagggcgtgaaggaccagctgtcaggtatgaagagtcttaaagatcggtactatttgtacttcatgcaagggggcagagacgcctacaccggaaagccactgaatatcgataggttatctgactatgatattgaccacataatgcctcagagcttcatcaaagatgactccctcgataaccgtgtcctggtgactcgcgctgtaaataaccagaagtcagacaatgtgcccgttcttctgtacggcaaccacttggtcgccgatctcgggattaccatccgggaaatgtgggacagatggcagaaaagcggaatgatttctaagaggaagctggcaaatctactgacagatccagctaccctctccgagtatcgagccgagggttttatcaaccggcagctggtggaaacaagtcaagtgataaaacttactgcaacgatcttgcagagcgagttccccgactctaagattatcgaagtccctgccaaatacaactccattctgcgcaagcagtttgacttatataaatcaagagaggttaatgattaccatcacgctatcgacgcgtatctcagtaccatagtgggcaactacctgtaccaagtgtatccaaatcttaggcggctgttcgtatacggggaatttaagaagttcagccatggagaggaggaatcgtcccaccaggccgtccgaagagtgaaatctatgaactttctagatgacctcctgcgcggcaagcacggtgatgacatttattgcagggttactggggaggtgatcttcagccgtaaagatatcatttcaaagttgaaacaggcatacagttttaagcagatgctggtcacacaagaagtgttcaccaagaaatccgctttatttgaccagacagtttatccgtctcccgcccgggatagcaagactagatccggcctcatacctaggaaacagggaatggacaccgagatctacggcgggtattcaggaaataaggatgcctacttcgtgctggctcaggtagtcaaaagcaagggtcatacgcttcaagtggtgggcgtcccaattcgcgcactgcgagccttggcgaactgtagtaattactctgaacagctcctgaaaatcgttaaggctcaggtgctatttaacaagaaaaccgggaaggccaaaaagggaatttccgacgtaagaatcctgcttgataaaataccctatcggcagcctgtgctcgacggcagcgcattctacatgctgggttcgtcaacatataagtacaatttgaagcaaatctctctgagtcagcagtccatgaaatatattttagactacatcgatgacccaaacttcaataagcacgagatgactaaaattgatcagcaaaacgagaaggaatgcctcctgagcgtctatgacgagatccttgataaaatggacaagtacctgtctttgtacgatataaatgggtttaggaagaaactccatgtgggccgcgacaagttcattaaactggaagttgagaagcaggccgaagctatcaaaaacgtgctacgtggatttcacgcaaatagcgatatgaccaagctgtccgaccttggcctctcaacaagtctggggttcatgcaggccagcgatggaatcaagttgtctgacaacgcggtctttatttatcaatcccccactggcttattcgagagacgggtgaaagtttcagacctgctcaagtga

SEQ ID NO: 3318 - RNA, 4260 nt, synthetic construct
  misc_feature 1..4260: note = Cas9 variant
  source 1..4260: mol_type = other RNA
atgatgatcaagaacattctgggcctcgaccttgggaccaatagcataggatgggccctgatcaaacagaacttcgagaataagtacggtgaaattttgggcatggggtccagaatcattcccatgtctcaagatgtgttaggagagtttggcaaaggtaactcagtcagtcagacagctgcaaggactgggtatcggggagttcgccgactgcgtgaaagattcctactcaggcgggagcgcctgcacagagtgcttaatgtactgaactttttgcctgaacattacgccagccagatcgacttcgagaagaggtttggcaaattcaagtatgagacggaaccaaagctcgcgtacaataacgatggctttttctttaaaaattccttcgacgagatgctgggggattttaaggaccaccagttccatctgctcgaaaacggacggaaagtgccgtatgattggaccatatactatttacgcaagaaagctctgtctcaaaagatcgagaaggaggaacttgcctggattttgctgaattttaaccagaaacgaggttactaccagctaagaggcgaggacttcgaagaggaaaaggatagggtcttcgtgcggctcaaagttgaccgtgtggtcgattcgggggagaatatcaagggaaaaattctgtatgacgtgtactttgagaacggctggaagtatgaaaaacagatcgtaaagacagaggattggataggtcgcactaaggaatttattgttaccgagtcaatccttaaaaatggggacacaaagagaacctttaaagcagtggacagcgaaaaggattggattgccatcaaaactaagacagagcaagagatcgacaagagtcacaaaaccgtcggagcttacatttatgaagcactgttgcagaaccccaagcagaaaataaagggcaaactcgtgaggacgatcgagcggaagttctaccgagaggagctgaagaaaattttagaacgccagaaggagtttcatcctgagctgcaatccgatgacctctataacgattgcatcagagaactttacaggaataacgaggcccaccagataactctgtctaaaaaggacttcgtgcacttgctactgaatgatctcattttctaccagcggccactgcgcagccaaaaatcctcagtcagtaactgtacccttgagttcagaaagtataaggacgaaaatggcgttgagcatgctcagtacctgaaaacaatccccaagagcaacccttattaccaggaatttagggtgtggcagtggatgttcaatttgaacatctatcgtaaagatgacgatactaatgtaaccaaggagtttctctcttccacagaagactacgagaccctgttcgaatttttaaacaatcggaaagaggtggaccaaaaggccctgctacgacacttcaaactcaacgagaagacgcatagatggaattatgtcgaagataagaaatacccatgcaacgagactaagacaatgatttcaaccaggctggaaaaagtggagaattaccccagcgacttccttactcgcgaaatggagcagaacatctggcacattatatatagtgttaacgataagatcgagtacgaaaaagcgttgaagtcttttgcacacaagaataacctggacgaaaattccttctttgaagccttcaaaaagtttcctccattcaaaagcgagtatgggtcgttttctgaaaaggctattaaaaagctcctgccgcttctgcggttgggaaagtactggaactgggagtccatcgatagaaaatcacagggtaggatcgagaagattataacaggcgagttcgacgggaatatcaaagataaggtgcgcgaaaaagccattcatctcaccgcagaaaacgactttcagggactgcaattatggctggctcagtatatcgtctacggccgacacagtgaggccagcatgattggtaagtggaactccgcggatgacctagaggagttcctcaaggggtttaaacagcattctctgcggaatcccatcgtggaacaggtaataacggaaacccttcgtgttgtgaaggatatctggttgaaatatggcaatggagccaaggacttctttagcgagattcacatcgaactgggcagagagatgaaacaaacaaaggatgagagggtcgacgcaactaaacgcattaccgaaaacgagaatacaaacctccggatcaaggctctgttagccgaaatgatgaatgacaactcagtggagaatataagaccttacagtccaatgcagcaggaaattctgaagatctacgaggatgggattcttaaatccgacatcgagatagatgacgatatcttgaagattagcaaaactgctcagccctcttcaagtgacctcaagaggtataaactgtggctagaacaacgatacaagagcccttataccggacagatcattccactgaacaaactcttcacatccgagtacgaaatcgagcatataattccccagtctcgctatttcgatgactcgtttagcaacaaaatcatctgtgaatccgccgtcaataagctgaaagataactacattggtcttggcttcatcaagcaatttgggggaatgattgtggagtgcggcttcggtaaatcagttgagatatttaaggcagaagagtatgaagacttcgtgaagaaacactacgccaataaccggagtaagagaaataaattgctgttagaggagatcccggaaaagatgattgataggcagctcaacgacacccgtcacatctctaaatacattagcggggtactgtccaatatcgtccgccaggaggatggcactgacgaaggagtgaactcaaagaatatagttcctggcaacgggaagatcacgacacagcttaaacaagactggggactgaatgatgtgtggaacgagttgattctcccccggtttgaaagaatgaatcagctgaccaacagcactgacttcacctcttggaataagaaccatcagaaatttctaccaacagtccctatcgagttctccaagggttttagtaaaaagaggattgatcaccgacatcacgctatggacgcgctggtgatcgcatgtgccaccaaggatcacataaacctcctgaataaccagagcgctaaatctgacactaagcggtatgatcttaaacgcaagttgatgaaattcgagagagtagtgtactcccattcaaagacaggcgaaaagattgagaaggaagttcccaagcaattcctgaaaccatgggacaattttacggtcgatgccaagaacaaaatggagaccatcatcgtgagtttcaagcagaatttaagggtgattaacaaagcaactaatcactatgaaaagtggatagagaaggacgggatcaaacggaaggagctcattaaacaggaaggaacaaactgggccatccgaaagcccatgcataaagagaccgtcagcggcaaggttgatctgcctggtattaagatcccaaaagggaagatacttacagctactagaaaatcgctggacacctcctttgacctaaagacgatcaattctattaccgatacaggcatccagaaaattctcaagaactacctggagttcaagggaagctcagaattggcctttagtccggaaggcatcgaggacatgaataaaaacatagagaagttcaatgatgggaaaccccaccaatccattaacaaggtgcgcatctttgaactgggatctaaattcagcgtgggccagactggtaataagaaagacaagtatgtagaggcagcgaaggggaccaacttatttttcgctgtctacgaagataaaaatggaaagaggtcctatgagacaatccctctcaacgaggtgattgaacgtcagaaacaaggcctggactcagttagctttaagaacaaagaggatttccttctgtgcccaaatgacttggtgtacgtccccagtgaagatgagctcgaaaacatctacaatatagactttaagaacctgactaccgagaagacgggtaatatttataaagtggtttctttctccggcaaccagatcttctttattcggcaggatatcgccataagcattgtgaataaggcagagttctcgacactaaacaaaatggaaagagccatcgacgggtcaatgatcaaggagaattgtattaaactgaagatcgataggcttggaaacattgctaagatatga

SEQ ID NO: 3319 - RNA, 4263 nt, synthetic construct
  misc_feature 1..4263: note = Cas9 variant
  source 1..4263: mol_type = other RNA
atggccaagcccaaagactacaccatcggcctggatattgggacaaacagcgtgggatgggtcgttactgacgatcagaataacatactcagaatcaagggtaaaaaggctattggcgcaaggcttttcacggaggggaaagtggccgcggaacggcgctcctttcgaaccacacgtagaaggctgtctcggcgcagatggaggatcaagatgttggaggaattattcgacgaggaaattgctaaggtagatccttcatttttcgcccggctgcacgagagttggatcagcccaaaagacaagcgcaaacgatattccgcaatagtgtttccgtctcccgaggaagataagaaattccatgagtcgtaccctactatctatcacctaagagacaagctcatgaaggatgaccaaaaacatgatattagggaaatctacattgccgtccaccagatgatcaaggctcggggaaattttctgcatgacgagtcagtggagacctatcgtagcggcatgagttcccttggtgggcgctctgaaagaacaatactgagcgttcagaccttggaggaactcaacgatctgttcgcagagaatgaaggaactgaggaggtggaactgaacgtcgcctccgctgagcagattaatgacatcctcacaggcggccacttaaacgccgactcacaaaaagaaattagtaatctgcttttgccaagctcttttccctccttcgatgacaaggcgaaagagaaacaggtgaaaaagctgatcaacaatgtagcaaccaacatctcaaaggcctggctagggtacaaagctgattttagcacgattctcaatctggccaaggttgacaaagatcagaagaaaatattcgcatttgcccttcagggagaagacgaggaggataaggtgcaagaactggagagtttgctcgaacagtctcagactgacatcgtcgataggctgattgagatccggcacgctatagtgttatccgaaattgtgcctgtcggtatgaccctgagcgaggcgatgatcgacaagtatgatcagcataaagaggacctcatcacacttaaggccgttattcgaaacactaaagacaagaaaaaggcagctaagctgcaagccatctacgatttgtacgtgaaaaatcgccacgctgacctagccaaggcaatgaaactgaccggcattaagaaaagatcggaactcctggatccagaggaacttaagaaggggatatcttccctgttggacgattcacccgaggccgtagagatcaaacagaggctcgaagagaagacattcctgcctttacagcggagtaacaacaatggagtgattccaaaccaactgcatcaggtcgaactagacgagatcatcaaaaagcagagcaaatattacccgttcctcgctgaaaagaatcccgatgagtccgaggaagcgcagaaaaaggcacctaccaagctggacgcccttttgacgtttcgcgtgccatattacgttggccccatgattactaaagaggaacaagaggctcagaacggtcactctttcgcctggatggtgagaagggatcctcaggaccacgaagcaataacaccatggaattttgagaagaaagtcgataagatggccagcgctacccagttcatcaaacgtatgactacaaaggacacctatctgctcggggaggatgtgctgcccgcctcaagtcttaagtaccaactgtttacggtattgaacgaactcaataacctgcgggttaatggaaagaagttaacctccgacgagaaagaacaggtgattgagggcctgttcaagaaacagaagacagtcaaggcagacaaatttgtgaagtattggcaggcgaaacatatcggcgctgatattaaggtcaaagggctaagcgacccgtctaagttcaactcaactatgagtacctacatcgattttaagaaaatattcggagaccaactcaatgatgtgaaccgacagaatgactttgaaaagatcattgagtacagcacaatcttcgaggatagaaaaattctggaagacaaacttagggccgattttgcatggttgtccgaggaacagatcaagcagctgtgccgcctccggctgcaaggttggggcagattatctgacaagctgcttactaggttgaccgatgccgacgggcagaacgttctcgagcgcctgtggaactcgaatgataacttcgtgcagatagtaagcgaccctaatattaaagctaagatcgagcaagaaaaccagaagctactgcgagactcccagtcagataatgccgtcgagagtattctcgacgatgcatatacatctccccagaacaaaaaggctatccggcaagtgatgcgtgttgtgcacgacatagtcaaagcctgtgatggaaatgtgccagcgaagttcgccatcgaatttgctagaagccaggaggacgatcctaaaaggaccactgcacgcgtaaaccagatgcagaagatttacgaccaaatctccgatgaagtggtttcacagggcgtcaaggagcagctgagcggtatgaaatctcttaaggaccggtattacttgtatttcatgcaagggggcagagatgcctacacgggagctaaactgaatattgacaggttatccgactatgatgtggaccatatcatgccccagagttttgtgaaggatgacagcctcgataaccgagtcctggttgcccgcgcagtgaataaccagaaatctgacaaggtgccagcgcttctgttcggcaataaggtagtcgccgatttggggataacagtgcgggagatgtgggacaaatggcagaagctcggaatgatttccaaaagaaagctgtcaaacctactgaccgatcccgacgctctcactgaatacagggcccaaggttttatccgtcgccagctggttgagaccagtcaggtgatcaaacttacagcaaccattttgcagagcgagttccctgattcgaagatcattgaagtcccagctaagtacaattccatagtgcggaaacaatttgacctgtataagtctagagaagttaacgatttccaccatgccatcgacgcatacttaagcactattgtgggcaattatctctaccaggtatatccgaacctgaggcgaatgtttgtctacggggagttcaaaaagttttcaagtaacgccgaggaatccgctcacgacgtggcgcggcgcgtgaaatctatgaatttccttgatgacctgctaagaggaacacacggcgataacatctattgcaggagcacgggtgagattgtctttaatcggaacgacatcatatccaagctcaagcaggcctactcattcaaacagatgctggttacccaagaagtgttcactcgaaagagcgcattgtttgatcagacagtataccccagtcctgagagagactctaaaaagcgctccgggctgatcccaaggaaaaagggcatggatcccgaaatttatggaggctacgctcataatcaggacagctatttcgtgttagccaaaatcgagaaggtcaaggggtacaccctccagattgtgggagttcctatccgttcgctggagataattaacaaagccgaagatttttcaacagcacttctggacatcatcaagtctaaagtgatgtataatgagaagactggtcaaccaaaacggggcattaagaacgtcgaaatattggtgaataagctcccctacagacagccgatcctggagaaagatgttagttatatgctagggtccagcgcttacaagtacaacatgaaacagattaccctgtctaggcagagcatgaagtatatccttgactacattgatgaccctaatttcacgaaacacgagatgaccatgatcgacgaacaaaacgagcgcgaatgtctcctgtccgtgtatgatgagatattggaaaaggtcgacaagtacctgccattatttgatggaaataaattccgagagaagctccattcagccagaaaagagtttgtaagtctgagcgtggacgatgaagcgtctgctatcgagaagattcttcggggcctgcacgccaactccgaaatgccctcattggagaatctcaaaatcaagcctgcactgggtttctttcagatgaagaacgggattacactaagtaacgacgccgttctgctttatcagagccccactggcctcttcgaaaggcgcgtgaaagtctccgatctgttgaagtga

SEQ ID NO: 3320 - RNA, 4263 nt, synthetic construct
  misc_feature 1..4263: note = Cas9 variant
  source 1..4263: mol_type = other RNA
atggccaagcccaaagactacaccatcggcctggatattgggacaaacagcgtgggatgggtcgttactgacgatcagaataacatactcagaatcaagggtaaaaaggctattggcgcaaggcttttcacggaggggaaagtggccgcgaagcggcgctcctttcgaaccacacgtagaaggctgtctcggcgcagatggaggatcaagttgttagaagaactgttcgacgaagagattgctaaagtagatccttcatttttcgcccggctacacgaaagttggatcagcccaaaggacaaacgcaagcgatattccgcaatagtgtttccgtctcccgaggaggataaaaagttccatgaatcgtaccctactatctatcacctcagagacaagctgatgaaagatgaccaaaagcatgatattagggagatctacattgccgtccaccagatgatcaaagctcggggaaattttcttcatgacgaatcagtggagacctatcgtagcggcatgagttccctgggtgggcgctctgagagaacaatattgagcgttcagaccctcgaggagctgaacgatctgttcgcagaaaatgagggaactgaagaggtggagctcaacgtcgcctccgctgaacagattaatgacatcttaacaggcggccacctgaacgccgactcacaaaaggagattagtaatcttttgctgccaagctcttttccctccttcgatgacaaagcgaaggaaaaacaggtgaagaagctaatcaacaatgtagcaaccaacatctcaaaagcctggctcgggtacaaggctgattttagcacgattctgaatcttgccaaagttgacaaggatcagaaaaagatattcgcatttgctctgcagggagaggacgaagaggataaggtgcaagagttggaaagtctcctggagcagtctcagactgacatcgtcgataggttaattgaaatccggcacgccatagtgctgtccgagattgtgcctgtcggtatgaccctcagcgaagcgatgatcgacaaatatgatcagcataaggaggaccttatcacactgaaagccgttattcgaaacactaaggacaaaaagaaggcagctaaattgcaagccatctacgatctatacgtgaagaatcgccacgctgacctggccaaagcaatgaagctcaccggcattaaaaagagatcggagctgcttgatccagaggagctgaagaaagggatatcttccttgctcgacgattcacccgaagccgtagagatcaagcagaggattgaggaaaagacattcctgcctttacagcggagtaacaacaatggagtgatcccaaaccaactgcatcaggtcgagctagacgaaatcattaagaaacagagcaagtattacccgttcctcgctgagaaaaatcccgatgaatccgaggaggcgcagaagaaggcacctaccaaactggacgcccttttgacgtttcgcgtgccatattacgttggccccatgataactaaggaggaacaagaagctcagaacggtcactctttcgcctggatggtgagaagggatcctcaggaccacgaggcaatcacaccatggaattttgagaaaaaggtcgataaaatggccagcgctacccagttcattaagcgtatgactacaaaggacacctatctgctcggggaagatgtgctgcccgcctcaagtcttaaataccaactgtttacggtattgaacgagctcaataacctgcgggttaatggaaagaaattaacctccgacgaaaaggaacaggtgatcgaaggcctgttcaaaaagcagaagacagtcaaagcagacaagtttgtgaaatattggcaggcgaagcatattggcgctgatatcaaagtcaaggggctaagcgacccgtctaagttcaactcaactatgagtacctacatagattttaaaaagatcttcggagaccaactcaatgatgtgaaccgacagaatgactttgagaaaattatcgaatacagcacaattttcgaggatagaaagatcctggaggacaaacttagggttgattttgcctggttgtccgaggaacagataaagcagctgtgccgcctccggctgcaaggttggggcagattatctgacaaactgcttactaggttgaccgatgcagacgggcagaacgtgctcgaacgcctgtggaactcgaatgataacttcgtacagattgtcagcgaccctaatatcaaggccaagattgagcaagagaaccagaaactactgcgagactcccagtcagataatgctgtggaaagtatcctcgacgatgcctatacatctccccagaacaagaaagcaatacggcaagttatgcgtgtggtccacgacatcgtgaaggcttgtgatggaaatgtaccagccaaattcgcgattgagtttgccagaagccaggaagacgatcctaagaggaccactgctcgcgtgaaccagatgcagaagatctacgaccaaatttccgatgaggttgtctcacagggcgtgaaagaacagctgagcggtatgaagtctcttaaagaccggtattacttgtatttcatgcaagggggcagagatgcatacacgggagccaagctgaatatcgacaggttatccgactatgatgtggaccatataatgccccagagttttgtcaaagatgacagcctcgataaccgagttctggtggctcgcgccgtgaataaccagaagtctgacaaggtaccagcacttctgttcggcaataaagtcgtggcggatttggggattacagttcgggagatgtgggacaagtggcagaaactcggaatgatctccaagagaaaactgtcaaacctactgaccgatcccgacgccctcactgagtacagggctcaaggttttatccgtcgccagctggtggaaaccagtcaggtcattaaacttacagccaccatcttgcagagcgagttccctgattcgaagattatagaagtgccagcaaaatacaattccatcgttcggaagcaatttgacctgtataaatctagagaggtgaacgatttccaccatgctattgacgcctacttaagcactatcgtaggcaattatctctaccaggtctatccgaacctgaggcgaatgtttgtgtacggggagttcaagaaattttcaagtaacgcagaagagtccgcccacgacgtggctcggcgcgtcaagtctatgaatttccttgatgacctgctaagaggaacacacggcgataacatttattgcaggagcacgggtgaaatcgtttttaatcggaacgacataatctccaagctcaaacaggcgtactcattcaagcagatgctggtgacccaagaggtattcactaaaaagagcgccttgtttaatcagacagtgtaccccagtcctaaacgagatgggtctaagagatccggcctgattccacgcaaaaggggaatggaccccgaaatctatggcgggtacgcacataaccaggatagccacttcgtcttagctaagattgagaaggtgaaaggatataccctccagatcgttggtgtgcctatacgttcgctggaaattatcaataaggccgaggacttttcaacagcccttctggatatcattaaatctaaggtcatgtacaacgagaaaactggccaaccaaagcgggggataaagaatgtggaaatcttggttaacaaactcccctatagacagccgattctggagaaggacgtgagttacatgctaggatccagcgcttataaatacaatatcaagcagattaccctgtctaggcagagcatgaaatacatccttgattatatagacgatcctaacttcacgaagcatgaaatgaccatgatcgacgagcaaaatgagcgcgaatgtctcctgtccgtctacgacgagattttggaaaaggtagataaatatctgccattatttgacggcaacaagttccgagagaaactccactcagcaagaaaggaatttgtgagtctgagcgttgatgacgaggcctctgcgatcgagaaaattcttcggggtctgcacgctaattccgaaatgccctcattggagaacctcaagatcaagcctgccctggggttctttcagatgaaaaacggcataacactaagtaatgatgcagtgctgctttaccagagccccactggactcttcgaaaggcgcgtcaaggtgtccgacctgttgaaatga

SEQ ID NO: 3321 - RNA, 4263 nt, synthetic construct
  misc_feature 1..4263: note = Cas9 variant
  source 1..4263: mol_type = other RNA
atggccaagttcaacaaaaattacagcatcggcctggacattggggtgtcctctgtcggatatgctgttgtgaccgatgactacagagtacccgcatttaagttcaaagtgctcggtaacacagagaaggagaaaataaagaagaatcttatcggctcaactacgtttgtccctgcccagagtgcgcaagggaccagggtgttccgggttaaccgccgacgtattgatagaaggaatcaccggatcgcttatctgcgcgacatttttcagaaagagatcgaaaaggtggataaaaacttctacagaaggttggacgagagctttcgggtcttaggagataagtccgaggaactgcagataaaacagccattctttggcgacaaggagctagaaacagcctatcataagaaatacccgactatctatcacctccgcaagcatctggcagatgccgacaaaaattctcccgtggctgatattcgagaggtatacatggcaatctcgcacattcttaagtacagaggtcatttcctgaccttggacaggatcaaccctaataacataaatatgcaaaactcatggattgattttatcgaaagctgccaggaggttttcgacctcgagattagtgacgaatccaaaacaatcgtggccatctttaagtctagcgataatcggcaggagaaagtcaagaagattctgtcctatttccagcaagaactgctcaaaaaggacaaatcaatattcaagcagttactgcagcttttgtttgggctgaaaaccaagttcaaggattgttttgagctagaagaggagccagacctcaacttcagtaaagaaaattacgatgagaacctggaaaactttcttggaagcctggaggaagacttctctgatgtgtttgctaagttgaaagtgctccgtgacactatcctgttatccggcatgctgacatataccggcacgactcgcgccagattctcagcgaccatggtcgagaggtacgaggaacaccggaaggatctccagcgatttaagagcttcgttaagcaaaatcttagtgagcaggactatctggatatttttgggcgcaagacacccaacggattcgacgtggacaaagaaactaagggttacgtaggctatatctctaataaaatggtgttgaccaaccctcagaagcagaaaacaatacaacagaatttttacgattacatttccgggaagatcaccggaatcgagggcgcagaatatttcctaaacaagattagcgacggtacgttcctgagaaaactcaggactacagataatggggccgtcccaaaccagatccacgcttacgagctggagaagattatagaccggcaaggagaagattatccctttcttctggagaataaagacaagttgctctcgatcctgaccttcaaaattccttactatgtgggcccattatctaagggcaacaattcccgctttgggtggatcaaaagaactatctcacaggatattctggacgataacgacgaagatacaaggaatggaaagatacgtccgtggaactaccagaagctaatcaatatggacgagacccgggatgccttcattacgaacctcatcggtaacgacattatcctgcttaatgagaaagttttgcccaagcgaagtctgatatatgaagaggtgatgctccagaacgaactgaccagagtcaaatacaaggacaaatacggcaagacacactttttcgatagcgagcttaggcaagaaatcattaataacctgtttaagactaataacaaacgcgtgtcctctgcaatgttgctcgactatctggagaattacaccaacttacaggctgtagagatcgttagcgggattgaaaagggaaaatcactgaatagtacactaaagacttataacgatctcaaaaccatcttctccgaggaactgcttgacagcgagatataccagaaggaattggaggagattgtgaaggtcatcacagtgtttgatgacaaaaagtctattaaaaattatctgatcaagtacttcggccatctcgaatttctgaacgaggaacggataaatcagttatcaaaactgagatataccggttgggggaggtacagtgccaaacttttgctcgatatccgcgacgaggatactggcttcaacctgatgcaatttctacgaaatgacgatgaaaaccggaacctgagccagctcatttccgactctacgctgtcgttcgatagcgcgatcaagtccattcagtcaaaaagtacagtcgaggacgacgtgttcgatgagatcaagaaacttgccggatctcctgcaataaagcgtggcattttgaatagcatcaaaatcgttgacgaactggtgcagattatcgggtacccaccccaaaacattgtaatagagatggctagagaaaatatgaccactgaggagggacagaagaaagccaagaccaggaagacaaaattagaatccgctctcaagaacatcgaaaattcagtcctggaaaacggtaaagtgcctcatagcgatgagcagcttcaatctgaaaagctgtatttgtactatctccagaatggcaaagacatgtactccctggataagaccgggagtccaactcccctatatcgcgaccagctggatcagtacgaggttgaccacattatcccgtatagctttctccctattgattctatcgacaacaaggtgctgacacaccgggagaataaccaaagaaaacttaataacatacccgataaggaaacggtcgccaatatgaaaccattctgggagaagttgtacaacgcaaaactgatctcccagaccaagtaccagaggttaactacatcagaacgaacccctgacggagtgctcacagagagtatgaaggccggctttattgaacgccagctggtagagactcggcaaatcattaaacatgtggctagaatccttgacaataggttcctggataccaagataattgcgctaaaaagccagctcatcacgaactttcgtaacaccttccacatcgcaaagattcgcgagctgaatgactatcatcacgcccatgatgcttacttggccgttgtcgtgggtcagacactgttaaaagcatatcccaagctcgccccagaactgatatacgggcaccacgctcattttaaccggcacgaggaaaataaggccactatcagaaaacatctttattcgaacattatgaggttctttaataaccccgactccaaggtgtctaaagatatctgggactgcaatcgagatctgcctattatcaaggaggtcatatacaacagccaggttaatttcgtgaaacggaccatgatcaagaagggcgcattttataaccaaaatccagtgggaaaattcaacaagcagattgcggctaataaccgctacccgttgaaaacaaaggtatcaagtctcgacacttccatctacggcgggtatggacccatgaactctgccctgagcattatcataattgcagaaagattcaatgagaaaaagggtaaaatcgagaccgtcaaggaatttcacgatatcttcattatcgactacaagaaatttaataacaaccctttccagtttctaaatgatacgtccgagaacggcttcctgaagaaaaataacataaatagggtgcttgccttttatggggttccaaagtactcactcatgcagaaaaacgacggaacacggatgctgttcgaaagcaagagtaatttgcacaaggctacccaatttaaactgactaagacacagaacgagttattctttcatatgcgaagactcctgaccaaatctaatcttatggatctgaagtccgagagcgccattaaagaatcgcagaacttcatcttgaagcacaaggaggaatttgacaatatttcaaaccaactctctgcattcagtcagaaaatgctgggcgacactacctccctacgcaatctgatcaagggttataacgagaggaaaataaaggaaattgatagctctgaggaggtgatcaaatacttctatgacaattttatcaagatgttcagctttgtcaagtccggggctcccaaaggcattaacgatttctttaacaataagtacacagtggcccgtatgcggcctaaaccagacaagaaattccttaacgcgacgctcatccatcagtcaattaccggactgtacgaaactagaatagatttgagtaagttaggcgaggactga

SEQ ID NO: 3322 - RNA, 4263 nt, synthetic construct
  misc_feature 1..4263: note = Cas9 variant
  source 1..4263: mol_type = other RNA
atggccaagttcaacaaaaattacagcatcggcctggacattggggtgtcctctgtcggatatgctgttgtgaccgatgactacagagtacccgcatttaagttcaaagtgctcggtaacacagagaaggagaaaataaagaagaatcttatcggctcaactacgtttgtccctgcccagagtgcgcaagggaccagggtgttccgggttaaccgccgacgtattgatagaaggaatcaccggatcgcttatctgcgcgacatttttcagaaagagatcgaaaaggtggataaaaacttctacagaaggttggacgagagctttcgggtcttaggagataagtccgaggaactgcagataaaacagccattctttggcgacaaggagctagaaacagcctatcataagaaatacccgactatctatcacctccgcaagcatctggcagatgccgacaaaaattctcccgtggctgatattcgagaggtatacatggcaatctcgcacattcttaagtacagaggtcatttcctgaccttggacaggatcaaccctaataacataaatatgcaaaactcatggattgattttatcgaaagctgccaggaggttttcgacctcgagattagtgacgaatccaaaacaatcgtggccatctttaagtctagcgataatcggcaggagaaagtcaagaagattctgtcctatttccagcaagaactgctcaaaaaggacaaatcaatattcaagcagttactgcagcttttgtttgggctgaaaaccaagttcaaggattgttttgagctagaagaggagccagacctcaacttcagtaaagaaaattacgatgagaacctggaaaactttcttggaagcctggaggaagacttctctgatgtgtttgctaagttgaaagtgctccgtgacactatcctgttatccggcatgctgacatataccggcacgactcgcgccagattctcagcgaccatggtcgagaggtacgaggaacaccggaaggatctccagcgatttaagagcttcgttaaacaaaatcttagtgagcaggactatctggatatttttgggcgcaagacacccaacggattcgacgtggacaaagaaactaagggttacgtaggctatatctctaataaaatggtgttgaccaaccctcagaagcagaaaacaatacaacagaatttttacgattacatttccgggaagatcaccggaatcgagggcgcagaatatttcctaaacaagattagcgacggtacgttcctgagaaaactcaggactacagataatggggccgtcccaaaccagatccacgcttacgagctggagaagattatagaccggcaaggagaagattatccctttcttctggagaataaagacaagttgctctcgatcctgaccttcaaaattccttactatgtgggcccattatctaagggcaacaattcccgctttgggtggatcaaaagaactatctcacaggatattctggacgataacgacgaagatacaaggaatggaaagatacgtccgtggaactaccagaagctaatcaatatggacgagacccgggatgccttcattacgaacctcatcggtaacgacattatcctgcttaatgagaaagttttgcccaagcgaagtctgatatatgaagaggtgatgctccagaacgaactgaccagagtcaaatacaaggacaaatacggcaagacacactttttcgatagcgagcttaggcaagaaatcattaataacctgtttaagactaataacaaacgcgtgtcctctgcaatgttgctcgactatctggagaattacaccaacttacaggctgtagagatcgttagcgggattgaaaagggaaaatcactgaatagtacactaaagacttataacgatctcaaaaccatcttctccgaggaactgcttgacagcgagatataccagaaggaattggaggagattgtgaaggtcatcacagtgtttgatgacaaaaagtctattaaaaattatctgatcaagtacttcggccatctcgaatttctgaacgaggaacggataaatcagttatcaaaactgagatataccggttgggggaggtacagtgccaagttgttgctcgatatccgcgacgaggatactggcttcaacctgatgcaatttctacgaaatgacgatgaaaaccggaacctgagccagctcatttccgactctacgctgtcgttcgatagcgcgatcaagacaattcagtccaaatcaaccgtcgaggacgacgtgttcgatgagatcaagaaacttgccggaagtcctgcaataaagcgtggcattcttaattctatcaaaatcgttgacgaactggtgcagattatcgggtacccaccccaaaacattgtaatagagatggctagagaaaatatgactaccgaggagggacagaagaaagccaagacaaggaagaccaaattagaaagcgctctcaagaacatcgaaaattccgtcctggaaaacggtaaagtgcctcattcagatgagcagcttcaaagcgaaaagctgtatttgtactatctccagaatggcaaagacatgtactctctggataagactgggtccccaacacccctatatcgcgaccagctggatcagtacgaggttgaccacattatcccgtatagttttctccctattgatagcatcgacaacaaggtgctgacgcaccgggagaataaccaaagaaaacttaataacatacccgataaggaaaccgtcgccaatatgaaaccattctgggagaagttgtacaacgcaaaactgatctctcagactaagtaccagaggttaacaacctccgaacgaacacctgacggagtgctcactgagtcaatgaaggccggctttattgaacgccagctggtagagacccggcaaatcattaaacatgtggctagaatccttgacaataggttcctggatacgaagataattgcgctaaaaagtcagctcatcaccaactttcgtaacacattccacatcgcaaagattcgcgagctgaatgactatcatcacgcccatgatgcttacttggccgttgtcgtgggtcagactctgttaaaagcatatcccaagctcgccccagaactgatatacgggcaccacgctcattttaaccggcacgaggaaaataaggccaccatcagaaaacatctttatagcaacattatgaggttctttaataaccccgactcgaaggtgtccaaagatatctgggactgcaatcgagatctgcctattatcaaggaggtcatatacaactctcaggttaatttcgtgaaacggacaatgatcaagaagggcgcattttataaccaaaatccagtgggaaaattcaacaagcagattgcggctaataaccgctacccgttgaaaactaaggtaagctcactcgacaccagtatctacggcgggtatggacccatgaactccgccctgtctattatcataattgcagaaagattcaatgagaaaaagggtaaaatcgagacggtcaaggaatttcacgatatcttcattatcgactacaagaaatttaataacaaccctttccagtttctaaatgatacaagcgagaacggcttcctgaagaaaaataacataaatagggtgcttgccttttatggggttccaaagtactccctcatgcagaaaaacgacggaacccggatgctgttcgaatcaaagagcaatttgcacaaggctactcaatttaaactgacaaagacccagaacgagttattctttcatatgcgaagactcctgactaaaagtaatcttatggatctgaagtctgagtccgccattaaagaaagccagaacttcatcttgaagcacaaggaggaatttgacaatatttcgaaccaactctcagcattctctcagaaaatgctgggcgacaccacaagtctacgcaatctgatcaagggttataacgagaggaaaataaaggaaattgattccagcgaggaggtgatcaaatacttctatgacaattttatcaagatgttctcttttgtcaagagcggggctcccaaagatattaacgacttctttaacaataagtacacggtggcccgtatgcggcctaaaccagataagaaattccttaacgcgaccctcatccatcagtccattactggcctgtacgaaacaagaatagacttgtcaaagttaggagaggattga

SEQ ID NO: 3323 - RNA, 4263 nt, synthetic construct
  misc_feature 1..4263: note = Cas9 variant
  source 1..4263: mol_type = other RNA
atggccaagttcaacaaaaattacagcatcggcctggacattggggtgtcctctgtcggatatgctgttgtgaccgatgactacagagtacccgcatttaagttcaaagtgctcggtaacacagagaaggagaaaataaagaagaatcttatcggctcaactacgtttgtccctgcccagagtgcgcaagggaccagggtgttccgggttaaccgccgacgtattgatagaaggaatcaccggatcgcttatctgcgcgacatttttcagaaagagatcgaaaaggtggataaaaacttctacagaaggttggacgagagctttcgggtcttaggagataagtccgaggaactgcagataaaacagccattctttggcgacaaggagctagaaacagcctatcataagaaatacccgactatctatcacctccgcaagcatctggcagatgccgacaaaaattctcccgtggctgatattcgagaggtatacatggcaatctcgcacattcttaagtacagaggtcatttcctgaccttggacaggatcaaccctaataacataaatatgcaaaactcatggattgattttatcgaaagctgccaggaggttttcgacctcgagattagtgacgaatccaaaacaatcgtggccatctttaagtctagcgataatcggcaggagaaagtcaagaagattctgtcctatttccagcaagaactgctcaaaaaggacaaatcaatattcaagcagttactgcagcttttgtttgggctgaaaaccaagttcaaggattgttttgagctagaagaggagccagacctcaacttcagtaaagaaaattacgatgagaacctggaaaactttcttggaagcctggaggaagacttctctgatgtgtttgctaagttgaaagtgctccgtgacactatcctgttatccggcatgctgacatataccggcacgactcgcgccagattctcagcgaccatggtcgagaggtacgaggaacaccggaaggatctccagcgatttaagagcttcgttaagcaaaatcttagtgagcaggactatctggatatttttgggcgcaagacacccaacggattcgacgtggacaaagaaactaagggttacgtaggctatatctctaataaaatggtgttgaccaaccctcagaagcagaaaacaatacaacagaatttttacgattacatttccgggaagatcaccggaatcgagggcgcagaatatttcctaaacaagattagcgacggtacgttcctgagaaaactcaggactacagataatggggccgtcccaaaccagatccacgcttacgagctggagaagattatagaccggcaaggagaagattatccctttcttctggagaataaagacaagttgctctcgatcctgaccttcaaaattccttactatgtgggcccattatctaagggcaacaattcccgctttgggtggatcaaaagaactatctcacaggatattctggacgataacgacgaagatacaaggaatggaaagatacgtccgtggaactaccagaagctaatcaatatggacgagacccgggatgccttcattacgaacctcatcggtaacgacattatcctgcttaatgagaaagttttgcccaagcgaagtctgatatatgaagaggtgatgctccagaacgaactgaccagagtcaaatacaaggacaaatacggcaagacacactttttcgatagcgagcttaggcaagaaatcattaataacctgtttaagactaataacaaacgcgtgtcctctgcaatgttgctcgactatctggagaattacaccaacttacaggctgtagagatcgttagcgggattgaaaagggaaaatcactgaatagtacactaaagacttataacgatctcaaaaccatcttctccgaggaactgcttgacagcgagatataccagaaggaattggaggagattgtgaaggtcatcacagtgtttgatgacaaaaagtctattaaaaattatctgatcaagtacttcggccatctcgaatttctgaacgaggaacggataaatcagttatcaaaactgagatataccggttgggggaggtacagtgccaaacttttgctcgatatccgcgacgaggatactggcttcaacctgatgcaatttctacgaaatgacgatgaaaaccggaacctgagccagctcatttccgactctacgctgtcgttcgatagcgcgatcaagtccattcagtcaaaaagtacagtcgaggacgacgtgttcgatgagatcaagaaacttgccggatctcctgcaataaagcgtggcattttgaatagcatcaaaatcgttgacgaactggtgcagattatcgggtacccaccccaaaacattgtaatagagatggctagagaaaatatgaccactgaggagggacagaagaaagccaagaccaggaagacaaaattagaatccgctctcaagaacatcgaaaattcagtcctggaaaacggtaaagtgcctcatagcgatgagcagcttcaatctgaaaagctgtatttgtactatctccagaatggcaaagacatgtactccctggataagaccgggagtccaactcccctatatcgcgaccagctggatcagtacgaggttgaccacattatcccgtatagctttctccctattgattctatcgacaacaaggtgctgacacaccgggagaataaccaaagaaaacttaataacatacccgataaggaaacggtcgccaatatgaaaccattctgggagaagttgtacaacgcaaaactgatctcccagaccaagtaccagaggttaactacatcagaacgaacccctgacggagtgctcacagagagtatgaaggccggctttattgaacgccagctggtagagactcggcaaatcattaaacatgtggctagaatccttgacaataggttcctggataccaagataattgcgctaaaaagccagctcatcacgaactttcgtaacaccttccacatcgcaaagattcgcgagctgaatgactatcatcacgcccatgatgcttacttggccgttgtcgtgggtcagacactgttaaaagcatatcccaagctcgccccagaactgatatacgggcaccacgctcattttaaccggcacgaggaaaataaggccactatcagaaaacatctttattcgaacattatgaggttctttaataaccccgactccaaggtgtctaaagatatctgggactgcaatcgagatctgcctattatcaaggaggtcatatacaacagccaggttaatttcgtgaaacggaccatgatcaagaagggcgcattttataaccaaaatccagtgggaaaattcaacaagcagattgcggctaataaccgctacccgttgaaaacaaaggtatcaagtctcgacacttccatctacggcgggtatggacccatgaactctgccctgagcattatcataattgcagaaagattcaatgagaaaaagggtaaaatcgagaccgtcaaggaatttcacgatatcttcattatcgactacaagaaatttaataacaaccctttccagtttctaaatgatacgtccgagaacggcttcctgaagaaaaataacataaatagggtgcttgccttttatggggttccaaagtactcactcatgcagaaaaacgacggaacacggatgctgttcgaaagcaagagtaatttgcacaaggctacccaatttaaactgactaagacacagaacgagttattctttcatatgcgaagactcctgaccaaatctaatcttatggatctgaagtccgagagcgccattaaagaatcgcagaacttcatcttgaagcacaaggaggaatttgacaatatttcaaaccaactctctgcattcagtcagaaaatgctgggcgacactacctccctacgcaatctgatcaagggttataacgagaggaaaataaaggaaattgatagctctgaggaggtgatcaaatacttctatgacaattttatcaagatgttcagctttgtcaagtccggggctcccaaagatattaacgacttctttaacaataagtacacagtggcccgtatgcggcctaaaccagataagaaattccttaacgcgacgctcatccatcagtcaattaccggcctgtacgaaactagaatagacttgagtaagttaggagaggattga

SEQ ID NO: 3324 - RNA, 4263 nt, synthetic construct
  misc_feature 1..4263: note = Cas9 variant
  source 1..4263: mol_type = other RNA
atggccaagttcaacaaaaattacagcatcggcctggacattggggtgtcctctgtcggatatgctgttgtgaccgaggattacagagtacccgcatttaagttcaaagtgctcggtaacacagaaaaggagaaaataaagaagaatcttatcggctcaactacgtttgtccctgcccagagtgcgcaagggaccagggtgttccgggttaaccgccgacgtattgacagaaggaatcaccggatcgcttatctgcgcgatatttttcagaaagaaatcgagaagatagacaaaaacttctacagaaggttggatgaatcatttcgggtgttaggagacaagtccgaggatatccagattaaacagccattctttggcaataaggagctggaaacagcctatcataagaaatacccgactatctatcacctacgcaagcatctcgcagacgccgataaaaactctcccgtcgctgacattcgagaggtgtacatggtactgtcgcacatccttaagtacagaggtcatttcctgaccttggggaaaatagatcctaataacattaatatgcaaaactcatggatcgactttattgaaagctgccaggatgcattcgacctcgagatcagtgacgagtccaagacaatcgccgctatttttaaatctagcgaaaataggcaggagaaggttaagcagatactgtcctatttccaacaggaactgctcaaaaaggataaatcaatcttcaagcagttactgcagcttttgtttggactgaaaaccaagttcaaggactgttttgagctagaagaggagccagatctcaacttcagtaaagaaaattacgacgagaacctggaaaaccttctgggcgccttggaggaagattttagcgacgtgttcgcgaagctcaaaattctgcgggatactatcttactgtcttccatgctcacatataccggcgcaacgcacgcccgtttttcagctactatggtcgagcgctacgaggaacacagaaaggaccttcaaaggttcaagagctttgtgaagcagaatctgagtgagcaggattatttggacatattcgggcggaagacccccacaggatttgatgtggacaaagaaactaagggttacgtcggctatatttctaacaaaatggttctaaccaatcctcaaaagcagaaaacaatccagcagaacttctacgactacatctccgggaagattaccggaatcgagggcgccgaatgctttctgaataagattagcgatggtacgttcctccgaaaactgcgcactacagacaacggggcaataccaaatcaaatccatgcttatgagcttgagaagattatcgaaagacagggaagggattaccccttcctgttggagaacaaagacaagctcctgtcgatcttaacctttaaaattccttattacgtgggcccactggccaagggcaataactctcggttcgcgtggataaaacgcactacatcccaggatgtactagacgataatgacgaagataccagaaacgggaagatcaggccgtggaattatcacaagctcattaacatggacgagacgcgtgatgcctttatcattaatctgatcggaaacgacataatccttttgaacgagaaagtgctgcccaagcggtcactcatttacgaagaggtcatgctgcagaatgaacttacccgagtgaaatataaggataaatacggtaagatccatttctttaacagtgagctgagacaagaaattatcaataacttgttcaagacaaatagcaaaagggtttcctctgcaatgctcctgagctacttagagaactttactaatctgcaggctgtggagatagtctcaggcattgaaaaggggaaaagtctaaactccaccctcaagacatataatgacctgaaaactatcttcagcgaggaacttttggactctgagatttaccagaaggaactggaggagatcataaaggtgatcaccgtatttgatgacaaaaagtcaattaaaaactatctcacaaagtacttcggacacctggaatttttaaatgaggagaaaatcaaccagctgagtaaacttcgctataccggctggggtcggtacagcgggaagttgctcctgggcattagagatgaagacactggattcaatctaatgcaatttctgaggaacgatgacgaaaatcgcaacctcacgcagctgatctccgatacaaccctttctttcgactcggccataaaagctattcagagcaagtccactgttgaggatgacgtgttcgaggaaatcaaaaacttggccggcagccctgcaatcaagcgagggattctgaatagtatcaaaattgtcgatgagttagtgcagataatcggatatccaccccaaaacattatcattgaaatggcccgggagaatatgaccacagaggaaggtcagaagaaagctaagacccgtaagtctaaactcgagagcgcgctgaagaacatcgaagactccgtccttgagtcaggcaaagtgcctcacagcgatgaacagctgcaatctgagaagttgtacctctactatctgcagaatgggaaagacatgtactccctagacaagactggaagtccaacacccctgtatagagatcagctcgaccagtacgaggttgatcatataatcccgtatagctttctgcctattgactctatcgataacaaggtgcttacgcacagggaaaataaccaacgcaaattgaataacattcccgacaaggagaccgtagcaaatatgaaaccattctgggaaaagctgtacaacgccaaattaatctcccagactaagtatcagcggctcacaacctcagagagaacacctgatggcgtcctgactgaaagtatgaaggctggttttatagagaggcagcttgtggagacccgacaaattatcaaacatgttgcccgcatcctggacaatcggttcagcgatacgaagattataaccctaaaatcgcagctcgtgacaaactttagaaatactttccacatcgcaaagattagggaactgaacgactaccatcacgcccacgatgcttacttggccgtcgtggtagggcagaccctgttaaaagcatatcccaagctcgcgccagagctgatctacggccatcacgctcattttaaccgtcacgaagagaataaggccacacttcgcaaacacctgtattccaacattatgcggttctttaataaccccgactctaaggtgagcaaagacatctgggattgtaatagagacttgcctatagttaaggatgtcatctacaactcacagattaatttcgtgaaaaggactatgatcaagaagggagcattttataaccaaaatccagtgggcaaactcaacaagcagattgccgctaataaccgatacccgctgaaaaccaaggtcagttccctagacacgtctatctatgggggatacggtcccatgaatagcgccctgtccataattatcatcgcagaacggttcaacgagaaaaagggcaaaattgagacagttaaggaatttcatgatatctttataattgactacgagaagttcaataacaatccttttcagttccttaacaacgtgtcagaagaggggtttctcaaaaagaatgatctgaaccgcgtgttggctttctatagaatcagcaaatacagtctgatgcaaaagattgacggaaccaggatgttatttgagtctaaatccaatctccacaaggtaactcagttcaagctgacaaaaacccagaacgaacttttcttccatatgaagcggctgttgactaaaagcaatctcatggatctgaagtcggagtcagccatcaaagaatctcagaactttatacaaacccaccagaatgagttcgacaacattgcggatcgactaagtaattattcccagaagatgctgggcgaaacaaagagccttcagacgctcatcaacggttacaatgagagaccaatcaaacaaattgacaacaatgaggaaaccatccgctattactatgataactttattaagatgttctctttcgtcaaaagcggggcccccaaggacataatcaactttttcaatgacaaatacactgtgcctaggatgcgtccaaagcccgatcggaagatgctggacgctacattgattcatcagtccatcaccggcttatacgagacaagaatcgatctgtcaaaactcggagaagactga

SEQ ID NO: 3325 - RNA, 4263 nt, synthetic construct
  misc_feature 1..4263: note = Cas9 variant
  source 1..4263: mol_type = other RNA
atgagcagaaagaactacgtggacgattatgccatctccctggacattggcaatgcttctgtcgggtggtcagcattcacccccaactacaggctcgttcgggccaaaggacacgagcttataggtgtgcgcctgtttgatcctgcggacacagctgaaagtcgacgtatggccagaactacgaggcggcgctatagcagaaggcggtggcgcttgcgattactggatgcactattcgaccaggccctctccgagatcgatccatcttttctggctagaaggaagtactcgtgggtacatccggacgatgaaaataacgcagactgctggtatggctcagtgcttttcgatagcaatgagcaagacaaacggttttacgaaaagtatcccaccatttaccatctgcgtaaagccttgatggaggatgacagtcagcacgacatccgcgagatttacctcgctatccaccatatggtcaagtatagagggaacttcctggtggaaggaacactggagtcctctaatgcctttaaggaagatgagctcttaaaactgcttggcaggataactcggtacgagatgagcgaaggtgagcagaactccgacatcgaacaggatgacgagaataagttggttgcgcctgcaaacgggcaactggccgatgctctatgtgccacccgaggatcacgcagtatgagagtggacaatgcactcgaagctctgagcgccgtcaacgatctttctagggagcagcgggcgattgtgaaagccatcttcgcaggcctggagggcaataagttggacctcgctaaaatttttgtatccaaggagttctcaagcgagaacaagaaaatcctggggatatattttaataagagtgattacgaagagaaatgcgttcagattgtggactctggattactggatgacgaagaacgcgagttcctcgacagaatgcagggtcaatataacgccatcgctcttaagcagctgttgggcaggtccacaagcgtctcggattctaaatgtgcctcctacgacgcacaccgtgccaactggaatctaattaagctgcagctccggaccaaagaaaacgagaaggatatcaatgaaaactatgggatcctggtgggatggaagattgactcaggccagcgaaaaagtgtgagaggtgagagcgcttacgaaaatatgaggaagaaagcgaacgtctttttcaagaaaatgatagagacttccgatctttctgagacagacaagaatcgcctgatccacgatattgaagaggacaagttgttcccaatccaacgggatagcgacaacggggttataccccatcagctccaccagaatgaactgaaacaaattatcaagaaacagggaaagtactatccttttctcctggatgcattcgagaaagacggcaagcagatcaacaagattgagggcctactcacctttagagtgccatacttcgtagggcccctggtggtccctgaagatcttcagaaatcagacaatagtgagaaccattggatggtgaggaagaaaaagggagaaatcacgccatggaattttgacgagatggttgataaagacgcctccggtcgcaagttcattgaacgattggtgggcactgatagctatctgctcggggagccgaccctgcccaagaactctcttctgtaccaagagtatgaagtcttgaatgagctcaacaacgtgcggctgtcagtacgtacaggaaatcactggaacgacaaaagaaggatgcgcttaggccgggaagagaagactctgctatgccagagactctttatgaaaggtcagaccgttacaaagaggaccgctgaaaatctgcttcgaaaagagtacgggcgcacgtatgagttgagtggcctgagcgatgaatccaagttcacttcttcgctcagcacatacggaaaaatgtgtcggatatttggcgagaagtacgtgaacgaacacagagacctgatggagaagatcgtcgaattacagaccgtgttcgaggataaagagactctgcttcatcaattgaggcagctcgaagggatttccgaggccgactgcgcactgctagtcaatacacactataccggatggggtcgtctgtcacgcaagctcctgacgaccaaagccggcgaatgtaagatcagtgatgactttgctcctcggaaacattctatcattgagataatgagagccgaggataggaaccttatggaaatcattacagacaagcagttggggttcagcgattggatcgagcaggaaaatctgggagcagagaacggctcctcattaatggaagtggttgacgacctccgagtgagcccaaaggtaaaacggggtattatccaatctatacgcctgatcgatgacatttccaaggcggtcgggaaaagacccagtaggatctttcttgagctggctgatgacattcagcctagcggccggactatctctcgaaagtccagattgcaggatctctaccgcaatgccaacctgggaaaagagttcaagggcatagcagacgaactaaatgcctgctcagataaggacctgcaggatgacaggttattcctgtattacacccaacttgggaaagatatgtatacaggagaggaattggacctggaccgtttaagtagcgcttacgatattgaccacatcattccacaggccgtgactcagaacgattcgatcgacaatcgggttctcgtggcaagagctgagaacgccaggaagaccgattcctttacatatatgccccaaatagcggaccgcatgcgaaatttctggcagatcctgcttgataacggtctgatttctagagtcaaatttgaacggctaaccaggcagaacgagttcagcgagcgcgaaaaggagcgttttgtgcagagatcactcgtagaaactcggcaaatcatgaaaaatgtggccacgctgatgaggcagcgctacggcaacagtgctgcagttattgggttgaatgccgagctgacaaaggaaatgcatcgatacttaggattctcccacaagaacagagacatcaatgattatcaccatgctcaggacgccctctgtgtcggcatagcaggtcagtttgcggccaaccgggggttctttgctgatggcgaggtgtctgacggagcccaaaatagctacaaccagtatctgagggattaccttcgcggctatagagagaaactgtccgcagaagacaggaagcaggggcgggctttcggatttattgtgggctcaatgcgtagccaggacgagcaaaaacgcgtcaatccgcgaaccggtgaagttgtgtggagtgaggaggataaggactacttgagaaaagtgatgaactataggaagatgctcgtaactcagaaagtcggggatgacttcggagccctgtacgatgaaacccggtacgcagccacagaccctaagggcatcaagggtatcccctttgatggcgctaaacaggacacctctctatatgggggattctccagcgcgaagccagcctacgcagtgctgattgagtcgaaaggcaagactcgccttgttaatgtgacaatgcaagaatattcactcctgggggatagaccttctgacgatgagttgaggaaagtcctggctaagaagaaaagtgaatacgccaaggccaacatcttactccggcacgtgcccaaaatgcagctgattcgatatggaggcggtcttatggttataaagtccgctggggagctgaataacgcacagcagttgtggctcccatacgaggaatattgctacttcgacgatctgagccaaggaaaaggctctctagagaaggacgacctgaagaaacttctcgatagcatcctgggttccgtgcagtgtttgtacccctggcatagatttacggaagaggaattagccgacctgcacgtagcgttcgataagctccctgaggacgagaaaaagaatgtcattaccggcatcgtgtcagctctgcacgccgatgcaaaaactgccaaccttagtattgtggggatgacaggaagctggcgcaggatgaacaataagtctggctataccttttccgacgaagatgagttcatctttcagtcaccaagtgggctgttcgaaaagcgggtcacagttggagagttgaaacgtaaggctaaaaaggaagtgaacagcaaatacagaactaatgagaagaggctaccgaccctgtccggcgcatctcagccctga

SEQ ID NO: 3326 - RNA, 4263 nt, synthetic construct
  misc_feature 1..4263: note = Cas9 variant
  source 1..4263: mol_type = other RNA
atggccaagcccaaagactacaccatcggcctggatattgggacaaacagcgtgggatgggtcgttactgacgatcagaataacatactcagaatcaagggtaaaaaggctattggcgcaaggcttttcgccgaggggaaagtggcggctgaacggcgctcctttcgaacgacccgtagaaggatctctcggcgcagatggaggattaagctgttggaggaattattcgacgaggaaatcgccaaggtagatccttcatttttcgcacggctgcacgagagttggataagcccaaaagacaagcgcaaacgatattccgccatcgtgtttccgtctcccgaggaagataagaaattccatgagtcgtaccctacaatttatcacctaagagacaagctcatgaaggatgaccaaaaacatgatatcagggaaatttacatcgctgtccaccagatgataaaggtgcggggaaattttctgcatgacgagtcagttgagacttatcgtagcggcatgagttcccttggtgggcgctctgaaagaaccattctgagcgtgcagacattggaggaactcaacgatctgttcgcagagaatgaaggaaccgaggaggtcgaactgaacgtggcctccgctgagcagatcaatgacattctcactggcgaccacttaaacgccgattcacaaaaagaaatcagtaatctgcttttgccaagctcttttccctccttcgacgataaggcgaaagagaagcaggtaaagaagctgatcaacaatgttgcaacaaacatttcaaaggcctggctaggctacaaagctgactttagcaccatactcaatctggccaaggtggataaagaccagaagaaaatcttcgcatttgcccttcaagggggagatgaagaggacaaggtccaggagctggaaagtttgctcgagcagtctcagacggatattgtggacaggctgatcgaaatacggcacgctattgtgttatccgagatcgtccctgttggtatgactctgagcgaagcgatgatcgataagtatgaccagcataaagaggacctcattacccttaaggccgtgatccgaaacacaaaagataagaaaaaggcagctaagctgcaagccatttacgacttgtacgtaaataaccgccacgctgatctagccaaagcaatgaagctgactggcataaagaagagatcggagctcctggacccagaggaacttaaaaaggccatctcttccctgttggatgactcacccgaagctggggagattaagcagaggctcgagggaaaaaccttcctgcctttacagcggagtaacaataacggcgtgatcccaaatcaactgcatcaggtcgaactagatgagatcattaagaaacagagcaagtattacccgttcctcgcggaaaagaaccccgacgagtccgaagaggcacagaagaaagcccctacaaagctggatgctcttttgacctttcgcgtgccatattacgttggtcccatgataacgaaggaggaacaagaggcccaggacgggcactctttcgcatggatggtgagaagggatcctcaggaccacgaagccatcactccatggaattttgagaaaaaggtcgataaaatggctagcgccacacagttcattaagcgtatgaccactaaagacacatatctgctcggagaagacgtgctgcccgcatcaagtcttaagtaccaactgtttaccgtattgaacgagctcaataacctgcgggttaatggcaagaaattaacgtccgatgagaaggaacaggtgatcgagggcctgttcaaaaagcagaaaaccgtcaaggcggacaagtttgtgaaatattggcaggctattcatatcggggccgatataaaggtcaaaggactaagcgacccgtctaagttcaactcaacaatgagtacttacatcgattttaaaaagattttcggtgaccaactcaatgatgcaaaccgacagaatgactttgaaaagatcattgagtacagcaccatcttcgaagatagaaaaatactggaggacaaacttagggccgattttgcttggttgtccgaggaacagattaaacagctgtgccgcctccggctgcaaggctgggggagattatctgacaagctgcttacaaggttgactgatgccgacggacagaacgtgctcgagcgcctgtggaactcgaatgacaacttcgttcagatcgtgagcgatcctaatattaaagcaaagatcgaacaagagaaccagaaactactgcgagacggccagtccgatgacgctgtagagtcaatactcgatgacgcctataccagtccccagaataagaaggcgatccggcaagtcatgcgtgtggttcacgatattgtgaaagcctgtgacggtaacgtcccagctaagttcgcaatcgaatttgccagatctcaggaggatgaccctaaaaggacaaccgctcgcgtgaatcagatgcagaagatttacgatcaaatcagcgacgaagtagtgtcccagggggttaaagagcagctgtcaggcatgaaaagccttaaggaccggtattacttgtatttcatgcagggaggcagagatgcctacactggggcaaaactgaacatagacaggttatctgattatgacattgatcatatcatgccccaatcctttgtcaaggacgatagtctcgacaatcgagtgctggtggcgcgcgccgtcaacaatcagaaaagcgataaggttccagctttcctttttggaaacaaagtggtggccgacctgggtatcacggtacgggaaatgtgggataagtggcagaagttgggcatgatttctaaaagaaagctctccaatctgctaacagaccccgatgcactgaccgagtacagggctcaagggttcatccgtcgccagctcgtcgagacttcacaggtgattaaactgaccgccacaatacttcagagtgaatttcctgacagcaagatcattgaggttccagcaaaatacaactcgatcgtgcggaagcaattcgacttgtataagtccagagaagtcaatgattttcaccatgccattgacgcttacctgtctaccatcgtgggaaactatttataccaggtttatccgaatctcaggcgaatgttcgtgtacggcgagtttaaaaagttcagctcaaacgcggaagagagtgcccacgatatggcacggcgcgtaaaatccatgaactttctggacgatcttctgagaggtactcacggggacaatatatattgcaggtctacaggcgagatcgtcttcaaccggaatgatattatcagcaagctaaaacaggcttactccttcaagcagatgctcgtgacgcaagaagtgtttacccgaaagtcagccctgttcgaccagactgtctaccccagccctgagagagatagtaaaaagcgctctggattgattccaaggaaaaagggcatggacacagaaatctatgggggatactccggtaacaaagatgcctattttgttctggctgaggcagtgaaggaaaaaggccataccttacagatagtaggggtgcccattcgtgccctcaatacactgaagaacagcgcgaattactcggagaaacttctggagatcatcaaacctcaggtcatgttcaacaagaaaaatggaaagccaaagaagggcgtgaacgacgttcggattttgatggataatataccctatagacaaccggtgctcgaaggtggggctctgtacatgctaggctcatctacttataagtacagtctgaaacagatcaccctttcccaggagagcatgaagtacattctcgactatatcgacgatccttcttttaacaaacacattatggtcaatatcgaccatcaggatgaaaagaaatgtctgttgagcgtgtacgacgagatactggataagatggacaagtatttaccactcttcgatatcaacggatttaggaaaaagctgcacgacggccgcgagaaattcgttaaacttcccgtggaaaaacaagccgaggtcgtaaaggatattctgcgagggttgcacgcaaattccgaaatgacgaagccttcagacctcggactgaccacagccctaggctttatgcaggctcccgatggtatcaaaattagtgacgacgcagtgttcatctaccagagcccaactgggctgtttgagagacgggttaaggtgtctgatcttctcaaatga

SEQ ID NO: 3327 - RNA, 4266 nt, synthetic construct
  misc_feature 1..4266: note = Cas9 variant
  source 1..4266: mol_type = other RNA
atgaccaagttcaacaaaaattacagcatcggcctggacattggggtgtcctctgtcggatatgccgttgtgacagaggattacagagtacccgcttttaagttcaaagtgctcggtaacactgaaaaggagaaaataaagaagaatcttatcggctcaacgacctttgtcagtgcacagcctgccaaagggacaagggtgttccgggttaaccgccgacgtattgacagaaggaatcaccggatcacttatctgcgcgatatttttcaaaaggaaatcgagaaagtggacaagaacttctacagaaggttggatgaatcttttcgggtcttaggagacaaatccgaggatctgcagataaagcagccattctttggcgacaaggagctagaaaccgcgtatcataaaaagtacccgacaatctatcacctccgcaaacatctggctgatgccgacaagaatagccccgtggcagatattcgagaggtatacatggccatctcgcacattcttaaatacagaggtcatttcctgaccttggacaagatcaaccctaataacataaatatgcagaactcatggattgattttatcgaaagctgccaagaggttttcgacctcgagattagtgacgaatccaaaaatatcgctgatatctttaagtctagcgagaacaggcaggaaaaggtgaaaaagattctgccatatttccagcaggagctgctcaaaaaggacaaatccatattcaagcaattactgcagcttttgtttgggctgaagactaaattcaaggattgttttgaactagaggaggaacccgacctcaatttctcaaaagagaactacgatgaaaacctggagaattttcttggaagtctggaagaggacttcagcgatgtctttgcaaagttgaaagtgctccgggacacaatcctgttatctggcatgctgacctatacgggcgccactcacgctcgtttctccgccaccatggtggagcgctacgaagaacacagaaaggatctccagaggtttaagttctttattaaacagaacctttcagaacaagactatctggatatcttcgggcggaagacacagaatggatttgacgtcgacaaagagactaagggttacgttggctatataaccaacaaaatggtgttgacaaatcctcagaagcaaaagaccattcagcagaacttctacgattacatcagcgggaaaatcacgggaattgaaggcgcggagtatttcctaaataagatcagtgacggtacttttctgcgaaaactccgcacatctgataacggggcaattccaaatcagatacatgcctacgagctggaaaagatcattgagagacaaggaaaagactatcccttccttctggaaaacaaggataaattgctctccatcctgacctttaagatcccttactatgtaggcccattagctaagggcagcaattcgaggttcgcctggattaaacgggcaacttcttccgacatactggatgacaacgatgaggacacacgcaatgggaagatcagaccgtggaactaccagaaactaattaatatggatgagaccagggacgcttttatcacgaacctcattggaaacgatatcatactgcttaatgaaaaggtgttgcccaaacgttcactgatctatgaggaagtcatgctccagaacgagctgacccgggtgaagtacaaggacaaatacggtaaggcccacttctttgacagtgaacttcgacagaatattatcaacggcctgttcaaaaataacagcaagagagttaatgcgaaatccttgattaagtatctctctgataaccataaggacctgaatgccatcgagatagtgagcggggtcgagaaaggaaagtcatttaacagtacattaaaaacttacaatgatctgaagaccattttctccgaggagctactcgacagcgaaatctatcaaaaagagctggaagagattatcaaggtgataacagtatttgatgacaagaaatctatcaagaactaccttactaaattctttggccacttggagattctggatgaagagaagatcaatcagctctcaaaactgaggtatagtggttgggggcgctacagcgcaaagttactgcttgacattcgggatgaagacaccggcttcaacttgctccagttcctgagaaatgatgaggaaaacaggaacctaacaaaactgatctccgacaataccctctcttttgagcctaagataaaggatattcagtcgaaaagcactatcgaggacgacatcttcgatgaaattaagaaactggctggatccccagccatcaagcgcggcattcttaactcaataaaaatcgttgacgagttggtgcaaattatcgggtatccccctcacaatattgtcatcgaaatggctcgagagaacatgacgacagaggaaggacagaagaaggccaaaacccggaagactaaactggagagtgcattaaagaatatagaaaactctctcctggagaatggtaaagtgccacatagcgatgaacagcttcagtccgagaagctgtacttgtactatctccaaaacggcaaggacatgtacaccctggataaaacagggtcacccgccccgctatatctggaccagctcgatcagtacgaggtcgaccacatcattccttatagctttctgcccatcgattctattgacaataaggtgcttacccatcgtgaaaacaatcaacagaaattgaacaatatcccagataaggagactgttgctaacatgaaacctttctgggaaaagctgtacaatgcgaagttaatatcccagacaaaatatcagagactcacgaccagtgagaggactcccgacggagtgctgacagaaagcatgaaggcaggctttattgagcgccaacttgtagagacccggcagatcatcaaacacgtcgccaggattctggacaacagattctctgatacaaagataatcactctaaaatcccagctcattaccaactttcgaaatacgttccatatcgctaagattcgcgaactgaacgactaccaccacgcccatgatgcatacttggccgtggttgtgggtcagaccctgttaaaggtctatccaaaactcgctcccgagctgatctacgggcaccatgcccactttaatcggcacgaagagaacaaggcaacacttagaaaacatctgtattcaaatataatgaggttctttaacaatcctgacagtaaggtgagcaaagatatctgggactgcaaccgtgatttgccaattatcaaggacgtaatttacaattcgcaaatcaacttcgtgaaacgcactatgataaagaagggcgcgttctataatcagaacccggttggaaaatttaataagcagctcgctgccaacaatcggtaccccctgaaaaccaaggcactatgtctggatacatccatttatggcgggtacggacctatgaactctgcccttagcatcatcattatcgctgaaagattcaatgagaaaaagggtaagatagagactgtcaaagaatttcacgacattttcatcattgattacgagaagtttaacaacaatccattccagtttctcaacgacacctcagaaaatggcttcctgaaaaagaacaatatcaacagggtgttggggttttatcgaatacccaaatacagtctgatgcaaaagattgatggaacgcggatgttattcgagtccaagtctaatctccataaagccacacagtttaagctgaccaaaactcagaacgagcttttctttcacatgaagcgcctgttgacaaaaagcaatctcatggacctgaagtccaagtcagcaatcaaagaaagccaaaacttcatcctaaagcataaagaggagttcgacaatattagtaaccagctgtctgctttttcccagaagatgcttggcaataccactagcctcaaaaacctgatcaagggttataatgaaagaaaaattaaggaaatagatatcagggacgagaccattaagtacttctatgataactttatcaaaatgttctcgtttgtgaagtcaggggcccctaaagacatcaacgatttctttgacaataagtgcacagtcgcgcggatgcgaccaaaacccgataagaagttgttaaacgccacgctgattcaccagtctataaccggcctctacgagactagaatcgacctgagtaaacttggagaagattga

SEQ ID NO: 3328 - RNA, 4266 nt, synthetic construct
  misc_feature 1..4266: note = Cas9 variant
  source 1..4266: mol_type = other RNA
atgaagaaaatcctgggcctcgaccttgggcccaacagcattggatgggccctggtgaatgaggctgaaaacgagaatgaaaagtcctctataatcaaaattggttcaagagtcatccactacggcgataacttggttaaggtggacaaaagtgggaagattagcgcatccatgacccctgaggaagatttctcttcgggaaagggcttatcaccaaatgccggtaggacaaaacagcggagcgcgcgccgaaacctgcaacgttataagcagagaaggaataacctaatcgagatactcaaagctcatagtctgatcgacaataactttattttctccgaggaagggaatgagactacgtttaagacctacaaaaaccgggcccttgcagccacaaatgaaatctctctggaggatttcattaaggtattgtttatgatcaacaagaaacgcggatataagagctccagaaaagctaagggcgacgaggatggccagctcatagacgggatggcaattgccatccagctgtacgaacacaatcaaactccgggacagttcgtgtataacctgctcaaaaacggtaagaaaaatattcccgatttttacaggtcagacttacagaccgagttcgatcggatctggaactttcagaaggctttccatcaagaaagtctgagcgacggcatctgcgagaaacttgtcgggcagaaaaagaatgtgacatctgccattttgtttaaagaatttaagatagagtccctggagatcaaaggaaagtgggatgaaaagcgctttttccgatatgagctaagaaacaaagcggttcagcaggaactcaagctgaatgagattgcagaatgtcttgtggagatcaacggcgagatatcaaatagcagtggttacctgggggccatttctgacaggtccaaagaattggtcttccaaaagatcaccgtgggacagtacctctataaacagatcgctgccaaccctaatactagcctgaagaagcaaattttctaccggcaggactatttagatgagttcaacacactgtgggaaacccaggcaaaataccacaaggagctcacggacgaacttaaaactcagatccgtgatgtaattatattttatcaacgcagactgaagtcgcagaaaggcttgatctctttctgcgagtttgagtccaagcagattgaagttttcgtggacggcaagaaatcaatcaagaccagggggatgcgggtcatcccaaaaagtagccccctatttcaggagttcaagatttggcaaatactgaataacatcgaaattacagatctcaaaactaaggagtcccgagagctgaccgacgatgaacgccagcttctgtttgaggaattgaatatcagacctaaaatttctaagaaggaggctctcaaaatcctgacagaaaagccagcccagtacgacttaaactataaagatatagagggaaataagaccaacgcgaaattctacgaggcctacaacaagatcattcatctgagcggtcacgacgaaatcgattttacggacaagacttcagacattaatgagtatctaaaacagatcttcagtctcctgggcataaagcccgaaattcttgattttgactccagcttgaaagatgaggacttcgaaaagcaactgcacttccagctctggcatctgctttactcttttgagggggataacacaaaaaccggagacgagaagctgttgcagaagctcaatactaaattcggctttcctgtggaatatgcaaaggtgatctcaaacattgctctgccagatgactacggtagtttaagcgccaaagctatcaggaagatactgccgcacctaaaagatgggttctcctatggcggacggaagtctcgccccgacgagccttcggcctgtgaatacgcaggctatagacatagcaaggcctccctcacaaaagatgagaaggaaaataaaacctacaaggacaaactggagatccttccaaagaactcattgaggaatcccattgtcgagaaaatcctgaaccagacgattaatgttgtgaacgctgtaatcggggattacggaaagcctgacgaaatacgtctcgagctggcgcgggaattaaagaaaagtgcagaggagcgacaagacgccaccgattctattagcaaggctacagccaaacacgaaaagtatagaaaagtgctgcagactgagtttggtcttaagcacatctccaggaatgacttgatccgctacaagctctatctggaactgaaaaacaatggcttcaagaccctatactcagatacatatattgcaccatacgagatctttagcaaaaagttcgacattgaacatatactccccaaagccaagctgtttgatgactctttctccaacaagactcttgagttgaaaagtgtcaatctgaagaaaggggatatgaccgcttatgactttgtgaaggaggaatacggaacagagggcttagccaaatacgaacagcgggttcaagatctcttcctgaacaagaagagaaacgaggaccttgatcaggaaaatgagagcaggatcaccgacgagaaaatttctaagactaaacgcgataagctgttgatgccggaaaacaaaatccctacgggttttattgaccgagagctccgggactcccagtatatcgcaaagaaggcgaaaacaatgatggaagatatatgcaaggacgtggtcaccactaccgggtcagtgacagatcgtctgagagaggactggcagctaatcgatattatgcaagaactgaattggcccaaatacgctgccctcggcctgaccgaggagttcactaacgaagagggaaatgtaatcaggaagattaaagactggacaaagcgcaacgatcaccggcatcacgcaatggacgccatcacgatagctttcaccaaaagaagtcatattcagtatcttaataacttgagcgccaggtcggataagtcctctagcatctacggcatcgaacagaaggagctgtatcgagacaaaaataacaagttacgctttgcaccacctattcccataaatgagttccgggctgaagccaaaatgcagctcgagaacactctgatctcaattaaggcgcaaaataaagttgtgacaaagaacaagaataaaatcagtgggcagaagaaacttcaggaaaccctgacaccaagaggacagctacacctcgagactatttacggtaagatcaaccaatatcagaccgccgaaataaaagtcggcgggacgctggattccgagttgatcaacaaggtggctaataagaaaaccagggaggcactgttaaaccgtctcgccgaatttggaaatgaccccaagaaggctttcacagtcaagaacactattgacaaaaatcctatctacctggataagcaccagtcttacaagattccagagaaagtgaagatcgtttggcaagaaccggtgtataccatacgcaaaagcattacacccgaccttaagctggataaaatcatcgaccctaagattaaagccttgctcgagtcccggctgaaggaatgtaacggcgatgcaaagctagcgttttcaaatctggccgagaacccaatctggcttaataaagagaagggtatacagattaaaagagtaactatcaccgggattagcaacgctgccagtctccatgacaagaaagatctgaatggcaagcccatcttggacgaaaagggaaacaaaatatctgtcgatttcgtgaatacgggcaacaatcaccatgttgcaatttacaaggacgagaacgggaatctgcacgataacgtggtcacatttttcgaagctgtggagagggtaaaccagaatttacctgtggttgacaaactctttaagcagaaagaaggatggcaattcctgtttaccatgaagcagaacgagtatttcgtcttcccaaatgagatcactgcctttaaccccaatgagttcgatcttctgaacccggacaattactatttgatctcccctaacctctttcgagtgcagacaatgagcaaggtgatgtacggcaataacaccctgcgggactataaattccgccaccatctagaaactaccctgcaggatattaaggaacttagagacatcgtctttaaacaattcaagtcgctctcaatttttgataaaatagttaaggtgaggatcaatcacctgggtaagattgtgaaaacaggggagtactga

SEQ ID NO: 3329 - RNA, 4266 nt, synthetic construct
  misc_feature 1..4266: note = Cas9 variant
  source 1..4266: mol_type = other RNA
atgaaggacatcctgggcctcgatcttgggaccaacagcattggatgggccgtggtcaaagaggctcagaatgacaacgaacaatccgagatagttgatgtgggtgtaagagtgaatcccctgacaactgacgaaaagacgaacttcgagaaaggcaagcctatctctaccaatgcagataggacattgaaacggtcagcccgccgaaacttacagcgttacaagctgagaaggaaggaactaattgagctcctgaaagagcaccagcttatcagtactgacaccattctgacagaaaatgggaagggaaccacttttcagacattggagctccgggcgaaaagcgctaaggagaaaatctccctggaggagctggcccgcgtcttcctcaccataaacaagaagagaggctataaatcttcgaggaaggccaaaaatgaagatgagggtcaattaatcgacgggatggaaattgcaaagcggctgtacgaggaaaaccttacgactggacagttgtcactgcagctactcaaagagggcaagaaaagcctgccagattattaccgcagtgaccttcagtttgagctggataaggtgtggaatttccaaaagcagtttcattcccacatcttgaccgacgagttctatgctcagctcaaaggcaaggggcagcgagcaacatctgccctgtttttagctaaataccaaatttatactgccgaaaacaagggaagcagagaagataaaaagctgcaggcgtaccagtggagggttgacgcactctccaaggagcttacccgggaacaactggccttcgtgatcacagagataaataacaatttgaacaactcaagtggttacctaggcgctattagcgaccgttctaaagagctgtattttaataacgaaaccgtcggggagtacctctggaagcagatcgccgcaaatccgcatacgtccctgaaaaaccaggtgttctatcgccaggattaccttgacgaatttgagcaaatttggaagactcagtcagctttctatcccgaaatcctgacagagagcttgaaaaaggagctcagagatgtagttatcttttaccagaggaagctgaaaagtcagaagtctttagtgtccttctgcgagttcgaaaataaagaaattgagataaagaaagaggacggaaccagcactaagaaggtcatcggcctgaaagtggcccctaagtcgtctccactatttcaagagttcaaaatttggcagaacctcaataacgtgctgatccggaagaaaggttccaagaccaaaaaggcggccaagaatcagcaggcagtcctttttgaagaagagaaaacaatatcagaattggatctggaggctaagcaagccctcttcaacgagctgaatcttaaagggaacctgaaggctgactattgtttggaaattctcggatacagtcccaaagagtgggaaatgaattacagcgttctggagggcaaccgaacgaataaggccttatatgaagcatacctgaagatcaccgatctagagggctatgacgccaaaaaccacctcaaggtgaaactgaacaaggatgaggtagaacttgacgatttgaaagtgcctgcttccgagatcaaggacatggtccaggcgatttttaaggaagcagggatcaatacagacattctgcatttcaacgccgagctcgatggaaaagactttgaaaatcaggcttcttaccagctgtggcacttactgtatagctacgagggtgatgactcaaagagtggcaacgagcttttgtataaactcctggaaactaagttcgggtttaaaaaggagtacgcccaaatactagcaaatgtgtccctgagcgatgactacggatctctctcaaccaaggccatgcgcaaaatccacccatatattaaggaaaacaaattcagtacagcttgcgagctggccggctacagacatagcaagcactcccttactaaagaggaaaatgataacagggttttgcgggactctctggaggtgttaaagaaaaattcgctccgccagcccgtcgtggaaaagatcctgaaccagatgatcaatcttgtaaacgcactgttgaagaaatatagaaccgagaatcctaactttaagttcgatgaaattaggatagagctcgcgcgtgagctgaaaaagaatgctgaggaacgggccaacatgacagcaaacatcaataaagccaagaccgaacatgagaagattatcaaaattctaaagaacgaatttggtctgccaaatccgactcgaaacgacatcataagatacaggctctatgaggagctgaaagctaatgggtacaaggatctttatacgaacatcaaaattccccaagaaaagttgttcacaaaggagatcgacattgaacacatcatacctaaaagccgcgttttcgatgactccttttcaaataagaccctgagtttccggaaaactaacttagacaagggcgagagaaccgcctttgattacatggaatctaaattcggagcagacaagctcgaggagtacgtggctagggtcgaagatctgtataagaataacattatcagcaaagccaagtaccagaaacttctgaagaaagagtccgaaattggcgacgggtttgtggagcgcgatctacgagagacacagtatatcgcgaagaaggccaaagaaatactcctgcagatcaccccaaatgtcttgtcaactagcggaggtattacagaccggctgcgtgaggattgggacttaatcaacgtgatgaaggaactcaatctgcccaaatacagagctcttggcctgacggagatggaagataggaagtatgggcaacaggttgaggtgattatcgactggaccaaacgcaacgatcaccggcatcacgcaatggacgccttgactgtagctttcacaaagcataatcacatacagtacctcaactatctgaacgccaggaaaaatgagaagcataaggaacactctaacattatgggaatccagcaactagagaccatcaaagtcacagataagaatggcaacgagaaaagagtgtttaaggcacctatgccaaatttccgacaggttactaaagcgtttctggaaaacattcttatctcccacaaggccaagaataaagtggtcaccaagaacaaaaataaggtggctggtagtaacaaagtacaggaagtgctcacgccccgcgggcagctgcataaggagaccgtttacggcaagtaccaatattacgtccagaaagaggaaaagattggaggcaaattcgacttggagacaataaagaaagtggccaatccgctgtatcagagcttactcaagaagcggctggaagagaacgggggagaccctaaaaaggcatttactggtaaaaattctcttgctaagaaccccatctacctggatgacgcccaaaccgaacagttgccagagaaagtgaagctcgtctggctggaaaattccttctcaattagaaaagatatcacacctgaaaactttaaggacgagaagctaattgataaaatcctggacgaaggcgttaagaggatacttaaagagcgtctccagagtttcgggaatgatgcaaagaaagccttcagcgacctggagaagaaccccatctggttgaacaaggaaaaaggaattactatcaagcgcgtgaccatttcgggcgtggctaatgcggagccattacacacgaaaaaggatcatctgggtaaagaaatcctcgacaaggaggggaagcccatacctgtagattttatttccacaggctctaaccaccacgtcgccgtgtatcgggacgaaaaaggaaatctgcaggagaaggttgtgagcgtcttcgaggcagtggttagagctaaccaaggccttccaatcatcgacaaaacctacaatcagcatctggggtgggaatttttgttcactatgaagcagaacgagatgtttgtgttcccgaatgaatcaacaggatttaaccccaatgatattgacctactggatcctaaaaacaagaggataatcagtccaaatctcttccgagtacagaagctggccaccggcgactattggtttcggcaccatcttgagactaccgtcgaaacaaaatccgccacgaaggatatgacctacaaacgcttatctctgaaccacattaagaatatcattaaagtgagaatcagccatctcggtgacatagtgtccgtcggggagtactga

SEQ ID NO: 3330 - RNA, 4275 nt, synthetic construct
  misc_feature 1..4275: note = Cas9 variant
  source 1..4275: mol_type = other RNA
atgaagagaatcctgggcctcgaccttgggaccaacagcattggatgggccctggtgaatgaggctgaaacagatgaggaagtctcctctataatcaggttgggtgttcgggtgaaccccttaactgtagacgagacgcagaatttcgaaaaaggcaagtcaattaccacaaacgcagagcgcactctgaaacgaagtatgcgtagaaatctacaaaggtacaagctccggcgcgatgccctggtggagtttcttaaagaactggggttcatcaccgacgagacaattttgagcgaacagggaaacagaaccacttttgagacatgcaggctccgggcgaaggctgccgaggaagagatctccctggaggaactgtctcgcgtcctcttaatgataaataagaaacgaggctataagtcgtcaagaaaagtgaagaaagaagaggatggtgttctgatcgacgggatggagattgcaaagaagttatacgaagaggatttgacccctggacagctgtgtagccagctactcgaaagtggcaaaaaggtgctgccagacttctataggtccgatcttcaagaggaactggaccggatctggtctgtccagaaacagtttcacccggatgtgttctgcgacgccgctaaggaggagattaaaggcaagaaccgtagccagacgtgggcaatcttggccaattactttgtatggaaagaagaggttgtggggtggaacgatcgcgaagctaagaatgagactatagaaaaggagtgtaaactcgtcggactgaagagaaccacaaaaggttatgagttaaagaaagaaaactacaggtggcgggcccaagcgctgactgagcagctcggccttgaagagattgcagtggtgctgcaggagatcaatgggcagattaacgcctcctcaggatatttgggcgctatcagtgaccgaagcaaggtcctatacttcaatcatcaaaccgttggtcagtaccagatggccgaactggacaagaacccccacgcatctctccgcaacatggtgttttatagacaagattacctggacgagttcgataggatctgggaaaaacaggctgagtttcataaggaacttacagccgagctgaaaaaggagattcgggacatgataatcttctatcagcgcagattgaaatcccagaaggggctcatttcattttgcgaatttgagaggctggaaatcgtagtggagaaggatggaaagaagcaaaccaaagtcataggctgtaaggtgattcctcgtagccacccattattccaggaatttaaagtttggcagacgctgaatgacatcaaggtgctaggccgggagaagaaacgaaacgcgctcagtgcctctgagtccagagcactgtaccccgaagagaaggaaatccttgctagggagttggccattaaagaaaatatgaagaaagctgatgtcctgaagctcctgttcgagaaccctcaggagcttgacctgaattttaaacaaatcgatgggaaccgcactggattcagcttgttttcggcctattctaagatgattgaaaagtacggttatgagccactcgacttcaaaaagcccgcagatgaaataatcggccagctgcggacaatttttaccgacttagggtggaatactaacctgttcacaatcgacctaaccaaagagggaaaggagctcgaaatgcagccttactttagactgtggcatcttttgtactccttcgagggcgataatacgtcaaccggtaacgggaaactgatcgaaaagattatgcagctctgcggcgtggagaaggaatatgccgtagagctggctagtcttagctttcaagacgattacggatccctgtctgcgaaagcaataaagaggatccttccatatttgaaagagggcaatctctacgacgttgcctgtgaatatgctgggtaccgccacagcaagtcaagtctgacaaaagaggaaattgagaacaaggtgctaaagggaaaactggaagtcctcccgaaaaattccctgcgaaaccccgtggtcgagaaaatccttagccagatggtgaatgttattaacactatcatagatacctatggtaagcctgacgagatccgggtggaattggcccgtgagctgaaaaagtctgcaaaggaaagagaggaattaacaaaagccattgctaagtcaactagggagcacgaggaaatccgcaaactcctgcaggatgagttcggcatgatgaacgtaagtcggaatgacattatcagatacaaactttacgaggaactgaaggataacgggtataagaccttgtacagcaatcagtatataccaaaagagaagattttctccaaggaaatcgacattgagcatatcataccccaatctcgactcttcgatgactcgctgagcaacaaaacactagaatacaaggccatcaatattgagaaaggaaacaagaccgcatatgatttcgtcaaagaaaagtacggcgaggagggtctgcagcagtatatcaataggtgcgaatccctctttaacgacaagaaagcgaagctgcgcaaacttaagatggagcaaaaagacattcctgatgggttcatcgaccgggatttgagaaatactcagtacatagctaagaaggccctggcaatgttaaacgaaatttgtaggcgtgtggttgccacgacaggctcaatcaccgaccagctccgcgaggattggcagctggtggacgtcatgaaagaacttaatctgccaaagtacgaggctctaggatttgtggagacttatgaagataaagacggccggaagatcaaaagaattaaggattggaccaagaggaacgaccaccgacatcacgccatggatgcactcacagtagctttcaccaaagacgcctttatccaatacttcaataacaagaatgcggcccaggatagtgggaaccggaaccacactaatattataggaatcaaaacacgctattttgacaagggtagagctctgcccccgattcctttggagcagttcaggatcgaagcaaaacagcatctggagaagttactcgtgtctattaaggccaaaaacaaggttgtcacggtgaatgtgaaccggaccaaaaagcgaaaaggcgaaaatactaagatccaacagacacccagagggcagctgcaccttgagaccgtctacggaagccataaacagtatgttacaaagatagagaaggtgaacgcttcctttgacgccgcaaaaatcgcgactgtgtcaaagcgcgcctacaggaatgctctgttgaaacgtctcgaaaccttcggcaacgatccaaagaaagcctttacgggtaagaatgcactggagaagaaccctctatatgctgacaaataccaaaccattcgggtacccgaaaaggtccagacagtggagttcgagactatctacaccattagaaaaccagttgatcccgccctgaatgtggacaaggtcgtggatgttaaagtgagggcaatccttgaacgccgactcaaggagtatgggggcgaccctaagaaagcctttgtaaacttctgggaaaatccaatatggctgaacaaggagaaaggaattagcatcaagagagtctctatccggggcattaataacgctcagtccatacacgtgaaaaaggataagaacgggaatccgatctgggacgaaaacggaaaacaaattcccgtggatttcgtcaatacaggcaacaatcatcacgttgcgatctacaggaagcctgtgttggacaaaaagggtcaggtaacttttgatgaggacgggaacctgatgtatgagttagacgaagtggtcgtgccattctttgaggccgttacccgcgcaaatctcggactgcccattatcgataaagactaccgtaagagtgaaggctggcagttcctttttagcatgaaacagaacgagtatttcgtgtttcctaatgaaaagacgggtttcaacccaaaggaggtcgatctgttgaatcccgacaactacgctatgatatctccgaatctctttagagtgcaaacaatgtccaaagttatgtatggcaacaatgtggtccgggattacaagttcaggcaccatctggagaccactgtaaaagacatgaaggaactaaaagatatcgcctacaagcagtataagacactgtcatttgggaacagtgtggttaaaattcgcatcaatcacattggacagatcgtgagcgtcggcgagtactga

SEQ ID NO: 3331 - RNA, 4275 nt, synthetic construct
  misc_feature 1..4275: note = Cas9 variant
  source 1..4275: mol_type = other RNA
atgaagagaatcctgggcctcgaccttgggaccaacagcattggatgggccctggtgaatgaggctgaaacagatgaggaagtctcctctataatcaggttgggtgttcgggtgaaccccttaactgtagacgagacgcagaatttcgaaaaaggcaagtcaattaccacaaacgcagagcgcactctgaaacgaagtatgcgtagaaatctacaaaggtacaagctccggcgcgatgccctggtggagtttcttaaagaactggggttcatcaccgacgagacaattttgagcgaacagggaaacagaaccacttttgagacatgcaggctccgggcgaaggctgccgaggaagagatctccctggaggaactgtctcgcgtcctcttaatgataaataagaaacgaggctataagtcgtcaagaaaagtgaagaaagaagaggatggtgttctgatcgacgggatggagattgcaaagaagttatacgaagaggatttgacccctggacagctgtgtagccagctactcgaaagtggcaaaaaggtgctgccagacttctatcactccgatcttcaagaggaactggacaggatctggtctgtccagaaacagtttcatccggatgtgttctgcgacgccgctaaggaggagattaaaggcaagaaccggagccagacgtgggcaatcttggccaattactttgtatggaaagaagaggttgtggggtggaacgatcgtgaagctaagaatgagactatagaaaaggagtgtaaactcgtcggactgaagcgcaccacaaaaggttatgagttaaagaaagaaaactacagatggagggcccaagcgctgactgagcagctcggccttgaagagattgcagtggtgctgcaggagatcaatgggcagattaacgcctcctcaggatatttgggcgctatcagtgaccggagcaaggtcctatacttcaatcaccaaaccgttggtcagtaccagatggccgaactggacaagaacccccatgcatctctccgaaacatggtgttttatcgccaagattacctggacgagttcgatagaatctgggaaaaacaggctgagtttcacaaggaacttacagccgagctgaaaaaggagattagggacatgataatcttctatcagcggcgcttgaaatcccagaaggggctcatttcattttgcgaatttgagagactggaaatcgtagtggagaaggatggaaagaagcaaaccaaagtcataggctgtaaggtgattcctaggagccatccattattccaggaatttaaagtttggcagacgctgaatgacatcaaggtgctaggccgtgagaagaaacggaacgcgctcagtgcctctgagtcccgagcactgtaccccgaagagaaggaaatccttgctagagagttggccattaaagaaaatatgaagaaagctgatgtcctgaagctcctgttcgagaaccctcaggagcttgacctgaattttaaacaaatcgatgggaacaggactggattcagcttgttttcggcctattctaagatgattgaaaagtacggttatgagccactcgacttcaaaaagcccgcagatgaaataatcggccagctgcgcacaatttttaccgacttagggtggaatactaacctgttcacaatcgacctaaccaaagagggaaaggagctcgaaatgcagccttactttcggctgtggcaccttttgtactccttcgagggcgataatacgtcaaccggtaacgggaaactgatcgaaaagattatgcagctctgcggcgtggagaaggaatatgccgtagagctggctagtcttagctttcaagacgattacggatccctgtctgcgaaagcaataaagagaatccttccatatttgaaagagggcaatctctacgacgttgcctgtgaatatgctgggtacaggcacagcaagtcaagtctgacaaaagaggaaattgagaacaaggtgctaaagggaaaactggaagtcctcccgaaaaattccctgcgcaaccccgtggtcgagaaaatccttagccagatggtgaatgttattaacactatcatagatacctatggtaagcctgacgagatccgagtggaattggcccgggagctgaaaaagtctgcaaaggaacgtgaggaattaacaaaagccattgctaagtcaactagagagcatgaggaaatcaggaaactcctgcaggatgagttcggcatgatgaacgtaagtcgcaatgacattatccggtacaaactttacgaggaactgaaggataacgggtataagaccttgtacagcaatcagtatataccaaaagagaagattttctccaaggaaatcgacattgagcacatcataccccaatctagactcttcgatgactcgctgagcaacaaaacactagaatacaaggccatcaatattgagaaaggaaacaagaccgcatatgatttcgtcaaagaaaagtacggcgaggagggtctgcagcagtatatcaataggtgcgaatccctctttaacgacaagaaagcgaagctgcgaaaacttaagatggagcaaaaagacattcctgatgggttcatcgaccgcgatttgcggaatactcagtacatagctaagaaggccctggcaatgttaaacgaaatttgtagaagggtggttgccacgacaggctcaatcaccgaccagctccgtgaggattggcagctggtggacgtcatgaaagaacttaatctgccaaagtacgaggctctaggatttgtggagacttatgaagataaagacggccgcaagatcaaacggattaaggattggaccaagagaaacgaccataggcaccacgccatggatgcactcacagtagctttcaccaaagacgcctttatccaatacttcaataacaagaatgcggcccaggatagtgggaaccgaaaccatactaatattataggaatcaaaacacggtattttgacaagggtcgcgctctgcccccgattcctttggagcagttcagaatcgaagcaaaacagcacctggagaagttactcgtgtctattaaggccaaaaacaaggttgtcacggtgaatgtgaacaggaccaaaaagcggaaaggcgaaaatactaagatccaacagacaccccgagggcagctgcatcttgagaccgtctacggaagccacaaacagtatgttacaaagatagagaaggtgaacgcttcctttgacgccgcaaaaatcgcgactgtgtcaaagagagcctaccgcaatgctctgttgaaaaggctcgaaaccttcggcaacgatccaaagaaagcctttacgggtaagaatgcactggagaagaaccctctatatgctgacaaataccaaaccattcgtgtacccgaaaaggtccagacagtggagttcgagactatctacaccattcggaaaccagttgatcccgccctgaatgtggacaaggtcgtggatgttaaagtgagagcaatccttgaaaggcgcctcaaggagtatgggggcgaccctaagaaagcctttgtaaacttctgggaaaatccaatatggctgaacaaggagaaaggaattagcatcaagcgagtctctatcagaggcattaataacgctcagtccatacatgtgaaaaaggataagaacgggaatccgatctgggacgaaaacggaaaacaaattcccgtggatttcgtcaatacaggcaacaatcaccacgttgcgatctaccggaagcctgtgttggacaaaaagggtcaggtaacttttgatgaggacgggaacctgatgtatgagttagacgaagtggtcgtgccattctttgaggccgttaccagggcaaatctcggactgcccattatcgataaagactaccgcaagagtgaaggctggcagttcctttttagcatgaaacagaacgagtatttcgtgtttcctaatgaaaagacgggtttcaacccaaaggaggtcgatctgttgaatcccgacaactacgctatgatatctccgaatctctttcgtgtgcaaacaatgtccaaagttatgtatggcaacaatgtggtcagagattacaagttccggcatcacctggagaccactgtaaaagacatgaaggaactaaaagatatcgcctacaagcagtataagacactgtcatttgggaacagtgtggttaaaattaggatcaatcatattggacagatcgtgagcgtcggcgagtactga

SEQ ID NO: 3332 - RNA, 4278 nt, synthetic construct
  misc_feature 1..4278: note = Cas9 variant
  source 1..4278: mol_type = other RNA
atgagaaggaacatcctgggcctcgaccttgggaccacaagcattggattcgccaaggtgatagaggatgaagactaccaaaattccgctgtcgagctgatcggtgttcgggtgaaccccttgactacggatgaacagaccaattttgagaaaggccgccctgtatctgtgaacgcagaccgaacattaaagcgtgggatgagaaggaatctggatcggtatcagctacgcagacaccatctcattgaagtcctgaaagccaaccacatcattactgtggacaccaaacttgcggaggatggaaagaatacaacccatgctacttacgccgttagggcactggccgctacagcagagatcccattggaagccttcgctcgggtgctcctggccataaacaagaagcgcggctataaatcaagtcgaaaggcgaaaaatgaggacgaaggtcagctgatcgatgggatggcagtcgccaagagactctacgaggagaacttaaccccgggacagctgagctatcttttgctgaaagaaggcaagaagtacctacccgacttttataggtccgatctcaatgctgagctggacaaagtgtggtctttccaaaagcagttttaccctgaaattcttacggaggagttcaaaaagcacctggaaggcaaagggcagcgggccacttcggcagctttttggggacagtacggtttcaacaccgccgagaataagggctcacgtgaagagaaaaagttgaaggcgtatcaatggcgcagcgaagccgtagatcagcagctcacaaaagaggaagttgcatacgtgatcactgagattaacaatgacctgaacaagagttccgggtatttaggagctatctctgacagaagcaaagagctgtttttcaacaagcagaccgtcggccaatacctctatcagcagcttaaacaaaatccacatacaaggctgaagggtcaggtgttttaccggcaggattatttggacgagttcgaaaccatatgggaaacgcaggccaagtttcaccccgagctaactgctgccctgaaagaagagattcgagatgtgatcattttctaccaacgcaagctcaaatcccagaaggggctgatctcattctgcgagtttgaaagtaaagagatcgaagtcgagaagaacggacttaagattaaaaagagaataggcctgagggttgcacctaaaagctctccattgttccaggagtttaagatctggcaagtgctcaataacctggagttccggaataaatcctcaaaggaagtatttgtgcccgacatgacagccaagcagcagttattcgatgaactgaacattaaaggcaatctactcgctagcgaggcgatcaagatactggggtacaaaaccaaggactgggaagcaaactatcacactcttgagggaaatcgcacaaacaaaagtttgtacgatgcctatctgaagattctcgagctggaaggttacgacgaggatcttctgaaattgtctggctccgacgatatcgacgtcagcaagatcgaaaagtcggcttctgagattaaacagatggtgcatgccgtttttgaagtgctcgggatcaattccaccattctggacttcgatgcagaggccgacggaaaggcttttgagcagcaaacggcctatagattatggcatctgctatactcagcagaagatgacaacaaaaagtatctccaggaggatatattcatctacggccacgacaatattggtctgaaaaagaaactttgtgaaaggtttgggttccgtcctgagcacaccaaaatcttggtcaacgtggcgtttagtggcgattacggaagcctgtcctctaaggctatgcggaaaatctatccattcattaaggaactcacatacgacaaagcctgccgagaggcaggctatagacacagcgcctcaagtctgtccaaggaggaaatagctactaggccgttacagaagcgcctggggcttttgaaaaagaatgagctccggagccccgtagttgaaaagatcctgaaccagatggtgaacgtcgtgaatgccctaattgatgacgagaacaagagaaggaaagcacgcggactgtctgatgacttccattttgatgagatccgaattgaactcgctcgggagctgaagaagaatgccaaagaacgtgcggagatgaccacaaacatcaatgccgctaagcaacttcacgagaaaataatcaagattttgcagactcagttcggtgtctcaaaccctagtagaaatgacatcattaggtacaaactgtatgaagagttaaagaacaatggctacaaagacctctataccaacacatacatcagcccagatatactgttttccaagcaaattgacatcgatcatattatcccccagatgtctcttttcgacgattcgtttagcaataagaccgtggttttccgcaaagacaaccaggataaggggaataaaactgcatacgactatatactgggaaagtacggcgaattggccctcgaggaatatatctcccggattacgtcactgtttgagctaggtaaaaagaacaaggaagaggggatcaataaagctaagttccagaaactgcaaaagagactcattgatatcggcgacggatttatagagaaagatctgagggaaagtcagtacattgccaagaaggcgaaaaacatgctttatgcaatctgtcgatctgtggtagccacaagcggcgagatcaccgctcgcttgcgggaagactgggatctggtcaacgtgatgcaggagattaatttacctaagttcagagccctcgggctgactgaaatggttgagaaaaaggacggaggtcagaaagagaggatcattgactggaccaagcgtaacgatcaccgccatcacgcaatggacgctcttacaatagcctttacccggcactcccatatccaatacctgaatcacctaaacgcaagaaaggatgaagcctcaaaatggcatccagtggtcagcaagattgaggaaaaagagactgacctcgtgtatgatgacctgggcaataggaagcgacggttcaaagctcccatgccgaactttcgcgaggtagtgaaggaacacttggagaatgttctgatctctcacaaggcgaaaaacaaggtcgtgacgaaaaataagaacaaaattaagacagccaaaggggaaaagatcaagaccgagttaactcctagaggacagctccataaagaaacaatatacggcaggtaccggtattacgagtccaaggaggaaaaagtgggtcccaagttcgatgcagagaccatcgggatggtcgttaatccacagtatcgaaaactgcttctggaaagattgacaactaacggcaatgaccctaagaaggctttcggaggcaaaaacaccctcagtaagaatcccctgtacattgatgaggccaaacaggaactactgccagagaagatccttctccgctggctgaacgacgattatagcattaggaaagacgtgacgcccgagaacttgaaggacgtgaagaccatcgaaaaagtactggatgaggggataaagaaaattttactcaagcgtctggtcgactttggaaatgatcctaaaaaggccttctctgaccttgataagaacccaatctggctgaatgaagctaaaggcatcacaattaagcgggtgactatatccggtgttaaaaacgcagaggccttgcactacaagaaagaccattttgggaatgcgatcctcaacgaaaatggaaagctgattccgtcaagtttcgtgagcaccggcaacaatcaccatgtcgctatctatagagatgccgagggtaacctacaagagagggtggtttcgctgtttgacgcagtgcagcttgtaaatgccggcgaagctgtcattgatcgcgagtacaacaaagggatcggatggcagttcctctttacaatgaagcaaaatgaaatgttcgtgtttcccaacgagaagactggcttcgaccctaaagagatagatctgttgaataccgacaaccgaaagttaatctccccaaatctgtttagagtgcagaaaattgcatctaagaactacttcttccggcaccacctcgaaacgaacgtcgaggaaaggaaagagctgaaggatatcgtttataagccccagcttgggctgaatgccattaaagacgtggtaaaggtgcgcatcaaccatttgggaaaaataattagcgtcggcgaatactga

SEQ ID NO: 3333 - RNA, 4281 nt, synthetic construct
  misc_feature 1..4281: note = Cas9 variant
  source 1..4281: mol_type = other RNA
atgcccagaaagaacatcctgggcctcgaccttgggaccacaagcattggattcgccaaaataatcgaggatgacgattaccagtgctcctctgtggaactgattggtgtcagggttaatcctttgactacggacgagcaaaccaactttgaaaagggcaaaccagtgtcagtaaatgctgatcggacattaaagcgcgggatgcgacgtaacctggacagatatcagctaaggcgggattacctcatcgagattctgcgcactcaccatatcataaccgcagacacaaaacttgccgaagatggaaagaataccactcacacaacctatgcgctgagagctttggccgcaacggccgagatcccgctcgaggctttcgtgagggtcctgctggcaattaacaagaaacggggctacaagagtagccgcaaagccaagaatgaagacgagggtcagctcatcgatgggatggctattgcccgaagattatatgaagagtccctgactcccggacagttttcttaccaacttttgaaagagggcaagaagtatctgcctgacttctacaggtcggatctaaacaccgaactcaataaagtgtggaactttcagaagcagttctacccagagatcctgacagacgaatttaaacggcatcttgagggcaaggggcagcgtgcgactgcagttgccttctggggacaacacggtttttcaatggctgaaaataaaggcagccgcgaggagaagaaactgcatgcctataagtggagaagtgaagcagctcacaagcagttgaccaaagaggaagtggccttcgtcataacagagattaacaatgacctcaacaagtcctctgggtacctgggagcgatcagcgataggtccaaagaattatttttcaataagcagaccgtgggccagtatctgcaccaacagctcaaagagaacccccatacgcggcttaagggtcaggtattttaccgacaagactatctggatgagttcgaaactatttgggagatgcaggccaagttctactcagcattgacactagaactgaaagaggaagttcgcgacgtggtcatcttttatcagagaaagctcaaaagtcagatggggctgatcagcctttgtgagttcgagtctaaggaaattgagatagagaaaaacggagaaaaggctaagaaaaggatcggcctgcgggtggcccctaagtcctcaccattgtttcaagagttcaaaatttggcaagtgctcaataacctggaatttcgcaataagaaaaccaaggaggtcttcgttcccgaaatggctgccaagcagcagttatttgatgagctgaacatcaaaggcaatctactcgcaagcgaagccataaagattctggggtacaaaactaaggactgggaggctaactaccacacacttgagggaaatagaaccaacaaaagtttgtatgatgcgtggctgaagatcctcgaactggagggttacgacgaaaatcttctgaaattgtctggctccgatgacatcgatgtgagcaagattgagaagcctgcactcgaaatcaggcaaatggtactggccgtgttcgaggtcttagggatttcgggagctatactggactttgacgccgaggcagatggcaaagccttcgaacagcagccagcttatcagctatggcatctcctgtactctgccgaggacgatggtaagaaatattcccaagaagacatctttacgtacgggcacgataacattggccttaagaaaaagttgtgcgagaagttcggatttcgtccggaacacaccaaaatcctggtgaatgttgtgttctcagacgattatggcaacctcagtagcaaggcaatgcggcgaatctaccccttcattaaagagctgacatacgacaaggcgtgtgctgaggccgggtatagacattccgcagcctctttaactaaagaagagatagctgccaggcctctgcagaatcgccttgatttgctcaagaagaacgaactgcggagcccagtcgtggagaaaatcctaaatcagatggtaaacgttgtgaacaccctggtcgacgatgagaatcagaacagaaaggcaaggggactctcagaagactttcacttcgatgagattcgcatcgaactggctcgagagcttaaaaagaatgccaaagaacgggcggagatgacaactaacattaataccgccaagcaaagtcatgagaagatcatacgtatcttgcagacagaatttggtgtgcccaacccttccagaaatgacattgtcaggtacaaactgtatgaggaattaaagaacaatggctacaaagacctctataccaacacttacatcagccgcgatattctgttctctaagcagatcgacgtggatcacataattccacaaatgtcactttttgacgatagtttcagcaataaaacggttgtgtttcggaaggacaaccaggataaagggaataagacagcttatgactacatcctgggaaagtacggcgagcaggcattggaagagtatatttccagaatcacctctctcttcgagctgggtaaaaagaacaaagaagaggggataggcaaggccaaatttcagaagctacaaaagaggctggtagatatcggagacggcttcattgaacgagatctccgcgagtcgcagtacatcgctaaaaaggccaataacatgctgtatgcaatttgccggagcgtcgtgtccacttcaggggaaatcaccgcgagacttagggaggactgggatttggttaacgtgatgcaggagataaatctgcccaaatttcgtgccttaggactcacagaaatggtcgagaagaaagacggtgctcagaaggaacgcattaccgactggactaagcggaacgatcatagacaccacgccatggacgcactggctatcgccttcacaaggcatagtcacatccaataccttaatcatctgaacgcacgaaaagatgaggccaataagtggcacccggtggtatctaaaattgaggaaaaggagacggtgctaatctatgacgatctcggcaaccggaaacgcaagtttaaggctcctatgcccaatttcagagaagttgtcaaagagcacctggaaaacgtgttgattagccataaggcgaaaaataaggtggtcaccaaaaacaagaataagataaaaactgttaggggagagaaggtgaaaacagagctgaccccacggggacagttacacaaggaaacaatctacggccgatatagatactacgagtccaaagaagagaagattggtcctaaattcgacgccgaaatgatcgggatggtgactaacccccagtataagaagctcctgcttgagcgcctggcagctaatggcaacgatcccaaaaaggccttttgggggaaaaatgccttgaacaagaacccactctacgtagacgaggctaggcaggaactgctacctgagaaaattctgcttcgttggctcaatgatgactattcaatccggaaggatgtcaccccagaaaacctgaaggacataaaaacgatcgagaagattttggacaaaggcgtgaagaaaatcctgttaaagagactcgcagatttcgggaatgacccgaagaaagcctttagcgatctggacaagaaccccatttggcaaaatgaagcgaaaaggatcgctataaagcgcgttaccatttctggaatcaaaaacgccgcacctcttcatcacaagaaggatcatctgggcaatgacatcttggatgagaaaggtaagcagattccatccagtttcgtgagcacagggaacaatcaccacgtcgccatataccgagacgctgagggaaacctccaggaaagagtggtttctctgtttgatgcagtgcagctagtaaatggcggtgagcccgtcatcgacaaagaatataacaagggcattgggtggcagttcctgtttactatgaaacagaatgagatgttcgtgtttcctgatgagaagaccggattcaacccacgggaagtggaccttctctcctcaggcaataggaaactgatcagtcccaacttgtttcgcgtccagaagttagccagcaagaattacttcttccgtcatcacctggagacatcggttgaagagaaaaaggaactcaaaaacattgcgtataagccgcaactggggcttaacgctctgtccaatatcgtgaaagtaagaataaaccatatcggagagattgtgtctgtcggcgagtactga

SEQ ID NO: 3334 - RNA, 4281 nt, synthetic construct
  misc_feature 1..4281: note = Cas9 variant
  source 1..4281: mol_type = other RNA
atgaagaacatcctgggcctcgaccttgggattaccagcatatccttcgcccacatcgtggaggatgaaaataaagagaagtctgaaattaaagagctgggagtcagaatcgtttcattgacaactgacgaacagagtgattttgagaagggtaaaagcattacgaccaacgctaataggacattaaagcatggcgcacggctgaacctagaccgctaccaacagcgacgtaagtatctcatcgatctgcttcagaaagccaatctgataacttcctcttcgatcttggcggagaacgggaagaataccacacactcaacctggcagctcagagctaaagccgtgactgaaaggattgagaaggaagagttcgcacgggtactgctggccatcaacaaaaagcgcggatacaagagcagtagaaaagctaagacagaggacgaaggccaagcaattgatggtatggccatcgctaaaaggctctatgacgagaatttaacccccgggcagctgtcccttcagttgctgcagcaaaacaagaaactactccctgatttttaccggtctgacctgcagcgcgagttcgatcttgtgtggaattttcagaagcagttctatccagacatactgacggatagcttttacaaagagttgcaaggaaagggcaaggacgccacttccaaagcgttctcaaagcgatatcattttgacaccgcagaaaacaaaggcagtaaggagagcgtcagactccaggcctaccagtggagggctgaggccatttctaaacaactgtccaaggaagaggtggcatacgttttaacagaaatcaataacaatctgaacaacgcttcagggtatctcggagccattagcgatcggagtaaggagctttacttcaatcgtcagactgtgggtcagtatctgtacgcgcagttgcaagaaaaccgccacaattctctgaaaaacaaggtcttttatagacaggactacctggatgagttcgagaggatctgggaaacccaggcctcctttcataaagagctcacagacgaactgaagaaacagatccgggatgtggtaattttctatcaacgaaaacttaagagccagaaaggcctgatatcgttctgcgagtttgaatctaaggagatcgagattgaaaaagacgggaagaccatcacgaaaactataggagcacgcgttgtgccgaagtcctcacccttgttccaggagtttaagatttggcagatcctcaataacgtcacatgtaaaagaaagggcatcaggaaaaagaaaagtagcgctaagtccaccgaactggatttattcaatgagccttctcaaactatttttagcctggacatggagtgcaaacagctactcttcgatgaactgaaccttaagggtgacttgaagtcagataaagtgctgaagctcctggggtacagtccacaggagtgggaaatcaattacaaccagcttgagggaaatcggacacaaaaagccctgtatgaagcatacttgaagattgtggagatggaggcccacgacgtcaaagacatactccagatcaagtccgcaaaggatgactggagcctggatgaatctcccttatcagccagtgagattaaagaaaaggttaaagacatctttcaggctctgggcatctgtaccaagattctatatttcgatcctctcctgccagtgaaagagtttgaaaagcaagacagctaccagctttggcacttgctgtattcctacgagtctgatgactcgacgagcggcaacgagaccctctatcgcatactggaaaagaaatacgcgttcaagagagagcatgcaaggatcttagccaatgtagctctgcaggatgactacgggtccctttcaacaaaagccattcgtaagatctatcccaacattaaagaaaatcagtacagtaaggcatgcgagttggccggatataagcactctaaactcagcctgactaccgaagaactagaggctcgggaactgaagaacatcatacctctcctgaaaaagaacgcccttcgaaatccagtggtcgagaaaatcttgaaccaaatgattaatgtggttaacgcactgatcgaaaagaactccgagagagatgcggagggtaaaattacaaagtactttcatttcgacgaaatcaggatagagttagctcgcgaactcaagaaaaatgcccagaagcggtatgagatgactcagaatattaacaaagcaaagctggaacaccagaaaatctcagagattcttcaaaagaagtttggcatcaaaaatccgaccaagagcgatataatcagatacaggctgtatcaggagttggaacacaacgggtacaaagagctctacacaaatgcccccattgctcgcgacatgctgttctctaagaacatcgaaattgagcatatcgtgcctaaagcccgagtcttcgacgattcctttagtaataagaccctaactttccaccggataaacagcaataagggagaatatacggcatttgactacattacatctctgaactccgaggaggaactcaaccagtatctgacccgtgtggagaatgcttacaaaactaagtcaatcagtcttaccaaatataagaacttgctgaaaaaggccagcgaaatcggcgatggtttcattaatagagacttaagggatacacagtacatcgcgaagaaagccaaggagattctctttcaagtaaccaaaaacgttctgtcgacttccgggtctataacagaccgccttcgggaagattggggcctggtggacgtcatgaaggagctaaatatgccaaaatatcagagcctcggactgacggaggtggaagagagaaaggaaggcaacaaggtcaccgtgatcaaaaattggactaagaggaacgatcatcgacaccatgctatggacgcattgacagttgccttcaccaaaccctcatacattcagtacctgaatcacttaaacgctcgcaaggatgagaataacaaaaattatagtgtgatcctcgccattgaggaaaaggagacaatcaaagtacctactaacaatgggaagaacaagcgggtctttatagaaccaatccccaacttcagacaagtggctaaaaagcacctggaggaaatttttatctcccataaagcgaagaataaagttgtgaccaagaacgtcaataagccggccggaacggacaaacagcagattacccttacacctaggggtcagctgcacaaggagactatctacggcaaatatcaatactatgtgaacaaggaggaaaaagtaggggtgaagttcgatgagcgtaccataacaaaggtttctaatcccttgtaccgcgaagctctcctgaaacggctacaggccaacgacaatgacccaaagaaagcatttactggaaagaacgctctgagcaaaaatcctatttatcttgatgagaccaagacgaagacactccccgaaaaagtcaacctgacctacttggaggaggacttctccatcagaaaggatatctcaccagacaattttaaagatctaaagagcattgaaaaagtgatagaccagggcgtgaagaggatcttaattaaacgactccaggattacgacaacgatcccaagaaggccttcgtcgacctggagaaaaatcctatctggcttaacaaggaaaaaggtattgcaatcaagcgggttactataagtggggtgtctaatgcccaaccactgcatatcggcaaagatcacttgggaaagacaaccctcaacaaggagggcaatgaaattccggtggactatgtatccactgggaacaaccaccatgtcgctatctaccgcgacaaagagggaaatctgcaggagcagattgtgagcttctttgaagcggttgtgagaacccagcaaggtctacccatcatagataagacatataaacaggaggaaggctggcagttcctgtttacgatgaagcagaacgagatgttcgtctttcctaatgccaccactgggttcaacccagcagagattgaccttctcgatcccaaaaataagaagctgatctcgcctaacttgtttagggtgcaaaagatcgctacaaaggactacttctttcggcaccatttagaaaccaatgttgagacagataacgtgctgaaaaatactacctggaagcgagaaggactctcaggcctgaaagacattgtaaaggtcagaatcaaccaccttggtgatatagtgtctattggggagtattga

SEQ ID NO: 3335 - RNA, 4281 nt, synthetic construct
  misc_feature 1..4281: note = Cas9 variant
  source 1..4281: mol_type = other RNA
atgaagcacatcctgggcctcgaccttgggaccaacagcattggatgggccctgataaaacaggatttcgagaataagcaaggtgaaatcttgggcatggggtccagaattatccccatgtctcaggacattttaggagattttggcaaaggtaactcagtgagtcagacagctgagaggactaagtaccggagcgtccgccgactgcgtgaaagattcctactcaggcgggagcgcctgcatagaatccttaatgttctggggtttttgcctgaacactatgcatcccagatagacttcacgaaaaggtttggaaagttcaaggaggagaccgaaccaaaactcgtgtactctaacgagggctttatcttcaagaaatcgtttgaagagatgctgtcagatttcaagacacatcaaccgcagctgctcgaggacaataaaaagattccctatgattggactatctactatttacggaagaaagccctgagccgcaagattgaaaaagaggaacttgcgtggatcttgctgaactttaatcagaagcgaggctactatcagctaagaggggaggaagaggaggaaaaccctaataaactcatagagttctacagtctgaagattgtagacgtgcttgctgatgaaccacaaaaaggaaagtccgacatctggtactctctgattttggagaacggttggatctataggcggagctccaagacacccctctttgattggaaagaaaagacacgtgacttcatcgtcaccattgatctgaatgacgacggctcagtgaaaactgataaggaggggaacgagaaacgcagtttcagagcccctggagaaaatgactggacattagttaagaagaaaaccgagcaggaaatagatagctctaggaagacggtgggcacttacatctatgagaccctgctcaaaaacccaaagcagaaaattaagggtaaacttgtccggacaatcgaacgaaaattttacaagactgagctgaaacagatattggagaagcaaaaagagttccaccccgaactacgccaggacgatctgtattccgactgcgtgagagaactctacaagaataacgaggcacatcagctgaccctttcaaagaaagattttgtacacctgttcatggaggacattatcttttatcaaaggcctttggggagccagaagagttctatctccaactgtacactcgagttccggaaatacaaggatgaaaatggaaccgaacacacgcagtacctgaaagccattccaaagagcaacccgtattaccaggagtttcgcatctggcaatggatgtataatttaaacatttacaaaaaggaagacgatactaatgttacaaaggacttcctgaacaccaaagctgactttgagtcgctattcgagtttctcaataacagaaaggaagtggatcagaaagcactgcttaagcatttcaaattgaatgacaagactcacaggtggaactatgtcgaggataagaaatacccctgcaatgaaacaaagaccatgatactgtctcgtctcgacaaagtggagaacatctccgatgactttctgacgcgggaaatggagcagaagatttggcatatcatctattcagtgaatgataaagtcgagtacgaaaaggcccttaagagtttcgctggcaaaaacaatctggaggacaacagcttctttgaagccttcaagaaatttcctccattcaagtccgagtacggcgcgttttctgaaaaagcaattaagaagttgctccccctgatgcgaatggggaaattctggaactataataacataagcgagcagtcaaagagtagaatccaaaagattatcaccggagagtacgatgaaaatattaaggacaaagttagggagaaggccatccacttaacaactgaaaccgattttcagggtctgcagctatggctcgtgcagtatatagtatacggccgccactccgaggctgccatgctggggaaatggaacagcgcagacgatcttgaggagttcttgaaggaatttaagcaacattctctgcggaatcctatcgtggaacaggtcattacagagactctcagagtggttaaagacatctggcagaagtatggaaacggcgctaaagacttctttagggaaattcacatcgagctgggtcgcgagatgaagttaccagccgaggaacgagaacggctgacccgtcagatatcagagaatgaaaacacaaatttcagaattaaagcgcttttggccgagatgatggatgacaacagtgtggagaatgtcaggccctttagcccgatgcaacaggaaatcctcaagatttacgaggaaggggtgctgaactccgatatcgagatagaagacgatatcctaaagatttctaaaaccgcacagccttcgagctccgacctgaagcgctataaactctggctggagcaaaagtacaaatcaccctacactggccagatcattccacttaataagttgttcacgcctgagtatgaaatcgagcatataattccccagagtcggtacttcgatgactcttttacaaacaagatcatctgtgaaagcgctgtaaataaactgaaggataactatattggattagagttcatcaaaaagctcggcgggtccattgttgagtgcggaaacggtaaatcagtggccatactgaagcacgacgcttacgaagattttatcaagaaacattatgccaataacagaagcaagaggaataaacttctgttggaggacattccagaaaagatgatcgagcgacagatgaacgatacccgctacatttctaaatatatctccggcgtcctcagtaatatagtgcgggtcgaagacgggactgacgagggagtgaacagcaagaatatcgttcccggcaacggtaagattaccacacaactgaaacaggattgggggctaaatgacgtgtggaacgatctgatcctccctagattcgagaggatgaatcacctgaccaactctactgactttacagcatggaatgaaaaccaccagaagttccttccaacggtaccggtcgagttttccaaaggcttctcaaagaaacgtattgatcatcgccaccatgccttggacgctctggtgatcgcgtgtgcaaccaaggatcacgttaatttactcaacaaccagagtgccaaaagcgacactaagcggtacgatctgaagaaaaagctgatgaaatttgaaaaggtggcttacaatcacccccaaacaggagagagaatagaaagggaggcccctaaacagttccttaagccatgggagacctttacaattgacgcaaagaaccatctagaaactatcatcgtctcgttcaaacagaatctccgagtgattaacaaggccaccaattattacgagaaatatgtagaaaaggagggcacgaaagtgaaggaacgggttgagcagaaggggaccaactgggctatacgcaaacccatgcacaaggagacagtctccggaaaaatcgatctgcctagaattaaggtgccaaaaggtaagatcttgactgccaccaggaagtctctggacaccagcttcaatttaaaaactattggctcaatcaccgacacggggatacaaaagatcctcaaaaactacctgcagtataaggataataaccccgaacttgcatttagtccggagggaattgaagacatgaataaaaacatcgagaagttcaataacggcaaagcgcatcagtccatttctaaggtgcgggtctttgagctgggtagcaagttccctttggggcaatccggcaataaaaaggaaaaatacgttgaggctgccaagggaacaaacctctttttcgcaatctatcaggataaaaatggcaagcgatcatacgaaaccataccactgaacgaggtgattgaaagacagaagcaggggctaagcgtggtagacctgaaaggagtcgatgacttttaccttagtcccaacgatctcgtgtatgttccttctgaggacgagctggaaaatatctccatgatcgatttcaacaagatgagctcggagcgcatttacaaagtggtctcatttactggcaatcaaatcttctttgtgaggcaggacatagccacatctgttgtgaacaaggctgagttcagtaccttgaataaaatggaacgtgccattgatggtactatgatcaaggaaacctgcgtaaagctgcagattgaccggttagggaacatctccaaaatatga

SEQ ID NO: 3336 - RNA, 4281 nt, synthetic construct
  misc_feature 1..4281: note = Cas9 variant
  source 1..4281: mol_type = other RNA
atgtacaacatcggcctggacattgggaccggaagcgtgggttggtgcctcacagatgagaatggctatcttctgaaggtcaacagaaaagggaataacggaaatacttacaggaactccgcctggggcgttcggttgttcgaatctgctgacacggcagccgattgtcgcataaagcgatcaacccgtagaaggtataaacggcgcagaacaaggatcattgagttacggaagatcatgagtgacatgattatgcccatcgatcctaatttttacgcgcgcctggacgaggctttcctatggaacgaagataaaagcgacaaggccaaggcaccatttctcctgttcaatgataacggttatgacgatgtgaaatactatactgactacccgaccatataccaccttcgaaagcatctgttggaaacaaaagagaaggccgatcccagatttatctatctcgctctgcaccatatgatgaaatacagggggcacttcctgtttgagggacagtccttcgaagcaattgacaatatcgaggacacctttattgaactcgagcatttagtaaacgtgtatgtcaaggagaaggaagatactgacaataacgccgagaataacgctctgtaccaagaaatgaaaaactatcttgccgataataaggtgaaaaacaaggacaaaaaggagtacatcacagataccttcataaaagcggactatgataataagtactctaaggaattggcagccgctgttctgggctacgagtttaacgtgggcattatcgtcaatgacaactcgctaacggatgaggacgggaaagccctcaaggcaaaattcgctgatgccaagtatgaagagaaagaagagaagctgtcagacactcttggagaacggtactatattatcgagaccctgaagaaaatctacagctggaaggtgttgcacagtattctcggtgacaataaatatctgtcctacgcgatggtagataagtatgagaaacactctgaacagttaaaggccctgaagtacctctttcataaatacacaagccaggacgagtattccgagttcttccaccaggaaaagaacaaagaaggcaagtacatagttaattatgcaaactacatcaaagggattaagcgtctttcaaatgagactaacaagaaatataataccaagcaacagctgtaccagagtatcatgaaaatattgggagagcgcgctgccgatgacgaagtgtataagaaaattctagtcgagatggaacaggagacatttctggagaagatcaacaatgtggataacagcgctatcccttaccaactcaacctgatggaaatggacaaaattcttacccagcagggcgtgtactataaggagctgagagataataaggaattgctcctgaaaatgttaacgtctaagatcccatactatgtcggtcccctgaacaataactccaatgggaacaggaatttcgcctggatgactaaaaaggacggaaaagagaacgaaaaggtttacccttggaatgtgaaggatgtagtggacattgatgtcacagcagaggactttataacccggatgactaactattgcacatacctaccaaatgagaaagtgctccccaaggaatcactgctttatcagcgatacatgttgctggaggaactcagccaaatccgcattgatggcagaaaactgagtaaggaggacaggaaagccatcatcaacgaccttttcattggcaaggggcgggttaaggtgtctgataaagactttaaggaatacctgaataaagtcaactatgtgaaggtaaatggaaaaggttacgatgttaccggctatcagtccgacgatgggttcgcttgtgcgttgagctcgtacaacaagtttcgcagaatactcggacatatcgacgagcagaacgagaagatgattgaagatatcatttattggatcacggtgttcgaggacaaagatatagtcaagaggaaaatcaataagcaatacgcagaccgtctgtctgccgaacagttaaagaagattctgaaactaaagtttaagggctggggtcggtattcctcaaaactcctgaacgggatcaagggcgatatgggaaccacaattatcgagatgcttgaagacgctgatgagcgattcgcctactgcgactactgtcctaattttatgcagataattaacaaagacgagaagatcaaacagattatcgatgacaatagaccaaggtatgatggcactaaggacttgctggatgtgatacaagacatgcacaccagtccggcaaaccgccgggggatctggcagacaatgaaggccattgaagagatcattgaatacatgggagagaaaccccagcagatctatatagagttcgctagagaagatgaccctaaggccaaaaataagagggcagatagccgcaaacgagcgattgacaaggctctcaagaaactgaaggaggatgtcgtggacgaatacaacgagaaagtttataaggaattaaaacaatacgagaagcggctggacgaggaaaaggtgtatctttactttatgcagaatggtaaagatttgtacttcccagacaaggagctcaacctggatgaactagagaaactggaaatcgaccacatcattccctattccctctctgatgacgatagcctggacaataaggcccttgtattgaaaggcaacaatcagaacaaggggaataagatcgtcaaagaggcattccctcagctgttttcaaacagtggaactgtgaactactggaagaatctcaaaaaggccggcttaatttccgagaaaaagtataacaatctgcagaaaaacaatgttgatgacatacttaccaagggtttcatcaaccgtcaactggtggaaacaagacagattgtcaagagcgtggctaatttgatcctcgattactataacgagcagattgacgtaatcgaagtgaaagcctctctgtcaaccagtgttaggaagatgctaacttacgagaaaaaggataataacgggttttggatagaaaataaagacaactgcatgttctataagaatcgcgacatgaacgattaccatcacgcacatgacgcttacctggccaatatcattggcctctatatccaaaagaactacccacggctgcagaaagagcttaattatagccagtacagaaggatttggcgaaagtattacgagaacacgaaaaacaataacggagtcaattggtttgcgacattgggcaagttctcctctaacaatgaagaggccgattggtatgggcaagacatcatagcttacatgcgcaaaatcttttgttaccgggatgtgctgatttcgaagaaggtggaagagaacaccggagcattctatagcgagactaaataccccagagaagacaaggccggttccaaattagtcccgctcaagcagggcaataacatgcgtggggctaataacctgaaagagcttgatgccaggaagtatggaggctacaagggtggggaaaaagcatattttgttctggtgaagtactgcatcgagaaagcgctaaagaaaaaggtgaaaaaggaatatcacatggagttcgtagagattcctgtctacatagcccgcggcatcaagaataaagacattaacctctacgattatgtgtgtgacatcctgaatgaagctaacaaaaattcagttgccgatgtggagattttgcggaacaaagtccccaagtaccagatgatcataggagaaaacggcgaggaatattacctggtgagtgcaaccgaggttatcaattctaaacagtttgtgttagggggagctaaccaacagtataatagactcctgaactacattaagtatggcaagaatgacaaatggcagtacatccagacagagcttctggatgaacaattgattggtctctacaacctgctaatcgccaagataaaagacgagtataaggggttcagcaaagaagcagtaaggattcaggagaataactcctttgacaagctggatgtcaaggacaaaaaggagttcatcgccgaaatgatcaaacttgtgcagccagattcagactacccttatctcggaaagtacgctaccggcctgagcaatcgaatgggtcggaaaactggcgagaaggtggggaagaaaattacattggtcgataagtctgttacgggactgtatgaacgcagaaccactttcgagttagaagacgattccagtacaaaaagctgctga

SEQ ID NO: 3337 - RNA, 4281 nt, synthetic construct
  misc_feature 1..4281: note = Cas9 variant
  source 1..4281: mol_type = other RNA
atgaagaacatcctgggcctcgaccttgggaccacaagcattggattcgcccacatagtggaggatgaaaataaagagaagtccgaaatcaaagagctgggtgtcagaattgtttctttgactacggacgaacaatcagattttgagaagggcaaaagtatcaccacaaacgctaataggactttaaagcatggggcacggctgaacctagaccgctaccaacagcgacgtaagtatctcattgatctgcttcagaaagccaatctgatcacccccagctccatattggcggagaacggaaagaatacaacccactctacttggcagctcagagctaaagccgtgacagaaaggatcgagaaggaagagttcgcacggattctgctggccatcaacaaaaagcgcggctacaagtcgtcaagaaaagctaagaccgaggacgaaggtcaagcaattgatgggatggccatcgctaaaaggctctatgacgagaatttaacgcctggacagctgagccttcagttgctgcagcaaaacaagaaactactcccagatttttaccggagtgacctgcagaaggagttcgatcttgtatggaattttcagaaacagttctatccggacatactgactgatatcttttacaaggaattgcaaggcaagggcaaagacgccacctccaaggcgttctctaaacgctatcattttgacacaactgaaaacaaggggagcaaagagtccgtgcgactccaggcataccagtggagagccgaggctatttcaaagcaactgagtaaggaagaggtcgcctacgtgttaaccgaaattaataacaatctgaacaacgcaagcggatatctcggtgctatctctgataggtccaaagagctttacttcaatcggcagacagttggccagtatctgtacgccaagttgcaggaaaaccgtcacaattcattgaaaaacaaggtgttttatcgccaagactacctggatgagttcgagagaatctgggaaacccaggcgagctttcataaagagctcacggacgaactgaagaagcagattagggatgtcgtgatattctatcagcggaaacccaagagtcaaaaagggcttatctctttctgcgagtttgaatccaaggagattgagatcgaaaaagacggaaagactataacaaagaatattggcgcccgagtagttcctaaaagctcgccactgttccaggagtttaagatctggcagatcttgaacaatgtgatttgtaaacgcaagggtatcaggaaaaagaaaatttctgcaaagaccactcagctcgatctgttaaacgaatcctcacaaacaatattcagtctggacatggagtgcaagcagctactctttgatgagctgaatcttaaaggggacctaaagagcgataaagtcctgaagctcctgggatactccccacaggaatgggagatcaactacaatcagcttgaaggcaacagaacccaaaaagctctgtatgaggcctacttgaagattgtggaaatggaggctcacgacgtgaaggacatcctccagatcaaatctgccaaggatgactggagcctggatgagtcacctttaagtgcatccgaaattcgggagaaagtcaaggccatattccagacgctgggcatctgtaccaaaattctatattttgacccactcctgcccgttaaggagttcgaagaacaagatagctaccagctttggcacttgctgtattcttacgagtcagacgatagtacaagcgggaatgagactctctatcgcatcctggaaaagaaatacgcttttaagagagagcatgcgaggattttagcaaacgtggccctgcaggacgattacggatccctttctaccaaagctatccgtaagatatatcctaatatcaaagaaaaccagtactcgacagcctgcgagaaggcaggttataagcacagcaaattgtccctcactaccgaggaactggaggcccgggaactaaagaacattatcccactgctcaaaaagaatgctctgcgaaacccggtagtggagaaaattcttaatcaaatgatcaacgtcgtgaatgccttgatagaaaagaactcagagagagacgcagagggcaaaattacaaagtacttccattttgatgaaatcaggattgagctggcgcgcgaattaaagaaaaatgctcagaagcggtatgagatgacccagaacatcaataaagccaagctcgaacaccagaaaataagtgagatcctgcaaaaggagttcgggattaagaaccccactaaatctgacatcattagatacaggctttatcaggaactggagcacaatggatacaaggaattgtacacgaacgcacctatcgcccgcgatatgctctttagcaaaaatatagagattgaacatatcgttccaaaggctcgagtgttcgacgactccttctcaaacaaaacactgacctttcaccggatcaatagcgataagggcgagtatactgccttcgactacattacctctctaaactccgaggaggaactgaaccagtatctcacacgtgtcgaaaatgcatacaagaccaaaagtatcagccccactaagtataaaaacctgcttaagaaggcttctgagattggtgatgactttataaatagagatttgagggacacacagtacatcgccaaaaaggcgaaagaaattctgttccaagtgacgaagaacgtattatccacctcagggagtatcactgatcgcctccgggaggactggggcctggttgatgtgatgaaagagcttaatatgcctaagtatcagagcctgggactaacagaagtcgaggaaagaaaagacggcaacaaggtgaccgtcattaagaattggacaaaaaggaacgatcatcgacaccatgccatggacgctctcactgtggcatttaccaagccatcgtacatccagtacctgaatcacttgaacgcccgcaaagatgagaataacaagaattattccgttatactggctatcgaggaaaaagagacgattaaggtgcccaccaacaatgggaaaaacaagcgggtattcatcgaaccgattcctaactttagacaagtcgccaagaaacacttagaggaaatcttcatatctcataaggctaaaaataaggtggttactaaaaacacaaataagcccgcgggaaccgacaagcagcagattacactcactccaaggggtcagctgcacaaagagaccatctacggcaagtatcaatactatatcaacaaagaggaaaagattggggtgaaatttgacgagcgtacgatagccaaggtcagcaatcctgtgtaccgcgaagcacttctgaagcggttgcaggccaacgataatgaccccaaaaaggcattcgctggcaaaaacgccctctcaaagaatccaatctatctggatgagagtaaaacaaagaccctacccgaaaaggtaaacctgacttaccttgaggaggacttttccattagaaaagatatctctcctgacaatttcaaggatctcaaaagcattgaaaaggtgatcgaccagggagttaaaaggatactgatcaagcgattgcaggcatacgataacgaccccaaaaaggcctttgtcgatctggagaagaatccgatttggttaaacaaagaaaagggtatcgctattaaacgggtgacaatctccggggtgaataacgcgcaacccctccatataggcaaggaccacctgggaaaaaccactcttaataaggagggcaaggaaattcctgtcgactatgtttcaaccgggaacaaccaccatgtggccatctaccgcgataaagagggaaatctgcaggagcagatcgtgagcttcttcgacgcagtagtcagagctcagcaaggtattccaatcatagataagacatataaacaggccgaaggctggcagtttttgttcacgatgaagcagaacgagatgtttgtgttccccaatgccaccactgggtttaaccctgctgaaattgacctcctggatcccaaaaataagaagctaatcagtccaaacctgttcagggttcagaaaattgcaacaaaggactactttttccggcaccatcttgagaccaatgtggagacagataacatcctcaaaaatgtcacttggaagcgagaaggactgtctggcttgaaagacatagtgaaggttagaattaaccacttaggtgatatcgtgtccatcggggagtattga

SEQ ID NO: 3338 - RNA, 4281 nt, synthetic construct
  misc_feature 1..4281: note = Cas9 variant
  source 1..4281: mol_type = other RNA
atgaagaacatcctgggcctcgaccttgggaccacaagcattggattcactcacatagtggaggatgaaaataaagagaagtccgaaatcaaagagctgggtgtcagaattgtttctttgacgaccgacgaacagtcagattttgagaagggcaaaagtatcagcacaaacgccaataggactttaaagcatggggctcggctgaacctagaccgctaccaacagcgacgtaagttcctcattgatctgcttcagaaagcaaatctgatcacctcctcttcgatattggccgagaacggaaagaatacaacccactcaacttggcagctcagagcgaaagctgtgacagaaaggatcgagaaggaagagtttgcccgggtactgctggcaattaacaaaaagcgcggctataagagcagtagaaaagccaagaccgaggacgaaggtcaagctatcgatgggatggcaattgccaaaaggctctacgacgagaatttaacgcccggacagctgtcccttcagttgctgcagcaaaacaagaaactactccctgatttctatcggtctgacctgcagaaggaatttgatcttgtgtggaatttccagaaacagttttacccagacatcctgactgatagcttctataaggagttgcaaggcaagggcaaagacgctacctccaaggccttttcaaaacgctaccatttcgacacagcggaaaacaaggggagtcgagagagcgtcagactccaggcatatcagtggagggccgaggctatatctaaacaactgtccaaggaagaggtggcctacgttttaactgaaattaataacaatctgaacaacgcatcaggatacctcggtgctatcagcgatcggagtaaggagctttattttaatcgtcagaccgtgggccagtacctgtatgcccagttgcaagaaaacaaacacaattctctaaagaacaaagtcttctaccgccaggactatctggatgagtttgagagaatttgggaaacacaggcgtccttccataaggagctcaccgaggaactgaaaaagcagatcagggacgtggtaatcttctaccaacggaaacttaaaagccagaaggggctgatttcgttttgcgagttcgaatctaaagagatagaaatcgagaaggatggaaaaacgattactaagtccatcggcgcccgagttgtgccgaagtcaagtcccttgtttcaggagttcaaaatatggcagattctcaataacgtcacatgtaagcgcaaaggtatcagaaagaaaaagagctccgcaaaatctaccgaactggacttatttaatgagcctagccaaactatcttctcactggatatggaatgcaagcagctactctttgaggaactgaaccttaagggggacttgaaaagtgataaggtgctgaaactcctgggatattccccacaggagtgggaaattaattacaaccagcttgagggcaataggacacaaaaggctctgtacgaggcctatttgaaaatcgtggaaatggaggctcacgacgtcaaggatattctccagataaagagcaccaaagacgactgggccctggaagagtctcccttatcagcaagtgaaatccgggagcgcgttaaggccattttccagacgctgggcatctgtaccaaaatcctatactttgatcctctcctgccagtgaaggagttcgaggaacaagacagctatcagctttggcacttgctgtactcctatgaatctgatgactcgacaagcgggaacgagactctctacaggattctggaaaagaagtatgcttttaagagagagcatgcgaccatattagcaaatgtaacactgcaggatgactacggatccctttcaactaaagccatccgtaagatttacccctatatcaaagagaaccagtacagtaccgcttgcgaaaaggccggttataaacactctaagttgagcctcacaaccgaggaactggaggcacgggagctaaagaatattatccctctgctcaaaaagaacgccctgcgaaacccagtggtcgagaaaatacttaatcaaatgatcaacgtggttaatgctttgattgaaaagaactccgaaagagatgccgagggcaaaatcactaagtacttccattttgacgaaattaggatcgagctggcacgcgagctcaaaaagaatgcgcaggaacggtatgagatgacgcagaacataaataaggctaaattagaacaccagaagatttcagggatcctgcaaaaagagttcggaattaagaacccgacaaaaagcgatatcaccagatacaggctttatcaggaactggcccacaatggctacaacgacttgtacactaatacctatatacccaaggagctcctgttctctaagaacatcgatattgagcatatcgtgtccaaagcacgcgtctttgacgatagtttcagcaataagacactagcctttcgagagttcaacattaaaaagggtgaatctaccgcttttgactacatcacttccctgaataacgaagaggaactcaaccagtatctgaatcgggtggagaacgcctacaaaacaaagaatatatcaccagcaaagtataaaaaccttttgaagaaagctagtgagattggggacggcttcatcaatcgtgatctgagagacacgcagtacatcgccaagaaagcgaaggaaattttatttcaagtaaccaagaacgttctcagcacttcgggatccatcacagataggctgcgcgaggactggggccttgtggatgtcatgaaagaactgaatatgccaaagtatcagtctctagggctcaccgaggtggaggaacggaaagagggaaacaaggtcacagtgattaaaaattggactaagagaaacgaccacaggcatcacgccatggatgctctgaccgttgcattcacgaagcccagctacatacagtacttgaatcatctgaacgcccgaaaagacaagaataacaaaaattattcagtgatcttagctattgaagagaaggaaaccatcaaagtacctacaaacaacggtaagaataaacgcgtctttattgagccaatccccaacttccggcaagtggccaagaagcacctcgaggaaatatttatcagtcacaaagcaaagaataaagttgtgactaagaacaccaataaaccggcgggcacagataagcagcagattactctgacccctagagggcagcttcataaggagacggtctacggaaaatatcaatactatgtgaacaaggaagagaaaatcggcgtaaagttcgacaaagaaacaattgccaaggtgtccaatcccgtttacagggaggctctgttgaagcgtctccaggccaacgataatgaccctaaaaaggcatttgctggtaaaaacgccctgtctaagaatcctatctatctagatgaggcaaaaaccaagactctgacagaaaaggtcaaccttacctacctcgaggaagacttcagcatacgcaaagacatttcccccgataatttcaaggacctgaaatcaatcgagaaggtgatcgatcagggggtgaaacggattttgataaagagactgcaggactacgataacgaccccaaaaaggcctttgtcgatttagaaaagaatccaatctggctcaacaaagagaagggcattgctatcaaaagggttactattagcggagtgaataacgcgcaacctctgcacatcggcaaggaccatcttgggaaaaccacactgaacaaggagggaaaggaaataccagtggattatgtaagtacgggtaataaccaccacgtcgccatctaccgagacaaagagggcaatttgcaggaacagattgtgtctttctttgaggcagttgtgggggctcagcaaggactcccgatcgtcgataagacctataaacaggccgagggctggcagttcctgtttactatgaagcagaacgaaatgttcgtgtttcccaatgaggccacaggtttcaaccctgctgaaattgacctactggaccccaaaaataagaagcaaatctccccaaacctttttcgggttcagaaaatagcaaccaaggattacttctttcgccatcacctcgagacaaatgtggacactgataacgtactgaaaaataccacgtggaagagagaagggttgagcggcttaaaagacattgtcaaggtgaggatcaaccatctgggagatatcgtgtcgattggcgagtattga

SEQ ID NO: 3339 - RNA, 4284 nt, synthetic construct
  misc_feature 1..4284: note = Cas9 variant
  source 1..4284: mol_type = other RNA
atgaagaaaatcctgggcctcgaccttgggaccagctccattggatgggccctggtgaacgaggctgaaacatctgaggaaaagtcaagtataatcaaattgggtgtcagagttaatcccttaactgtggatgagctgcagaacttcgaaaagggcaaaagcattacgaccaatgcagacaggacagccgggcggtccatgcgccgaaacctacaacgttacaagctcagaagggagaatctgatcgaggtacttaaggaatataactttattactgatgagatgatcctgtctgaaaatggaaaccggaccacattcgagacctaccgcttgagagcgaaagctgccgtggaggaaatatcgctcgagcagtttgcaagggtcctgctgatgatcaataagaaacggggctataagtcaagccgcaaagccaagggtgctgaaaacgggactctcattgacggaatggaggtggcaaagaaaatgtacgatgaaggcatcacacctggcgagttatgcctgcagcttttgaccgccgggaagcgatatttcccagacttttacagaagtgatctgcaggctgagttcgacaggatttggaattttcaaaaacagttctatccggattccctaatcgacaaggttaaagatgaagtgcggggaaagaacaaatctcagacgtgggccatactcgcgaagtactttgtctggaaggaggtggaaaatagctggaacgaggaagaggcacagactcgtcgcgtagagaaagaatacagactggttggtattaagaggggcgtgaaacgggaggaacttaagctggagaatttccaatggcgagtcaaagccttgtccgaacgcatgaaccccgaggagctcgctatcgtgctgcaggaaattaacgagcagatctcaaatagtagcgggtatttaggagccatctctgacagatccaaggaactgtactttaacaggcagaccgtgggccaatatcagatggcagtcctcgataataaccctaatattggtcttcggaacatggttttctaccgccaggactatctggacgagtttaatacaatatgggagaagcaagctgaatttcacaaagagttgactgaagatctaaagaaagagatcagagacattgtgatcttctaccagaggcgtctgaagtcacagaaagggctcataaacatttgtgaatttgagcggcgacagatcgaggtagaaatcgatggaaagaagaaaattaagaccatcggcagcagagtgattccaaggagttctcccctgttccaagagtttaaaatatggcagacacttaatgacatcgaagtctccgtgctgggcgttaagaacaaacgcaagaagcaggatgacaatagcaccacgttgctcgattcggccgagaacattgactctctgaaattaaatgtgtcccggcctctggatgcggacgaaaagtcactactcgccaaagagctgttcatcagagataaacttactaagagtgacgtcttgaagctgctctttaacaatccacagaacctgaaccttaatttcaaaaacatcgacgggaataggacaggaagcgcactgtatcaggctttttccaagattttggagatatctggtcatgaaagcatcaacttcaagaaatcagccgatgagattgtggaacaagtaaagaccatctttagtgctctcggctggaatactgaggttctgtgcttcgactccgaaaaagagttagataagcagccctactttaaactgtggcacctactctacagcttcgagggggactctacacctaccggagatggcaacctgattcagaagatcgccgacctttgtggttttgaaaaggattatgcatcaatattggccaatatcacgttccaagaggactacgggagtctgagcaccaaagctattcgcaagatcctcccacatctgaaagatggcaaccagtatgacgtggcgtgcgaatacgcaggatataagcactccaaatcttcgttaaagaaggaggagattaaaaataaggtcctgaaagataaacttgaattgctcccgaagaacagcctgcgaaatcccgtggtcgagaagatcctaaaccagatggtgaatgttataaacgccattatcacaacttacggcaagcctgacgaaattcggatcgagctggctcgtgaactcaaaaagaatgccaaagagagagaggaactgaccaagtccatagtggatacaactaaaacccatgaggggatcagggcaattcttcagaacgacttcggaatgtcacacgtaagtcgcaacgccatcattcggtataagttgtacgaggaactgaaagacaatggttacaagacattatattctaacacctacatcccaaaggaaaaactctttagcaaggatttcgacatagagcacattatcccccaagctagactgtttgatgactccttctcaaataaaactcttgaggtcaagagcatcaacattgaaaaaggctctaagacggcctatgattttgtggaggaaaagtacggggagcagggactgcaggaatatttgaataggtgtgaggttctcttccgagacaaaaagacaaaactgcgcaagctaaaaatgcaagagtccgaaatccctgagggctttattgatcgggacctgagaaacacccagtacatagcaaagaaggcgctcagtatgctgaatgaaatctgcaggcgtgtggtcgctactaccggtgccattacagatgagcttcgcgaggactggcagttggtggatgtaatgaaagaactgaactgggagaagtataaagtgttagggctcgttgaatacttcgaggacaatgatggccggctgatcggaagaattaaggactggaccaaaaggaacgaccatcgacaccatgcaatggatgcccttactgtcgcttttacaaaggacgtgttcatccagtactttaataacaagaatgccagcctgaaaccagatacgaacgaagcagctatacggaataagtatttccaaaacggcaaagccattcccccgatgtctctagacgagtttcgcgcggaggccaagaaacacctcaacgataccctgatctccatcaagactaagaataaagtggtcacaattaacttgaatagaaccaagaaaaagaacgggatcaataaaaagcagcagcagacacctaggggacaactgcacttagaaactgtttacggttcacataaacagtatgtggtgaaggaggaaaaggtaaacgctagtttcgacgcagccaaaatagctaccgtcaataagcccgcctaccgggatgcactcctgcgaagacttcaggagaacggcaatgacagcaaaaaggcgttcacggggaaaaactcgctggataagcagccagtgtggttggacgccaagcaaaatgaatgtgttcctgagaaagtgaagaccgtcatgctcgagacagtgtatactgttcgcaaacccattgatgaaaagctgaacgtggacaaagtagtcgacgctaggatccgtaagctactgcaggatcggatcaaggagtacggaaatgccaaatccgcatttgctaaccttgacgaaaatccaatttggctcaacaaggagaaaggcataaccatcaagagagtgtctgtgagcggtatttcaaaagcccagagtctgcacgaaaagaaggataaagacgggaatttcatcttggataaggactccaggcgcattcccgtcgattttgttaacacaggcaacaatcatcacgtggcaatctatcgaaaacctgtactggacaagaaaggacaagccgtgttcgatgagaacggcgagttaaagtttgaactcgaggaagtcgtggtttctttctttgacgctgtgactagagtcaatctgagccagccaataatcgataaagactacaagcggtccgaggggtggaagttccttttctcaatgaaacagaacgagtacttcgtgtttccgaatgaaaagaccggattcgatcccaaagagattgacctgttgaaccctgaaaattatgcgctcatcagcccaaacctgttcagggttcagaagattgccagtaaagactacgtgtttcgccatcacctagagacggtcgtagcagatcgtaaggaactgcaagagatcacatggaagagaatatcttcccttagcattctcaatcggatcatcaaagtgagggttaaccacattggccagatcgtgatgataggtgagtattga

SEQ ID NO: 3340 - RNA, 4284 nt, synthetic construct
  misc_feature 1..4284: note = Cas9 variant
  source 1..4284: mol_type = other RNA
atggccaagcccaaagactacaccatcggcctggatattgggacaaacagcgtgggatgggtcgttactgacgatcagaataacatactcagaatcaagggtaaaaaggctattggcgcaaggcttttcgccgaggggaaagtggcggctgaacggcgctcctttcgaacgacccgtagaaggctgtctcggcgcagatggaggatcaagttgttagaggaactgttcgacaaggagattgccaaagtagatccttcatttttcgcacggctacacgaaagttggatcagcccaaaggacaaacgcaagcgatattccgccatagtgtttccgtctcccgaggaggataaaaagttccatgaatcgtaccctacaatctatcacctcagagacaagctgatgaaagatgaccaaaagcatgatattagggagatctacattgctgtccaccagatgatcaaagcacggggaaattttcttcatgacgaatcagtggagacttatcgtagcggcatgagttccctgggtgggcgctctgagagaaccatattgagcgttcagacactcgaagaactgaacgatctgttcgccgaaaatgagggaaccgaagaggctaagctcaacgtggcctccgcggagcagattaatgacatcttaactggcggccacctgaacgcagactcacaaaaagaaattgggaatcttttgctgccaagtagctttccctctttcgatgacaaggccaaagagaagcaggtcaagaaactaatcaagaacgtggctacaaatatctccaaagcctggctcggatacaaggcagatttttcaaccattctgaaccttgctaatgtagacaaagatcagaagaagatattcgcctttgcgctgcagggtggcgacgaagaggataaagttcaagaattggagagcctcctggagcagagtcagacggacatcgtggataggttaattgaaatccggcacgccatagtcctgtctgagattgtgcctgtggggatgactctctccgaagcaatgatcgacaagtatgatcagcataaagaggaccttatcaccctgaaggctgtcattcgaaacacaaaagacaagaagaaagccgctaagttgcaagccatctacgatctatacgttaataaccgccacgcagacctggccaaagctatgaagctcactggaattaaaaagagaagcgaactgcttgatccagaggagctgaagaaagcgatatcgtctttgctcgacgattcccccgaagcagtggagatcaagcagatgctggaagagaaaaccttcttacctctgcagaggtcaaacaataacggcgtaattccaaatcaactacatcaggtggagctcgacgaaatcatcaagaaacagagtaagtattacccgttcctggccgagaaaaaccccgatgaaagcgaggaagctcagaagaaggcccctacaaaacttgacgcattgctgacctttcgggtcccatattacgtgggtcccatgattacgaaggaggagcaagaagcccaggatgggcactccttcgcttggatggttcgcagagaccctcaggatcacgaggccataactccatggaattttgagaaaaaggtggacaaaatggcatctgcgacacagttcatcaagaggatgaccactaaggatacatatctcctgggagaggacgtccttcccgctagctcactgaaataccaattgtttaccgtgctcaacgaactgaataacttacgtgtaaatggcaagaaactgacgagtgacgagaaggagcaggttattgaaggcctattcaaaaagcagaagaccgtgaaagccgataagtttgtcaaatattggcaggcaaagcatatcggggccgacattaaagtgaagggactctccgatccgagcaagttcaactctacaatgtcaacttacatcgactttaaaaagatattcggtgatcaactgaatgacgtcaaccggcagaatgattttgagaaaatcattgaatacagtaccatcttcgaggaccgaaagattcttgaagataaattgagagctgactttgcctggctgagcgaggagcagatcaagcagctctgcaggctgcgcttacaaggctgggggcggctgtccgataaacttttgacaagactcactgacgcagatggacagaacgtgctggaaaggctatggaactctaatgacaacttcgttcagatagtgtcggaccctaatattaaggctaagatcgagcaagaaaaccagaaactgctccgcgatggccagagcgacgatgccgtagagtccattctggacgatgcgtatacctcaccccagaataagaaagccatccgacaagtcatgcgggtggttcacgacatagtgaaggcttgtgatggtaacgtcccagcaaaattcgccatcgagtttgctcgtagtcaggaagacgatcctaagagaacaaccgccagggtgaatcagatgcagaagatttacgaccaaatctctgatgaggtagtgagccagggggttaaagaacagctttccggcatgaagtcattgaaagaccgctattacctgtatttcatgcagggaggccgggacgcatacactggggcgaagttaaacattgatagactcagcgactatgatatcgaccatataatgccccaatcttttgtcaaagatgactccctggataatagggtgcttgtggcccgagctgtcaacaatcagaagagtgacaaggttccagccctgttgttcggaaacaaagtggtggcagatctcggtattacggtacgcgagatgtgggacaagtggcagaaactgggcatgatcagcaagcggaaactatctaatctgctcacagatcccgacgctctgaccgaatacagagcccaagggtttatcaggcgtcagcttgtcgagacttcccaggtgattaagttgaccgcaacaatcctgcagtcagagttccctgatagtaagattatagaagttccagccaaatacaacagcatcgtgcgcaagcaatttgacttatataaatcgcgggaggtcaatgactaccaccatgctattgatgcgtatctctccaccatcgtgggaaactacctgtatcaggtttacccgaatcttagaaggatgttcgtgtatggcgaatttaagaaattctctagcaacgccgaggaatcagcatacgacgtagtccgacgggtgaagagtatgaactttctggatgacctactccgcggtactcacggggataatatttactgcagatccacaggcgagatcgtgttcaacaggaatgacataatctctaagctgaaacaggcttatagctttaagcagatgttggtcacgcaagaggttttcaccaaaaagtccgccctgttcgatcagactgtgtacccctcacctgaacgggacagcaaaaagcgaagtggattaattccacgcaaaaagggcatggatacagagatctatgggggatactctggtaacaaggacgcctattttgtactcgctgaagcagtgaaagagaagggccacaccctgcagattgtcggggtgcccatcagagcccttaatacactgaaaaactccgcgaattacagcgaaaagttgctcgagataattaaacctcaggttatgttcaacaaggatactggaaagccaatcaaaggcatcaaggacgtgaaaattctgatggataagataccctgtaggcaaccggtcctagagggtgaatcgtattacatgctggcttcatctaaataccgttatagtcttaagcagatctccctcagccagatgtctatgaagtacattctggactatatcgacgatcctaattttaacaaacatgagatgattaatatcgaccagcaagatgaaaaggagtgcttgctgagcgtgtacgacgagatattagagaaaatggataagtatctcccactgttcgacatccggtcctttagaaagaaacttcacgatgggagggacgccttcattgcactgcccgttgcctcagaagaaaagaaacctggcaaggtggatgtcatccgcaaagtattgaagggactccatgctaacgcagacattaccaatctggccgagctaggctttgggacggcggctctgggagcccttgtgagtaccggcggtatcaaaataagcgatgacgcagttttcatttaccagtctcccacagggctctttgaacgaagagtgaaggtctccgacctgttgaaatga

SEQ ID NO: 3341 - RNA, 4287 nt, synthetic construct
  misc_feature 1..4287: note = Cas9 variant
  source 1..4287: mol_type = other RNA
atgaagaaaatcctgggcctcgaccttgggaccacaagcattggatccgcctacgtgctggaggctgaaaagtctgcagagcagactaaaatagtctatttgggtacgagaatcattttatcaagtgccgatgcggaaaacttcagcaagggcctgtcctgctctcccaccacagacaggacttttaaacggtcgatgcgccgacgtctacaaagatacaagcagaggcggtcaagcctcatccagcagttcaagaaaattgggatcataaccaatacagagcaaatcattcgcgaacctatcagtgagacccacgagctgcttagaattaggtccaaggctgtttctgaacgggtgagcctggaggaatttgcccgcatcttgctcactataaacaaacgaagaggatataagtccaataggaaaacatcaaagagtaccgaggaggatggcaagctggtagacgcaatggccgtgacgaaagaactgattaagctcaaaaagactccaggtcagtacatgttcgagcggtttaaacgtgggaagtatgctgaaatcgatttctacccgtttgacttaattaacgagctgaaacagatctgggaagtccagggacaaaagtatcccgatgtgcttaccgaggacttgctgagctctctactcaagcagaaaacaggcaaggcaaaagagctgatctactccaagtcagatcttaatcctgccgaagttccaattgactaccagaaaggcaagaagctgcgcaaaactatattgaacaagtatttcgcttacgagagcagaagtctcgccgcgaccaatatcattcccgtggaacaggtcatcacagcaatagtggccatttgtaaacaaatcaacaattcttccgggtatctgggagctatcggtgataggagccgggtattatacgccaacaatcagaccattggccagtatctgtacgagcgaatcaaggcaaaccctcatgaccgcattagaggggaagttttctataggcaagattacctcgacgagttcgaccggatatgggagtgccagcagaattactatccagctatccttacgaacgatcgcaaacagtttattagaaataggatcatcttctaccaacgtcccctgaagtcgaagaaatctgaattggccttttgtgagttcgaatcccgggaggtggaacacaacggaaagaaatatactgagggcctacatgtcgcgcctaagtcaagtccagtgttccagcactttcgactgtggcagagactcggtcagattgaggtgagcccgctgaggaaatggaacaagcaatccaatgaacttttcgagcagcagaacgacacagatcaggaacgcatactgaataccgaggccaagcaaaaattgttttcttacctcaacctgttagaccatctgactgataatgagatcctaaacattctcgggtatagccccgacaagtggaaaatcaatttccgggaaattatcggaaacagaacaaataactcaatgatgaaggcatttttcaatatgaaagagatgaccgatggcgaacagataaactgggagaagaatctgacgaaaatcaccaacggccagagtcttatttcccctgaacagatcgtcgacttgattaggcaatttttcgagcgcgaggggatcacaactagcctgctctactttgatccaaccacagacaatttccgagaacagtctcactattcactgtggcaccttctgtacagttacgaggatgacaacagccccactggaaccacatccttgtgcaagaccctcgctaagcggtatggtatacctcatgaactgtgtccattactggcctctctaacttttgagccccagtacggctcgctcagcacgaaagctatgcgtaagattctgccgttcatgcaagaaaacgggtatgacaaagcctgcgagcttgcaggatacagacactccgcctggacaaccaaggaggaaaatactgagaggaccttgaaaaactcactgcctctcctgcgcaagggcagtttacggaatcccgttgtggaaaagatcctgaaccagatgacacatgtaattaatacccacatctctgagtatggtaacccagatgaaataagaatcgagatggctagggacatgcaggcgaatagcaaacagcgaaaggcaatgactacagccattgctgaggccacgaaacgcaacacccaatttatcgaagagattcagaaggaatttgggttcaatccttccaaaaacgatcttatcaagtacaagttgtggaaagagctcgcacccctgggctcaaagactctatatagcaatacatacataccaaaagaggaactgtttaccgccaagttcgagattgaacacatcatcccccgggctctcttttacgacgattctttctccaacaaaacactggagcttaatagtgtgaacaagttgaagggaaataaaactgccctggactatatggataccttaagccaggaacaggcaaacgactacattatcagagtcgaggagctcaagaaaattggcgcgataacgcaagctaagtataaaaagctgcttatcagggaaaaagatctgggggacgattttaccaaccgtgacttgacaaatactcgctacattatccggcatgccgcagatatgctccttcaggtgaccccttctattgttcacacaaacggatccatcactgccatactaagaagggactgggagctgctcgacatcctgaaggaacttaatttgccaacctatgagtcaattgatcgaaagatcagtgacccgaaagaaaagctgacggagagcgtggagcggaaagatggtcaggctattaagatgatcaaagactggtcgaagcgcgatgaccatagacaccatgccatggatgcattaataacagctctcaccactaggaagcacgtccagtacctgaacggcaatcggggagccgaagagacagacaaagtgcaaaagctgcagcagctgaaagcgctacgaaagcaactcattggatccgatggccacttcattccccctatgcatgacatcagagtacaggccaaagaagctctgtctcgcgttatcataagcaccaaggcaaagggtaaagtgactaccccaaacacaaatatcatttgttcaagggataagacgaccgggcgtaaaatctatgtcaagcagactacattgacaccccggggcgccctgcacaaagagatgcagtacggatgcaaccattactatttagaaaagcaaattcctatcggcagtaagctcaccgaggaggaaataagactggtgtcctctccaaaaatcaggagcatgctttccgagcgcctgcaggcttacaataacgaccccaagtcagcctttactgggcgaaatagcatggataaaaagccgttggaagacaaaaacaagaagctcgtctataccgacaaaaaggtgaaacagacgattctggcaaatagattcgttaagcgggatagggtgaacagtaaactagacctggataaggtaatcgacacaggaattaaacgcatccttgagcgtagactcaagcagtacggtggcaagtatgagaccgcgttttctgatctggaaaataaccctatatggttgaacgaggaaaaagggattgccatcaagtccgtccggatcagggggaaaaataacactattaccatccgccaaacaaatacttgtcgaataaagtacgtggctaacgacaataaccaccacctggccgtttatgcattaccagatggcagcattgaggacgatatcgtgtcgttctttgacgctgtcgaaagatcacggaaaggtctccccattatcgataagcataagaatcagtctctggggtggaaattcctttttagtgtgaagcagaacgagtacttcctgttgcctcagcaaggcgagaaaatagacattgacaccggagaaatctccatgcagacaacgttcagccccaaggatctctctccagagtacatcatgaatcctgacaactatgccgaactggcaccccacatttttagggtacagagcatctccaaaaccccacagggcaatcgcgatgtgagaatttacctattcaagcaacagtatatatcagggagtcagaaggacagcctgcatcttaaaggaatcactcacaggcaaatttcttccgccaaggatctcgctggcctggttaaaatccgggtcaaccatttgggtcgtatcgtggcggtgggggagaagtga

SEQ ID NO: 3342 - RNA, 4287 nt, synthetic construct
  misc_feature 1..4287: note = Cas9 variant
  source 1..4287: mol_type = other RNA
atgaagaaaatcctgggcctcgaccttgggaccgccagcattggatccgcttacgtgctggaggcagaaaagtctgccgatcagacaaaaatagtctatttgggtactagaatcattttatcaagtgcggacgctgagaacttcagcaagggcctgtcctgctctcccacgaccgataggacatttaaacggtcgatgcgccgacgtctacaaagatacaagcagaggcggtcaagcctcatccagcagttcaagaaaattgggatcataactaataccgaacaaatcattcgcgagcctatcagtgaaacacacgagctgcttagaattaggtccaaggccgtttctgagcgggtgagcctggaagagtttgcacgcatcttgctcaccataaacaaacgaagaggatataagtccaataggaaaacttcaaagagtacagaagaggacggcaagctggtagatgccatggctgtgaccaaagagctgattaagctcaaaaagacgccaggtcagtacatgttcgaacggtttaaacgtgggaagtatgcagagatcgacttctacccgtttgatttaattaacgaactgaaacagatctgggaggtccagggacaaaagtatcccgacgtgcttactgaagatttgctgagctctctactcaagcagaaaaccggcaaggccaaagagctgatctactccaagtcagaccttaatcctgctgaggttccaattgattaccagaaaggcaagaagctgcgcaaaacaatattgaacaagtatttcgcctacgaaagcagaagtctcgcggtgactaatatcattcccgtcgagcaggcaatcaccgccatagtggctatttgtaaacaaatcaacaattcttccgggtatctgggagccatcggtgacaggagccgggtattatacgcaaacaatcagacaattggccagtatctgtacgaacgaatcaaggctaaccctcatgatcgcattagaggggaggttttctataggcaagactacctcgacgaatttgatcggatatgggagtgccagcagaattactatccagccatccttaccaacgaccgcaaacagtacattagaaataggatcatcttttatcaacgtcccctgaagtcgaagaaatctgagttggcgttctgtgaatttgagtcccgggaagtggagcacaacggaaagaaatacacggaaggcctacatgtcgcccctaagtcaagtccagtgttccagcacttccgactgtggcagagactcggtcagattgaggtgagcccgctgaggaaatgggataagcaatccaacgagctttttgaacagcagaataacgcagaccgcgaggggatactgaatactgaagctaagcagaaattgttctcttatctcaacctgttagatcatctgacagacaatgagatcctaaacattctcggatacagccccgataagtggaaaatcaattttcgggagattatcggcaacagaaccaataacctgatgatgaaggccttcttttcaatgaaagaaatgactgacggcgagcaaatagattgggaaaagaatcttacaaaaatcaccaacgggcagagtttgatttcccctgagcagatcgtcgacctgattaggcagttctttgaacgcgagggaatcacgaccagcctcctgtatttcgatccagctacagacaattttcgagagcaatctcactactcactttggcacctgttgtacagttatgaagacgataacagccccactggtaccacatccctctgcaagactctggccaagcggtacggcatacctcatgagttatgtccactgctagcatctctcaccttcgaacgtcagtatgggtcgctgagcacaaaagccatgagaaagctgttgccctttatgcaggagaaaaggtacgacgaggcttgcgaactggcgggatatcgccactccgcatggattaccaaggaggaaaatgccaaacggactctcaagaacaagctgccgttactgagaaaaggctcacttaggaaccctgttgtggagaagatcttgaatcaaatgacgcatgtaattaacacacacatcgctgaatacggtaatcccgatgagatacgaatcgaaatggcccgcgacatgcaggcaaacagtaaacagcggaaggccatgaccgctgccattactgaggcaaccaaaagaaatacacagttcatcgaggaaattcaaaaggagtttgggttcaacccatctaagaatgatctcatcaaatataagctgtggaaagaactagcgcctctgggcaacaagaccctctacagcaatatatacattcccaaagaggagctgttcactgctaagtttgaaatcgagcacatcattccaagggcccttttctatgacgattccttttcaaacaagacattggaactgaatagcgtgaacaaattaaagggaaataaaacggcactcgactacctggatacccttggccaggagaaggccaacgactatatcctgcgtgtcgaagagttgaaaaagattggggctataactcaggccaaatacaagaagctcctgatccgcgagaaagatctaggagacgatttcacaaatcgggacctgaccaacacaagatatattatcaggcatgcagctgacatgctccttcaggtgactccctctattgttcacaccaacggttccatcacggccatacttcgacgggattggggcttgctggacatcttaaaggaactcaatctgcctacctacgagagtattgatcgcaaaatcagcgacccagaagagaaacttacacaatctgtggatagaaaggacgggcaggcgattaagatgatcaaggattggtccaaaagggacgatcatcggcaccatgccatggacgctctgataactgcactaaccacacgaaagcacgtccagtatctcaacggaaattcaggcgccgaagagactgataaagctcagaagctggagcaattgaaagccctgagaaagcagttaattggtagtgacgggcactttatcccgcccatgcatgatatccgcgtgcaggcaaaggaagcgctcagcagggtaattatatcgaccaaagttaagggcaaagtgacgacacctaacaccaatatcatttgttcccgtgacaagactacaggacggaaaatctacgtcagacaaaccactctgaccccaaggggcgcccttcacctggacacaaagtacgggattaaccgctattaccaggagcgagaagtgtctatcggaagcaagttgacgcaggaggaaataagactcgtctcaagtccccatatccagtccattctgctagagcggctgagggctttcgataataaccctaaatctgcctttaccggtcgcaatagcgtggacaagaaaccacttgaggataagaacaaaaagctcgtttatactgacaagaaagtgaagcaaacaatcctggcaaatcgtttcgtaaaaagagatcaggtcaactccaagttgaatctggacaaagtgattgataccggcatcaagcggatattagaagggaggctccagcagtacggaggcaaatatgagacagctttttcagacctggaaaacaatcccatttggcttaacgaggagaagggtatcgccatcaagagcgttcgcattcgagggaaaaacaatgcaatcccgatacaccaaactgatacctgccctattgactacgtggccaacgataataaccaccatctggctgtctatgtgttgccagacggcacgatcgaagacgatattgtaacattctttgacgcggtggagagaagtcggcagggactccccatcgttgataagaataaaaaccagtctctgggctggaagttcctattttccataaaacagaatgaatacttcctgcttcctcaacaggccgagaagattgacatcgataccggggaaatcagcactcagaccacattctcgcccaaggacctctcaccagagtacattatgaaccctgataattatgcagagctggcttctcacatctttagggtccagagtatttccaaaactccccaaggaaaccgcgacgtgagaatatacttgttcaagcagcagtatatcagcggctctcaaaaagatagcttacatctgaagggtattacctacaggcagatctcctcagccaaagacctcgccgaactggtgaagatccgggtcaatcaccttgggcgtattgttagtgtgggagagaagtga

SEQ ID NO: 3343 - RNA, 4287 nt, synthetic construct
  misc_feature 1..4287: note = Cas9 variant
  source 1..4287: mol_type = other RNA
atgaccaagaaaatcctgggcctcgaccttgggacaactagcattggatgggcctacgtgatagagtccgataaccccgacgaatctgagatcaagcagattggtgtcagagttaatcctctgacgaccgatgaacaaacaaacttcgagaaaggcaagccattttcaatcaataaagaaaggactttgaagcgcggggctcggcgaaacttagaccgttataaggatagaaggaataacctgattgaggtgctcaaaaaggcaaatatcctaagtcaggacagcatactgaccgaggaaggacagcacacaacccatcagacttggcaacttcgggccaaagcggctgtagataagatcgagaaagaggaactggcccgcgtgttgctcgcaattaacaagaagagaggctacaaatcctctaggaaggccaaaaatgaggacgaaggtcaggctatcgatgggatggcagtcgccaagcggctgtatgacgagcagattacatgcggacagctggtgtaccaactcttacgcgaaggcaaaaagtcgatcccggatttctatcgatcagacctgcaggctgagtttgataaagtttggaacttccagaagcagttttaccccaagatacttaccgacgaattttataaagagttgaagggcaaagggcaaagagccacgagcgcgctgttttacaagacttacaatttcaacaccgcagagaataaaggaagtagggaagagaagaagattcaggcctataaatggcggtccgaagctatctctcagcaactagagaaggaagaggtggcctttgtcctcacagagattaacaataacctgaacaatagctccggttaccttggcgcaatctcagaccgtagtaaagaactgtatttcaacaagcagactgtggggcagtacttgtatcagcaactccaggagaatcgccacgctagactgaaaaaccaggtattttacaggcaggattatttagacgagttcgaagccatctggaaggaacaagcgaagcatcacaccgagctgacagaggaactcaaagccgagattcgggatataatcattttctaccagcgaaaacttaaaagccagaagggactgatctctttctgtgagttcgaatcccgcgagatacagattgacggcaaaaagaagaccatcggtttgagagttgcacctaaatcaagcccactatttcaagagttcaagatctggcagaatctgaacaatgtgctcgtcaggaaaaaggggagtcggaaacgcaacgtgaagcaggaaattcagggatctctgtttgaagaggaaaaagagatcttcgtgtttgatcttgagacgaaggaaaagctgttcgaggaattgaatctcaaaggcaacctgtccgctaataaggtcattgagttactgggccataaacccactgaatgggagataaactacagcgccctagaggggaatagaacaaaccaagctctctataatgcctacctgaagatccttgacattgaaggatatgatgaggacttgctgaaactctcggataaggacgatatcaacgttgcagacctgaagacccctgcctctgaaatcaaaaacatggtgagggacatttttcaggtacttggtatatccactgatatcctggagttcgacgctgaattggatggcaaggactttgagcagcaagcgtcataccagctctggcacctgttatatagttacgagggggatgacagccagtccggaaatgaaaaactgtatgagctactcgaaaagaaattcggctttaagaaggagcactctcaggtgctggcaaacgtcacacttagcgatgactacggtaatttgtcaagtaaagccatgcgtaagatttacccattcatcaaagagaacaattattccaccgcttgcgaactggccgggtaccggcatagcaagcactctctcacgaaagaggaaattgagaaccgacccctggatgacaagttagaactgcttaagaaaaattcattgagacaacctgtggttgagaagatcctcaaccagatggtgaatgtcgtgaacagtctgctagagaaaaataggaaggaaaacccagattttcgcttcgacgagatacggatcgaactggcaagagagctcaaaaagaatgccaaagaaagggctgagatgaccacaaacattaatagcgccaagactgagaacgaaaagatcttcaaactgcttcaggcagagtttggcttgaagaacccgacccgcaatgatattatccgatatcggctgtacgaagagttaaagaacaatggatataaggacctctacacaaacaaatatataccccgtgaaattctgttctccaagcaggtagacatcgagcatattatccctcaatctagactttttgatgactcgttcagcaataagactatagtttacagggagaccaacctggataaaggcaatcagacagcgtttgactacatcgattccaagtatgggaacgaaaaagtggaggaatacattttgcgcatcgaggctctccacgacgcctggaagaaaaataaggaggaaggaatttcaaaggcaaaatatcagaagctgctgaaaaaggagaccgaaatcggtgatggcttcatagagcgggacctaagagaaagtcagtacattgccaaaaaggctaaggagatgctctttaaaatcactaggtctgtcgtgagcacgtccgggtcaatcacagataagctgcgagaggactggggacttattaacatcatgaaagaattgaatctgccaaagtatcgcagcttaggcctcaccgagatgcaagaacggaaattcggtcagaaggtcgaggtgattaacgattggactaagagaaatgaccacaggcatcacgccatggatgcactgaccgttgcttttacaaaacataaccacatacagtaccttaattatctgaacgcccgtaagaacgaaaatcataaactacacaacaatatcattgcgatcgagaacctcgagaccgaaactatgattgacaataacgggtctaagcgccgggtgttcaaagcccccatgcctaattttagacaagtagctaaggagcacctggaaaacgtcttgatctcccataaagcaaagaataaggtggttacgaaaaacaagaataaaatagccggcaaggtggctgcccaggagacactgaccccaaggggacagttacacaaagaaactgtctacggcaagtaccagtattacgtgaacaaggaggagaaaatcgggacaaagttcgacgaagagaccattaataaagtaagtaacccccaatatcgaaagctcctgcttgaacggctgagcgcaaatggaaacgatccgaaaaaggcgttttctggtaagaatgccttgtccaaaaaccctatctacctcaacgagacaaagactgagaccgtgcccgaagttgtcaaactgacgtggctagaggaagactattcaattcgcaaggatatcaccccagacaatttcaaagatgagaagagtatagacaagattctggatgaaggcgtgaaaagaatccttaagaaaaggctccggaagaacgacaatgatcctaaaaaggctttcagcgacctggataaaaaccccatctggttgaatgaggagaaggggatttcgataaagcgagtgacaatctccggagtcaacaatgccgaaccactgcattacaaaaaggaccactttggcaacgacattttagatgagaaaggtgacaagatccccgttgatttcgtgtctactgggaataaccaccatgtggcagtatatagagacgaaaaaggcaatctccaggagaacattgtcagctttttcgaagctgtgatccgcgttaatcagggactgcctataatcgataaggcctacaaccagcaccttggctggcaatttctgttcaccatgaagcagaatgagatgtttgtgttcccaaacgagaaatcagggtttaacccgcaggaaattgacttgctcgatcccagtaataagaaaaagatctcccctaacctgttcagggtccagaaaatgtctaaggtgatttacggaaatagcccagttcgtgagtatgtgtttcggcatcacctagaaacaaacgtagacgagaagaaagaactgaaggatatcactttcaaaaatataaagtcccttggctacttcgaggacattgtcaaagtgagaatcaaccatctcggtgatatcgtgtcagtcggggagtattga

SEQ ID NO: 3344 - RNA, 4293 nt, synthetic construct
  misc_feature 1..4293: note = Cas9 variant
  source 1..4293: mol_type = other RNA
atgaagcacatcctgggcctcgaccttgggaccaacagcattggatgggccgtggtcaaagaggctcagaatgataacgaacaatccgagatagttgacgtgggtgtaagagtgaatcccctgacaactgatgaaaagacgaacttcgagaaaggcaagcctatctctaccaatgcagacaggacattgaaacggtcagcccgccgaaacttacagcgttacaagctgagaaggaaggaactaattgagctcctgaaagagcatcagcttatcagtactgataccattctgacagaaaatgggaagggaaccacttttcagacattggagctccgggcgaaaagcgctaaggaaaagatctccctggaggagctggcccgcgtcttcctcaccataaacaagaagagaggctataaatcttcgaggaaggccaaaaatgaagacgagggtcaattaatcgatgggatggaaattgcaaagcggctgtacgaggaaaaccttacgactggacagttgtcactgcagctactcaaagagggcaagaaaagcctgccagactattaccgcagtgatcttcagtttgagctggacaaggtgtggaatttccaaaagcagtttcactccgatatcttgaccgacgagttctatgctcagctcaaaggcaaggggcagcgagcaacatctgccctgtttttagctaaataccaaatttatactgccgagaacaagggaagcagagaagataaaaagctgcaggcgtaccagtggagggttgacgcactctccaaggagcttacccgggaacaactggccttcgtgatcacagagataaataacaatttgaacaactcaagtggttacctaggcgctattagcgaccgttctaaagagctgtattttaataacgaaaccgtcggggagtacctctggaagcagatcgccgcaaatccgcatacgtccctgaaaaaccaggtgttctatcgccaggattaccttgacgaatttgagcaaatttggaagactcagtcagctttctatcccgaaatcctgacagatgagttgaaaaaggagctcagagacgtagttatcttttaccagaggaagctgaaaagccagaagagtttagtgtctttctgcgagttcgaaaataaagaaattgagataaagaaagaggatggaacctccactaagaaggtcatcggcctgaaagtggcccctaagagctcgccactatttcaagagttcaaaatttggcagaacctcaataacgtgctgatccggaagaaaggttctaagaccaaaaaggtcgcgaagaatcagcaggccgttctttttgaagaagagaaaaccatatccgaattggacctggaggcaaagcaagctctcttcaacgagctgaatcttaaagggaacctgaaggccgattattgtttggaaattctcggatactcacccaaagagtgggaaatgaattacagtgtgctggagggcaaccgaacgaataaggctttatatgaagcctacctgaagatcaccgacctagagggctatgatgccaaaaaccacctcaaggtaaaactgaacaaggacgaggtggaacttgatgacttgaaagtccctgcaagcgagatcaaggacatggtgcaggctatttttaaggaagcggggatcaatacagatattctgcatttcaacgcagagctcgacggaaaagattttgaaaatcaggcctcctaccagctgtggcacttactgtattcttacgagggtgacgatagcaagtcaggcaacgagcttttgtataaactcctggaaactaagttcgggtttaaaaaggagtacgctcaaatactagccaatgttagtctgtccgacgattacggaagcctctctaccaaggcaatgcgcaaaatccacccatatattaaggaaaacaaattctcaacagcctgcgagctggctggctacagacatagtaagcacagccttactaaagaggaaaatgacaacagggtgttgaaggattccctggaggtcttaaagaaaaattctctccggcagcccgtggtagaaaagatcctgaaccagatgatcaatcttgttaacgccctgttgaaaaagtatcgcaccgagaatcctaactttaaattcgacgaaattagaatagagctcgcaagggagctgaagaaaaatgcggaggaacgtgctaacatgacagccaacatcaataaggcaaagaccgaacatgagaaaattatcaagattctgaaaaacgaatttggtctaccaaatccgactcggaacgatatcatacgatacagactctatgaggagctgaaggccaatgggtacaaagacctttatacgaacatcaagattccccaagaaaagttgttcacaaaagagatcgatattgaacacatcatacctaagtcgagggtgttcgacgacagcttttccaataaaaccctgtcattccgcaagactaacttagataaaggcgagcggaccgcttttgactacatggaaagtaagttcggagccgataagctcgaggagtacgtcgcaagagtggaagacctgtataaaaataacattatctctaaggctaaataccagaaacttctgaaaaaggagagcgaaattggcgatgggtttgtcgagagggacctacgcgagacacagtatatcgccaagaaagcgaaggaaatactcctgcagatcaccccaaatgtgttgtccacttcaggaggtattacagatcgactgcgggaggactgggatttaatcaacgttatgaaagaactcaatctgcccaagtaccgtgcccttggcctgacgcaaatggaggacagaaaatatgggcaacaggtggaagtaattaccgattggactaagaggaacgaccaccgccatcacgctatggatgcattgacagtcgccttcaccaaacataatcacatccagtacctcaactatctgaacgctcggaagaatgagaagcataaagagcacagcaacataatgggcattcagcagctagaaacaatcaaggtgactgacaaaaatggaaacgagaagagagtttttaaagcccctatgccaaatttccgacaggtgaccaaggcatttctggaaaacatccttatttctcacaaggcgaaaaataaggtcgtgacgaaaaacaagaataaagtagccggttccaacaaggtgcaggaggttctcacacccagggggcaactgcataaggaaacagtctacggcaaataccagtattacgtgcagaaggaggagaaaatcggagctaagttcgacttggaaactattaaaaaggtggccaatccgctgtatcaaagtttactcaagaaacgcctggaggaaaacggcggggatcctaagaaagcatttaccggaaagaatagccttgctaaaaaccccatatacctggacgatacacagactgagcagttgccagaaaaggtcaaactcgtttggctggaaaattctttctccatccggaaggacattacccctgagaactttaaggatgaaaaactaatcgacaagattctggatgagggtgtgaaaagaatccttaaggaaaggctccagtcattcggcaatgacgccaaaaaggcattcagtgatctggacaagaaccccatatggttgaacaaagagaaggggatcacgattaaacgtgtgacaatcagcggagtagccaatgctgagccattacacaccaagaaagatcatctgggcaaggaaattctcgacaaggagggtaaacccatccctgtcgactttatatcgactgggtccaaccaccacgtggcggtttatcgcgatgaaaagggcaatctgcaagagaaagtggtctctgtgttcgaagccgttgtgcgggcaaaccagggacttccaattatcgacaagacatacaatcagcatctgggctgggagtttttgttcaccatgaaacagaacgagatgtttgtattcccgaatgaaagcactgggtttaaccccaatgatatcgacctactggatcctaagaacaagagaattatatcaccaaatctcttcagggtccaaaaatttagtaagctgcagtatggaaactccttcgtgcgagagtttgtgttccggcaccatcttgaaaccacagtcgaggaccgcaaagaattacagggcatcacgtacaagcagatgaaaaattctaccttctttaacgatattatcaaggttagaattaatcacctgggtgacatcgtgagcataggggagtactga

SEQ ID NO: 3345 - RNA, 4293 nt, synthetic construct
  misc_feature 1..4293: note = Cas9 variant
  source 1..4293: mol_type = other RNA
atgaagcacatcctgggcctcgaccttgggaccaacagcattggatgggccgtggtcaaagaggctcagaatgataacgaacaatccgagatagttgacgtgggtgtaagagtgaatcccctgacaactgatgaaaagacgaacttcgagaaaggcaagcctatctctaccaatgcagacaggacattgaaacggtcagcccgccgaaacttacagcgttacaagctgagaaggaaggaactaattgagctcctgaaagagcatcagcttatcagtactgataccattctgacagaaaatgggaagggaaccacttttcagacattggagctccgggcgaaaagcgctaaggaaaagatctccctggaggagctggcccgcgtcttcctcaccataaacaagaagagaggctataaatcttcgaggaaggctaaaaatgaagacgagggtcaattaatcgatgggatggaaattgccaagcggctgtacgaggaaaaccttacgactggacagttgtcactgcagctactcaaagagggcaagaaaagcctgccagactattaccgcagtgatcttcagtttgagctggacaaggtgtggaatttccaaaagcagtttcactcccatatcttgaccgatgagttctatgctcagctcaaaggcaaggggcagcgagcaacatctgccctgtttttagctaaataccaaatttatactgccgaaaacaagggaagcagagaagacaaaaagctgcaggcgtaccagtggagggttgatgcactctccaaggagcttacccgggaacaactggccttcgtgatcacagagataaataacaatttgaacaactcaagtggttacctaggcgctattagcgaccgttctaaagagctgtattttaataacgaaaccgtcggggagtacctctggaagcagatcgccgcaaatccgcacacgtccctgaaaaaccaggtgttctatcgccaggactaccttgatgaatttgagcaaatttggaagactcagtcagctttctatcccgaaatcctgacagacgagttgaaaaaggagctcagagatgtagttatcttttaccagaggaagctgaaaagccagaagagtttagtgtctttctgcgagttcgaaaataaagaaattgagataaagaaagaggacggaacctccactaagaaggtcatcggcctgaaagtggcccctaagagctcgccactatttcaagagttcaaaatttggcagaacctcaataacgtgctgatccggaagaaaggttctaagaccaaaaaggtcgataagaatcagcaggcggttctttttgaagaagagaaaacaatattcgaattggacctggaggccaagcaagcactctttaacgagctgaatcttaaagggaacctgaaggcttattactgtttggaaattctcggatactcccccaaagagtgggaaatgaattattcagtgctggagggcaaccgaacgaataaggccttatacgaagcatatctgaagatcaccgatctagagggctacgacgccaaaaaccatctcaaggtaaaactgaacaaggatgaggtggaacttgacgatttgaaagtccctgcaagtgagatcaaggacatggtgcaggccattttcaaggaagctgggatcaatacagacattctgcactttaacgcggagctcgatggaaaagacttcgaaaatcaggcaagctatcagctgtggcacttactgtactcctatgagggtgatgactctaagagcggcaacgagcttttgtacaaactcctggaaactaagtttgggttcaaaaaggagtacgcccaaatactagctaatgtttcactgagtgatgactatggatccctcagcaccaaggccatgcgcaaaatccatccatacattaaggaaaacaaattttctacagcatgcgagctggccggctatagacactcaaagcatagtcttactaaagaggaaaatgataacagggtgttgaaggacagcctggaggtcttaaagaaaaattccctccggcagcccgtggtagaaaagatcctgaaccagatgatcaatcttgttaacgctctgttgaaaaagtaccgcaccgagaatcctaacttcaaatttgatgaaattagaatagagctcgccagggagctgaagaaaaatgcagaggaacgtgcgaacatgacagtgaacatcaataaggctaagaccgaacacgagaaaattatcaagattctgaaaaacgaatttggtctgccaaatccgactcggaacgacatcatacgatatagactctacgaggagctgaaggccaatgggtataaagatctttacacgaacgaatacatcgagaagcaagacttgttcacaaagaatattgatatcgaacacattatccccaaatctagggtcttcgacgactcgttcagcaacaagaccctgtcctttcgcaaaactaatttagataagggcgagcggaccgcattcgactatatagaatcaaaatttggagccgataagctcgaggagtacgtggctagagtcgaagacctgtataagaacaatattatcagtaaagccaagtaccagaaacttctgaagaaagagtctgaaattggcgatgggttcgtggagagggacctacgcgagacacagtatatcgcaaagaaggctaaagaaatactcctgcagatcacccctaacgttttgagcacttccggaggtattacagatcgactgcgggaggactgggatttaatcaatgtgatgaaggaactcaacctgccaaaataccgtgcccttggcctgacgcaaatggaggacagaaagtatgggcagcaggtagaagtcattatcgattggaccaaaaggaatgaccatcgccaccatgcgatggatgccttgactgtggcttttacaaagcacaaccatatacagtacctcaactacctgaatgcacggaaaaacgagaagcacagagagcactcaaatattatgggaatccaacagctagaaaccatcaaggttacagacaaaaacggcaatgagaagagggtgttcaaagcccccatgcctaactttcgacaggtcactaaggctttcctggaaaatgtgcttattagccataaagccaagaacaaggtagtgaccaaaaataagaacaaagttgcaggttctaataaggtccaggaggtgctcacgccacgcgggcaactgcacaaagaaaccgtgtatggcaagtaccagtattacgtccagaaggaggagaaaatcggaggcaagtttgacttggaaacaattaaaaaggttgcgaaccccctgtatcaatccttactcaaaaagcggctggaggaaaatgggggagatccgaagaaagccttcactggtaagaacagtcttgctaaaaatcctatatacctggacgatgcccagaccgagcagttgcccgaaaaggtgaaactcgtgtggctggagaacagcttttctatcagaaaggacattacaccagagaatttcaaagatgaaaagctaatcgacaagattctggatgagggcgtaaaaaggatccttaaggaacgtctccagtccttcgggaacgacgctaaaaaggctttttcagatctggacaaaaaccctatatggttgaataaggagaagggaatcgccattaaacgcgtcgcaatcagtggcgtggccaacgctgagcccttacatactaagaaagatcacctgggtaaggaaattctcgacaaagagggcaagagcatcccagttgacttcatatcgaccgggaataaccaccatgtggcggtctatcgggatgaaaagggaaatctgcaagagaaagtggtttccgtgtttgaagccgtagtcagagcaaaccagggccttcccattatcgacaagacgtacaatcagcacctggggtgggagttcttgtttacaatgaaacagaacgagatgttcgtgttttctaatgaaagcaccggattcaaccctaatgatatcgacctactggatccaaagaacaaaaagattatatcaccgaatctctttagggtgcaaaagttcagtaaactgcagtacggcaactcctttgtccgagagttcgttttccggcatcaccttgaaactacagtggaggaccgcaaggaattacagggtatcacctataaacagatgaaaaattctgcatttttcaacgatattatcaaagtaagaattaaccatctagggggaatcgtgagcgtcggcgagtactga

SEQ ID NO: 3346 - RNA, 4293 nt, synthetic construct
  misc_feature 1..4293: note = Cas9 variant
  source 1..4293: mol_type = other RNA
atgaaggacatcctgggcctcgatcttgggaccaacagcattggatgggccgtggtcaaagaggctcagaatgacaacgaaacatccgagatagttgatctgggtgtgagagtaaatcccttgactacggacgaaaagaccaacttcgagaaaggcaagcctatctctacaaatgcagataggactttaaaacggtcagcccgccgaaacctgcaacgttacaagctaagaaggaaggaactcattgagctgcttaaagagcaccagctgatcagtaccgacacaattttgaccgaaaatgggaagggaactagctttcagacactcgagctgcgggcgaaatccgctaaggaaaagatctctctggaggagctcgcccgcgtgttcttaaccataaacaagaagagaggctataaatcgtcaaggaaggccaaaaatgaagatgagggtcagctgatcgacgggatggaaattgcaaagcggctttacgaggaaaacttgacgactggacaactgagcctacagctcctgaaagagggcaagaaaagtcttccagattattaccgctccgacctgcagtttgagttggataaggtctggaatttccagaagcaatttcattctcacatcctcaccgacgagttctatgctcagctgaaaggcaaggggcagcgagcaacaagcgccttatttctggctaaataccagatttatactgccgagaacaagggatccagagaagataaaaagctccaagcgtaccagtggagggtggacgcactttcaaaggagctgacccgggaacagttggccttcgttatcacagagataaataacaatctaaacaacagtagcggttacctgggcgctatttctgaccgttccaaagagctctattttaataacgaaaccgtgggggagtacctgtggaagcaaatcgccgcaaatccgcatacgtcacttaaaaaccaggtcttctatcgccaggattacctggacgaatttgagcagatttggaatactcaagctcagttctatccccagatcttgacagatgaactcaagaaagagctgagagacgtggtaatcttttaccagaggaagttaaagagccagaaaagtctggtttctttctgcgagttcgaaaacaaggagattgaaatcaaaaaggaggatggaacctccactaaaaaggtgataggcctaaaggtcgcccctaaaagctcgccactctttcaggagttcaagatttggcagaatctgaacaatgtgcttatccggaaaaagggttctaaaacaaagaaagcggccaagaaccagcaagcagtgttgtttgaagaggaaaagaccatatccgagctggacctcgaagctaaacaggccctgttcaatgagcttaacctgaaggggaatttgaaagctgattattgtctcgagattctgggatactcacccaaggaatgggagatgaactacagtgtcttagaaggcaatcgaacgaacaaagccctgtatgaggcatacctaaagatcaccgacctcgaaggctatgatgccaagaaccacctgaaagttaaacttaataaagacgaggtggagttggatgacctgaaggtacctgctagcgaaatcaaagacatggtgcaggcgatttttaaggaggcagggatcaacacagatattctccatttcaatgccgaactggacggaaaggattttgagaaccaggcttcctaccaattatggcatctgctttattcttacgaaggtgacgatagcaaatcaggcaatgagttgctctataagctgctagagactaaattcgggtttaagaaagaatacgcccagatactggcaaacgtcagtctctccgacgattacggaagcctgtctaccaaggccatgcgcaagatccacccatatattaaagagaataagttctcaacagcttgcgaacttgccggctacagacacagtaaacacagcttgactaaggaggagaacgacaatagggtgctgaaagattccttagaagttctcaagaaaaactctctgcggcagcccgtggtcgagaagatccttaatcaaatgatcaacctggtgaatgcattgctcaagaaatatcgcaccgaaaaccctaattttaagttcgacgagattagaatagaactggcgagggagctgaaaaagaacgctgaggaacgtgccaacatgacagcaaatatcaacaaagccaagaccgagcatgaaaagattatcaaaattctaaagaatgagtttggtctcccaaacccgactcggaatgatatcatacgatacagactgtatgaggaacttaaagctaacgggtacaaggacttgtatacgaatatcaaaattccccaggagaagctgttcacaaaggaaatcgatattgagcacatcatacctaaatcgagggtattcgacgacagcttttccaacaagaccttatcattccgcaaaactaatctcgataagggcgaacggaccgcctttgactacatggagagtaaattcggagcagataagctggaagagtacgttgctagagtggaggacctttataagaacaatattatctctaaagccaagtaccagaaactgctaaagaaagaaagcgagattggcgatgggtttgtcgaaagggacctccgcgagacacagtatatcgcgaagaaggccaaagagatactgttgcaaatcaccccaaacgtgctgtccacttcaggaggtattacagatcgattacgggaagactgggatctcatcaatgtcatgaaggagctgaaccttcccaaataccgtgctctgggcttgacggaaatggaggacagaaagtatgggcaacaggtggaagttattatcgattggaccaaaaggaatgaccaccgccatcacgcaatggatgccctcactgtggctttcacaaagcataaccacatacagtacctgaactatctaaatgcccggaaaaacgagaagcataaggagcacagcaatattatgggaatccaacagctggaaaccatcaaagtaacagacaagaacggcaatgagaaaagagtctttaaggcacctatgccaaacttccgacaggtgactaaagcgtttcttgaaaatattctcatctctcacaaggccaagaacaaagttgtgaccaagaataaaaacaaggtcgctggttccaataaagtgcaggaggtactgacgcccagggggcaattgcataaggaaaccgtgtacggcaagtaccagtattacgttcagaaagaggagaagattggaggcaaattcgacctggaaacaataaagaaagtcgccaacccgttatatcaaagtctcctgaagaagcgccttgaggaaaatgggggagatcctaaaaaggcatttactggtaaatacagcctggctaagaaccccatctatttggacgatgcccagaccgagcagctcccagaaaaagtgaagctggtgtggctagaaaattctttctccattcggaaagacatcacacctgagaactttaaggatgaaaagctgattgacaaaatccttgatgagggcgtcaagagaatactcaaagaaaggctgcagtcattcgggaatgacgcaaagaaagccttcagtgatttggacaagaaccccatctggttaaacaaggagaaaggaattactatcaagcgtgttaccattagcggcgtggctaatgcggagccactgcacacgaaaaaggatcatctcggtaaagaaatcctggacaaggaggggaagcccatacctgtggactttatttcgacaggctccaaccaccacgtagccgtctaccgcgatgaaaaaggaaatcttcaagagaaggtggtttctgtgttcgaagcagtcgtgcgggctaaccagggcctgccaatcatcgacaaaacctataatcagcatttggggtgggagtttctattcactatgaagcagaacgagatgtttgttttcccgaatgaaagcacaggatttaaccccaatgatattgacctgctcgatcctaaaaacaagagaataatctcaccaaatctgttcagggtgcaaaccattagtgtagtcaagtacggcaacgccatcgtgcgagactttaaattccggcaccatcttgagactaccgtggaagataagaaagagttacagggtaagacataccagcagattaaatccctgtctcccctcaatgacatcataaaggtccgcatcaaccacttgggggatattgttagcgtgggagaatattga

SEQ ID NO: 3347 - RNA, 4293 nt, synthetic construct
  misc_feature 1..4293: note = Cas9 variant
  source 1..4293: mol_type = other RNA
atgaagcacatcctgggcctcgaccttgggaccaacagcattggatgggcctacgtgaaagaggctgaaaatgatacagagacttccgaaatagtcgacctgggtgttagagtgaaccccttgacgaccgatgagaagacaaatttcgaaaaaggcaagcctatctctactaacgcagacaggaccttaaaacggtcagcccgccgaaatctgcagcgttataagctaagaaggaaggagctcattgagctgcttaaagaacatcaactgatcagtgagaacacaattttgaccgaaaatgggaagggaactacatttcagaccctcgagctgcgggcgaaaagcgctaaggagaaaatctccctgggcgaactcgcccgcgtattcttaacgataaacaagaagagaggttacaaatcttcgaggaaggcaaagaatgaggatgaagggcagctgatcgacggaatggagattgccaagcggctttatgaagagaacttgactaccggccagctgtcactacaactcctgaaagagggcaagaaaagccttccagattactatcgcagtgacctgcagtttgaattggataaggtgtggaatttccagaagcagtttcactccgacatcctcacagatgagttctacgctcaactgaaagggaagggacagcgagcaacttctgccttatttctggctaaatatcagatttacaccgccgaaaacaagggtagcagagaggacaaaaagctccaggcgtaccaatggagggtcgatgcactttccaaggaactgacacgggagcagttggccttcgtgatcaccgagataaataacaatctaaacaactcaagtggctatctgggggctattagcgaccgttctaaagaactctactttaataacgagacggttggagaatatctgtggaagcagatcgccgcaaatccgcatacttcccttaaaaaccaagtgttctaccgccaggactatctggatgagtttgaacagatttggaatacacaggctcaattctacccccagatcttgaccgacgagctcaagaaagagctgagagatgtcgtgatcttttatcagaggaagttaaagtcacagaaaagcctggtaagtttctgcgagttcgaaaacaaggaaattgagatcaaaaaggaggacggcacttctaccaaaaaggttataggtctaaaggtggcccctaaatccagcccactctttcaagagttcaagatttggcagaatctgaacaatgtccttatccggaaaaaggggtcgaaaacaaagaaagcggccaagaaccagcaggcagtgttgtttgaagaagagaagacgatatctgaactggatctcgaggctaaacaagccctgttcaatgagcttaacctgaagggaaatttgaaagctgactactgtctcgaaattctgggctactcccccaaggagtgggaaatgaactattcagtgttagagggcaatcgaaccaacaaagccctgtacgaagcatatctaaagatcacagatctcgaggggtacgacgccaagaaccacctgaaagtcaaacttaataaagatgaggttgaattggacgatctgaaggtgcctgctagtgagatcaaagaaatggtacaggcgatttttaaggaggcaggaatcaacactgacattctccatttcaatgccgaactggacggtaaggattttgagaaccaggctagctatcagttatggcatctgctttactcctatgagggcgacgattctaaaagcgggaatgaattgctctacaagctgctagagaccaaattcggatttaagaaagaatacgcccaaatactggcaaacgtgtcactcagtgacgattatggcaatctgtccacaaaggccatgcgcaagatctacccatatattaaagagaacaagttcagcactgcttgcgagcttgccggttacagacactctaaacactcattgaccaaggaagagaatgacaacagggtcctgaaagatagtttagaagtgctcaagaaaaatagcctgcggcagcccgttgtggagaagatccttaaccagatgatcaatctggtcaacgcattgctcaagaaatatcgcacagaaaatcctaactttaagttcgacgagattagaatagagctggcgagggaactaaagaagaacgctgaggaacgtgccaatatgaccgcaaacatcaataaagccaagactgagcacgaaaagattatcaaaattctgaagaacgagtttgggctcccaaatccgacgcggaacgatatcatacgatacagactgtatgaggaacttaaagctaatggctacaaggacttgtacacaaacatcaaaattccccaagagaagctgttcaccaaggaaatcgatattgagcatatcatacctaaatccagggtgttcgacgattctttttcgaataagactctcagcttccgcaaaaccaacttagacaagggagaacggacagcctttgactatatggagtccaaattcggcgcagataagctggaggaatacgtagctagagttgaggacctttataagaataacattatctcaaaagccaagtaccagaaactgctaaagaaagaaagtgagattggggatggatttgtggagagggacctccgcgaaacccagtatatcgcgaagaaggccaaagagatactgttgcagatcactcgaaatgtcctgtctacaagcggtggcattacggatcggttacgtgaagactgggatctcgtgaacgtcatgaaggagctgaatcttccaaaatacagagctctggggttgaccgaaatggaggacaggaagtatggacaacaggtggaggttatcattgattggactaaacgcaacgaccaccggcaccatgcaatggatgccctcacagtggctttcaccaagcacaaccatatccagtacctgaattacctaaacgccaggaaaaatgaaaagcacagagagcattccaacataatgggcattcagcaactggaaacaatcaaggtaactgacaaaaatggtaacgagaagcgagtctttaaagcacccatgcctaatttccgccaggtgaccaaggcgtttcttgaaaacgttctcatctcacacaaagccaagaataaggtggtcacgaaaaacaagaataaagtggctgggagcaacaaggtacaggaggtgctgaccccacggggccagttgcacaaagagacagtttatggaaagtaccaatattacgtccagaaggaagagaaaattggcgggaagttcgatctggaaactatcaaaaaggtggccaatcccttatatcagtctctcctgaaaaagagacttgaggaaaacggaggtgacccgaagaaagcatttaccggcaaaaattccctggctaaaaaccctatttacttggacgatgcccaaacagagcagctccccgagaaggtgaaactggtctggctagaaaatagtttcagcataaggaaggacatcactccagagaactttaaagatgaaaagctgattgacaagatccttgatgagggggttaaacgtattctcaaggagcgcctgcagtctttcggaaacgacgccaaaaaggcattctccgatttggacaaaaatcctatctggttaaacaaggaaaagggcataaccatcaaacgggtgacgatttcaggtgtggctaatgcggagcccctgcatacaaagaaagatcacctcgggaaggaaatcctggacaaagagggcaagccaattcccgtagattttatcagtaccggaagcaaccatcacgtcgccgtgtatagagacgaaaagggcaatcttcaggagaaagttgtgtcggtcttcgaggcagtggttagggctaaccaagggctgcctataattgacaagacttacaatgaacacttgggatgggagtttctattcacaatgaaacagaacgaaatgtttgtgttcccaaatgagtccaccggctttaacccgaatgatatcgacctgctcgatcccaagaacaaacgaatcatttctcctaatctgttccgggtacagactataagcgtcgtgaagtacggtaacgccatcgtgcgcgactttaagttcagacatcaccttgaaaccacagtcgaggataaaaaggagttacaggggaaaacgtatcaacagattaagtcactgagtccactcaatgacatcattaaagttaggatcaaccatttgggagatatagtgtccgtaggcgaatactga

SEQ ID NO: 3348 - RNA, 4293 nt, synthetic construct
  misc_feature 1..4293: note = Cas9 variant
  source 1..4293: mol_type = other RNA
atggcccagaagtacatcctgggcctcgaccttgggaccaacagcattggatgggctgtggtcaaagaggcagaaaatgataacgagcaatccgaaatagttgacgtgggtgtaagagtgaatcccctgacaactgatgagaagacgaacttcgaaaaaggcaagcctatctctaccaatgccgacaggacattgaaacgaggggcgcgccgaaacttacagcgttataagctgagaaggaaggagctaattaaaatcctcaaggagcaccagctgatttcagatgacactatccttgctgaaaatggaaaaggcaccacataccagaccctgaagttgcgggccaaaagtagcaaggagaagatatccctcgaggaactggcacgcgtctttctgactatcaacaaaaagagaggttataaatcttcgaggaagacaaagaatgaggatgaagggcaactcattgacggaatggagatcgccaagcggttatacgaagagaacctgaccacgggccagctttcattgcagctgctaaaagaaggcaaaaagagcctcccagattattaccgcagtgacctggagcttgagctggataaagtgtggaatttccagaagcaatttcattccgacattttgactgatgagttctatacccagctcaaagggaagggacagcgagctacatctgcactgtttttagaaaaataccagatctacactgttgaaaacaagggtaatagagaggaaaagaacctgcaagcctatcagtggagggtggacgctctcagcaaagagcttacccgggaggaactggccttcgtcataacagagattaataacaacttgaataactcctcaggctacctaggggcgatcagtgaccgtagcaaggaactgtattttaataacgagaccgtgggagaatacctctggaaacagattgcagccaatccgcacacgtctctgaagaaccaagtattctatcgccaggattaccttgacgagtttgagagaatctggaatactcaggctcagttctatccccaaatcctgacagaatccttgaaaaaggagctcagggatgttgtgatattttaccagcggaagctgaaatcacaaaagagcttagtcagtttctgcgaatttgagaacaaagagattgaaatcaagaatgaggacggcaccactaccaaaaaggtgattggtctgaaggtggcccctaaatcttccccactattccaggagttcaagatctggcagaacctcaataacgtcctgatacggaaaaaggggagcaaaacagaaaaggttgctaaaaatcaacaggtggtactttttgaagaggagaagacgatttcggaattggatctggaggcaaagcaggccctcttcaacgaactgaatcttaaaggaaacctgaaggcggactactgtttggagatcctcggctattcttccaaagaatgggagatgaactactcagtgctggagggcaatcgcaccaacaaggccttatatgaagcatacctgaaaatcacagatctagaggggtatgacgctaagaattacctcaaggtcaaaagtaacaaggatgaagtggagctggacgatcttaaagttcccgccagcgaaattaaggagatggtgcaggctatctttaaagaggccggaattaatactgacatattgcatttcgacgcagaactggatggtaaggactttgagaaccagggctcctataagctctggcacctgttatactcttacgaaggggatgacagcaaatcaggaaatgagctgctttataagttgctcgagaccaaattcggcctgaagaaagaatacgcccagatcctagctaacattagtctgtccgatgactatggtaatctcagcacaaaggcgatgagaaagatccatccttacatcaaagagaacaagttttctactgcatgcgaactggccgggtataggcactcaaaacacagtcttaccaaggaggaaaatgagaaacgggtcttgaaggatggcctggaggtgctcaaaaagaacagcttacgccagccagtagttgaaaagattctgaatcaaatgataaaccttgtgaatgctctgttgaaaaagtacagaacagagaaccccaacttcaaatttgacgaaatcaggattgagctcgcccgtgaactgaagaaaaatgcagaggagcgggccaacatgaccgctaatatcaacaaggccaagactgaacatgagaaaattgataagatcctaaaatccgagttcggactgcctaatccaacgcgaaacgacataatcagatataggctctacgaagaactgaaggcaaatggctacaaagatctttatacaaaccgctacatttcttcggagaagttgtttagcaaggagatcgacattgaacacatcataccgaaatcccgggtcttcgatgactcatttagtaataagaccattgtgtatagaactgacaacctggataaaggggagcagaccgcgtacgactatatcgaatctaagttcggagctgagaaattaaaggagtacatgacaagggtcaaggatctctatcagaaaaagattatcagcaaagccaagtaccaaaaactgcttaagaaggaatccgagataggtgacggcttcgtggaacgcgatctgcgagagacccagtacatcgccaaaaaggcaaaagaaattctactccagatcactcataatgttctgtcaacaagcgggggaattacggaccggttgcgtaaggattggggcctggtgaacgtaatgaaagagttaaatctccccaagtatagagctctgggtcttaccaaaatggaggacaggaagtacgggcagcaagtcgaagtgatcactgattggacaaagcgcaacgacctgcggcaccacgccatggatgcattgaccgttgcttttacaaaacataatcacatacagtatctcaactacctgaacgccagaaagaatgagaaacataaggaacacaacaatattatggcgatccagcagctagagactatcaaagtgaccgacgaaaacggcaatgagaagaggattttcaaggcccctatgccaaactttcgacaagtcgctaaaacgttcctggagaatgtgcttatctctcataaggccaaaaacaaggtagtgaccaaaaataagaacaagatttccggaagtaataaagttcaggaagtcctcacaccccgcggccagctgcacaaggagactgtgtatgggaaataccagtattacgtgcaaaaggaagagaaaataggagcaaagtttgatagcgaaaccatcgagaaggtcgctaaccctttgtaccagtctctgctcaaaaagcggttagaggaaaatggtggcgaccccaaaaaggccttcacagggaaaaactccctggcaaagaatccaatttatcttgacgatactcagaccgagcaactgccggaaaaagttaagttggtgtggctcgagaactcatttagtatcagaaaggacattacgcctgagaatttcaaagatgaaaagctgatcgacaaaatactagatgagggagtgaagaggatcctgaaagaacgtcttcagagctttggcaacgacgcgaagaaggccttctcggatctcgagaaaaaccccatttggctgaataaggaaaaaggtatcgctattaagcgcgtaacaatctccggggtcgccaacgcagagccattgcacaccaaaaaggaccatttaggcaaggagatactggataaagaaggaaagcctattcccgtggactttatctctactggcaataaccaccatgttgctgtgtaccgggatgagaaagggaatctccaggaaaaggtcctgagcgtgttcgaggccgttgtgagagcaaaccagggacttccaatcattgagaaaacatataatcaacacctgggctgggaatttttgttctcaatgaagcagaacgagatgttcgtatttcccaatgaaagtaccggtttcaaccctaatgacatagacctactggatccaaagaacaaaaggatcatttccccgaatctctttaaggtccagaaactggccactaagaactacatgttcacccaccatcttgagacaaaatctatcgacggggatatgttaaagaataaaaaggaactgagcggcattctctataactttatccagacgccccaaaagttgtacggaataatcaaagtgcgaattaaccacctgggtgacatcgtgtccgtcggcgagtattga

SEQ ID NO: 3349 - RNA, 4296 nt, synthetic construct
  misc_feature 1..4296: note = Cas9 variant
  source 1..4296: mol_type = other RNA
atgaagagaatcctgggcctcgaccttgggagctcctctattggatgggccctggtgaacgaggctgaatcaaagaatgagaggagtagcatagtcaagttgggtgttcgggtgaaccccttaaccgtagatgaatccatcaatttcgagaaaggcaagtctattacaactaacgcagaccgcacgctgaaacgatcgatgcgtagaaatctacacaggtacaagctccggcgcgaagccctgatcgaggtgcttaaggagtgcaaatttattaccgaagatacaatcctgtcagagaacgggaatagaactaccttcgaaacatataggttgcgggtcaaggcgctcaccgaggagataagcctggaagagtttgctcgcgtgctgatcatgattaacaaaaagcgaggatacaaaagttccagaaaggccggcggtgcagaagaggacactctcatcgatgggatggacattgccaggaagttatatgatgctaatctgacacctggagaactttgtttgcagctgctatctgcaggcaaaaaggttctcccagacttctaccggagcgatctgcaaaacgagcttgaccgtatctgggagaaacagaaggaatattacccgggcatactgaccgccgctttgaaagaggaactccgcgggaagaaaagagatgccgtgtgggcgatttgcgcaaatgcctttgtctggaaggagacgtatactgaatggaacaatgaggagtccaagaacgaacagatcgagaaagaacataagctggagggaatttactcaaaaaggaagcgggacgaagctaaaaaggagaatttacagtggcgagtgagtggtctgaaggagaaactcagccttgaacaactggtaatcatcttgcaggagattaacacccagataaacaattcttccggctacctagggacaatctcagatcgcagcaaggaactgtatttcaacaaacagactgttggacaatacctcatggacattctggacaataaccccaatgccagtcttagaaacatcgtgttttataggcaggattacctggacgagttcaatgtcttgtgggagaagcaggcagaatttcacaaagagctcaccggcgaactgaagaaggagatacgggatattatcatcttctatcagcgcagattaaaatctcaaaagggtctgatttccttttgtgagttcgagagcaggcagatcgaggtgaaaattgacgggaagcgtaaaatacggacagtgggaaaccgagtcatccctagatcgtctccactatttcaggagttcaagatttggcaaatcctcaataacatcgaagttaccgctgtgggcaataagaacaaacagaggatgcagaatggctccaacgaacccgatgacacggagcagctggaacttaatgggcgccggtacttgtatcaagaggagaaggaactgctcgccaaagagctgttcgtaagagataagatgactaaacttgacgtgctgaggttgctctttgataaccctgaagaactggacttaaacttcaagacaattgatggaaataaaaccggttacctgtttttccaggcgtactcaaagatgatagaaatgagtggccatgagccagtcgactttaagaaacccatcgagaagattgtggaacaggttaaaagcgtgttcgtcctactcaactggaatactgacatcctgtcctttgattctaacaaggagcttgacaaacagagctattacaagttgtggcatctgctctattcattcgaaggggataatacacctaccggaaacggctgcctggtgcaaaagattatggacagttacggtttagggaaagagtttgccaagatcctggcaaatataacgttccaggaggattatggctcccttagcgctaaagccatccacaagattttgccacacctcaaagaaggaaaccagtacgacgtagcttgtgagtatgccggctaccgccactctaagtcaagtctgaccaaggaagagatcgcaaataaagttctaaaggataaactggaagtgctcccgcgaaacagcctgcggaatcccgtcgtggagaagattcttaaccagatggtcaatgtgatcaacgccataattgaggcttacgggcgtcctgacgaaatcagagttgagttggcgagggaactgaaaaagaatgcaaaggagcgcgaaaaattaacaaagtccattgccgagactaccaaaacacatgaggctcacaagaaactcctgcaagaagagtttggacttaagaacgtgggtcggtctgatatcctgagatataaattgtacaaggaactcgagtcgaggggctataagactctgtacagcaacacctatataccacgagaaaaactattctccaaggagtttgacatcgagcatattatcccccaggcccgcctgttcgatgactcattcagtaataaaacactcgaagcacggaacgtaaatattgagaaggggaacagaaccgcctacgattttgtcaaagaaaagttcggagagtctggcactgacaatagcctggactgctatcttaacaatatcgaggtgttgtttgtttccggtaagatatcaaaaacgaagtacacaaaactgaagatgaccgaacaggatattcctgggggcttcatcgagagggacttacgtaacactcagtacatcgctaaaaaggccctcagcatgctgaatgaaatttctcgctgtgtggtcgcaacctccggaagtatcacagataaacttcgggaggactggcaactggtggatgtaatgaaagaactaaactgggagaagtataaagcgctcggcctggtggagtactttgaagacaaggatgggaaacagattggaagaataaaggactggagcaagaggaatgatcaccgacaccatgctatggacgccttgaccgttgcattcactaaagaggtctttatccagtatttcaacaataagaacgcctctctgaatccaaacacaaacgaatacgctattaaaaataagtattttcaaaacggtcgggccatcgcacccattccgttaaatgagttccgcgctgaagccaaaaagcacctcgagaacacgctgatctccataaaggcgaaaaataaggtgatcaccaacaatattaacaaaactaagaaaagaggcggggtgaatacaaagaaacagcagacccctaggggacagcttcatctggagacaatctacggctgctgtcggcaatatttgactaaggaagagaaggtcaacgcctcatttgatgttagtaaaattgctaccgtgagctcgtccgtgtaccgagacgcactcctgaagagactacaggaacaccataatgatcccaaaaaggccttcgctggtcgcaactctctggacaaaaagccagtatggcttgacaaggagcagatcaggaaagtccctgaaaaggtgaaaacggttacctttgagacaatatacactattcgtaaggagatcagccccgatctccgggtggacaaaatcattgattcaggggtcagaaagatgctgaccggcaggttgaaggaatatggaaatgacgccaaaaaggcattcagtaacctggatgagaaaccaatatggttaaataaggaaaaaggcatccccattaagcgcgtgacaatctccgggatttctaacgcgcagagcctccacgttaagaaagacaaggatggaaaacctgtgctggacggcaatggtcgaaacatcccagtagatttcgtcaacactgggaataaccaccatgtggccgtgtacagacggccggtcatagacaagaatggacaaatggttatcgatgagaacggcaatcttaaatatgagctggaagaggtggtagtgacctttttcgacgctgtcacgagggtgaacttgggtcagcccattatcgacaaggattacaaagcctccgaaggctggcagtttctcttctcaatgaagcagaatgagtattttgttttccctaacaagaaaacagggtttaatccaaaggaaattgacctgctagatgcagacaactacggactgatcagccccaatcttttccgcgtgcaaaaatttacccacaagaactatgtcttccgtcatcacctcgagactacaataaaagataccagttctattctgagaggcatcacttggatcgactttcggtccagcaaggggttggattcgattgtgaaggttagggtgaatcacatcggacagatagtctcagtaggcgagtactga

SEQ ID NO: 3350 - RNA, 4299 nt, synthetic construct
  misc_feature 1..4299: note = Cas9 variant
  source 1..4299: mol_type = other RNA
atgaagaaaatcctgggcctcgaccttgggagcaactccattggatgggccctggtgaatgaggctgaaaacagagatgaggcatcttcaataatcaagttgggtgtcagggttaatcccttaaccgtggacgaaatgcagaacttcgagaaaggcaagagtattacaactaatgccgatcggacgctgaaacgcagcatgcgacgtaacctacaaagatacaagctcaggcgggacgcgctgatcaaacttctgaaaaaggtagggtttattgctgatggaaccatcttgtccgaacagggcaatcgctctacattcgagacttatagactcagggccaaagcacctgacgaggaaatatcgctgcaggagctggcccgggtgctcttaatgatcaacaagaaacgcggttacaagtcaagccgaaagattaaagaaaaggaggctgggaccctgatcgatggaatgaaagtcgcaaagaaactttatgacgaggatttgacaccaggccagctgtgcctacaactcctggaaagtggcaagaaatcccttccggacttttactctagcgatctgcaggaggaatttgacagaatttggaattttcagaagcagttcaaccccaaggccttttgtgataccgctaaagaggaaatcaaggggaaaaataagtcccaaacttgggccatattggcgaaatatttcatttggacagacgagatggtggtttggaacgagaaggaatcaaagaccgagagggtggaaaaagagtgcaagctcgtcggactgaaacggacggtgaagaaagaggaacagcgtaaggagaattaccgctggagagtacaggcattaactgaacagctggacctcggtaaggttgccgtggtccttcaagagatcaacggccagattagtaccagctctgggtatctgggagctatctccgataggtcaaaagtgttgtactttaatcggcagacagtgggccaataccagatggccgaactagagaagaaccctaacactagcctgcgaaatatggtcttctatcgccaggactacctcgatgaatttgacaaaatctgggagaagcaggcagagttccacaaagaactgaccgttgagcttaagaaggaaattagagatataatcattttctatcaaaggcggctgaaaagtcagaagggtttgatcgggttctgtgagttcgagaaccgcgaaataatggtggagaaaaatggaaagatgcaggctaaagtagtgggctgcaaggtcattccaagatctcatcccctctttcaggaatttaaaatctggcaaacactgaacaatgtggaggtttttgccggcgaaaagaagtgtaaaaggaagcgtaccgacgcgttccctgggttatttgatggaacggaggacactctgatggtggagggttggcggtacctatatcaggaagagaaagaaatcctcgccaaggagctgtccgtcaaaaagagccttaagaaagaatacattttgaagctcctgttcgataacccacaggacctggatatgaattttgagcagatcgagggcaacgacacagggaatgtgcttttctcggcatattctaaaatgattgaaaagtacggatacgagcccctggactttggcaaatccaccgatgaaataatcgagcgattgcaagtaattttcactgacctcggttggaacacagatctgttatttgttgacctgaataaggaagggaaggatctagagaaacagccttatttcaagctctggcatctgctttactcatttgagggcgacaacaccccaacgggaaatggcaaattggtggaaaagctgatggagctctgccacgtcgggaaagaatgtgctctggagttagtgaacatcagtttccagaatgattatggaagcctgtccgccaaggctatcaagaaaattcttccgtacttgaaggagggtaacagatatgacgtcgcctgcggctacgcagggtataggcactctaaaagctcactcaccaaggaagagatagaaaacaaagtgctgaaggataaactagacatcctgcccaagaatagtctccgcaaccctgttattgagaagatcctgaatcagatggtgaacgtaattaatgccatcatagatacatacggaaaaccagacgaaatccgggtcgagcttgctagagagttgaagaaatccgcgaaggaaagggatgagctgactaaagcaattgccaagagcacccgcgaacatgaggaaatccgaaaggtgttacaagaggagttcggcatgattaacgtttctcggaatgacatcatacgttacaaactctatgaggaactgaaggacaacggttacaaaacactttattcaaatcagtacattcccaaggaaaaagtgtttagtaaggagatcgatattgaacacatcatacctcaggctagactgttcgacgatagcttgtccaacaagactctcgagtataaagccatcaatattgagaaggggaacaaaaccgcatacgactttgtcaaggaaaaatatggcgagaagggactgcaacagtacctaaataggtgtgaatctctgttcaagggccaccgcacaaaactccggaagctgaaaatggggcaggagaacatcccagagggatttattgatagagaccttaggaatacccagtacatcgccaagaaggctttggccatgctgaacgaaatatgccgacgcgtggtagcaactacgggttcgattacagatcggttaagagaggactggcaactcgtggatgttctgaaggaacttaacctgcccaagtatgagaccctaggcctcgtcgaagtgtacgaggacaaagatgggaggaagatcaaacgtatcaaggactggactaaacgcaatgatcatcggcaccatgcgatggacgctctgaccgtggccttcacaaaggacgtctttattcagtatttcaacaataaaaacgcagcctggcaggctgattgtaaggagcacagcgacatcattggaataaagaccagatactttgaaaatggcagggccttgccgcctatgcccctggttcgattccgggcagaggctaaatcccacttagaaactctcctggtgtcaatcaaggccaaaaacaaggtggtaacaaataacgtcaattgcacgaaacgcaagggtggggagaacaagaaacttcagcaaaccccaagaggccagctgcatttggaaactatttatggaagtcacaggcagtacgtgatgaaggaggagaaagttaatgcgtcttttgatagctccaagatcgccacagtgtgcaaacaggcttatcggaacgcactcctggaacgactagccgctttcggcaatgaccctaagaaggcctttaccgggaaaaactcactggagaagaatcccgtctaccttgatagagaacaaacagcacgcgtgccagagagggttcgtactgtggaactcgagaccgtatacacgattcggaaacccgtcgaccctaacctgagcgtggataaggtggtcgacgcgaaagttagatctatcttggagcagaggctgcgcgaatatgatggagaggccaagcgagctttcgtgaacttagacgaaaatccaatatggctcaacgaggagaagggcatcgccattaaaagagtaaccatccggggtattaataaggtgcagtccctgcatgggaaaaaggataaaaacggaaatcttatcctggacgaaacaggcaagaaaataccggtcgacttcgtgaacactggtaataaccaccatgttgcaatttacaggaagcccgtgttggataagaccggccaagagatgctcgacaatgaagggaaccctgtctatgagctggatgaagtggttgtgagtttcttcgaggctgtcacacgcgtaaatctaggactgccagtgatcgacaaaaactacaataagagcgagggctggcagtttatgttcactatgaaacagaacgaatattttgttttccccaatgagaagaccgggtttgatcctaaagaagtggaccttctcaacccagagaattacgccgtcatctctcccaacctgttccgtgtgcagaagattacggaaaaggattatatgtttagacaccacttggagacaaaagtagtggacgataagttcttaaaagagataacctggaagcggatcctgactccgaacaaactcgaaggaattgtcaaggttagggtgaatcatatcggccaaattgtgtccgtcggtgagtactga

SEQ ID NO: 3351 - RNA, 4299 nt, synthetic construct
  misc_feature 1..4299: note = Cas9 variant
  source 1..4299: mol_type = other RNA
atgaagaaaatcctgggcctcgaccttgggagcaactccattggatgggccctggtgaatgaggctgaaaactctgatgaggtctcaagtataatcaagttgggtgttagagtgaatcccttaaccgtagacgaaatgcagaacttcgagaaaggcaagagcattacaactaatgcagataggacgctgaaacggtccatgcgccgaaacctacaacgttacaagctcagaagggacgccctgatcaaacttctgaaaaaggtggggtttattaccgatggaacaatcttgtctgaacagggcaatcggactaccttcgagacatatcgcctcagagcgaaagctcctgacgaggaaatatcgctgcaggagctggccagggtcctcttaatgatcaacaagaaacggggttacaagtcaagccgcaagattaaagaaaaggaggcagggaccctgatcgatggaatggaggtggccaaaaagctgtatgacgaagatttgactccaggccagctgtgcctacaactcctggagagtggcaaaaagtcccttccggacttttactctagcgatctgcaggaagagttcgaccgaatttggaattttcagaaacagttcaaccccaaggctttttgtgatacagcaaaggaagagatcaaagggaagaataaatcccaaacctgggccatattggctaagtatttcatttggacggacgagatggttgtgtggaacgaaaaagagtcaaagactgaaagagtcgagaaggaatgcaaactcgtgggactgaagaggaccgtaaagaaggaggagcagcggaaagaaaattactgttggcgtgttcaggccttaacagagcagctggacctcgaaaaggtggcggtcgtgcttcaagagatcaacggtcagattagtactagctctggctatctgggggcaatctccgatcgctcaaaggtgttgtactttaatagacagaccgtcggacaataccagatggccgaactagagaaaaaccctaacacaagcctgaggaatatggttttctatcggcaggactacctcgatgagtttgacaagatctgggaaaaacaggctgagttccacaaggaactgaccgtggagcttaaaaaggagattcgagatataatcattttctatcaacgcagactgaagagtcagaaaggcttgatcggtttctgcgaatttgagaacagggaaataatggtagagaagaatgggaaaatgcaggccaaggtggtcggatgtaaagtgattccacggtctcatcccctctttcaggagttcaagatctggcaaacgctgaacaatgttgaagtgtttgcaggcgagaaaaagtgcaagcgcaaaagaactgacgctttccctggcttatttgatgggacagaagacaccctgatggtcgagggatggaggtacctatatcaggaagagaaggaaatcctcgccaaagagctgtccgtgaagaaaagccttaagaaggagtacattttgaaacttctcttcgataacccacaggacctggatatgaattttgaacagatcgagggtaacgacactggcaatgtacttttctcggcgtattctaagatgattgaaaaatacgggtacgagcccctggactttggaaagcctacagataaaataatcgaacaattgcaggttattttcgccgacctcggctggaacaccgatctgttatttgtggacctgaataaggagggtaaggatctagagaaacagccatatttcaagctctggcatctgctttactcctttgaaggggacaacacgccgaccggcaatggaaaattggtcgagaagctgatggaactctgtcacgtgggcaaagagtgcgcactggagttagtcaacatctcattccagaatgattatgggagtctgagcgctaaggccatcaagaaaattcttccctacttgaaggaaggaaaccgttatgacgtggcttgtggttacgccggctatcggcactccaaatctagcctcacaaaggaggaaatagagaacaaagttctgaaggataaactagacatcctgcctaaaaattcactccgaaacccagtggtagaaaagattctgaatcaaatggtcaacgtgatcaatgcaattatcgatacttacgggaaacccgacgagataagagttgagcttgccagggaattgaagaaaagtgctaaggagcgcgaggaactgaccaaagcgatcgcaaagtccacacgggaacatgaggagattagaaaggtgttacaggaagagttcggaatgatcaacgtcagcaggaatgatattatccgctacaaactctatgaggaactgaaggacaacggctacaaaactctttattctaatcagtacatacctaaggaaaaagtgttttcaaaggagattgacatcgagcacattatcccacaagcccgactgttcgatgacagtttgagcaacaagaccctcgaatataaagctataaatatcgagaagggtaacaaaacagcctacgattttgtaaaggaaaaatatggggagaagggcctgcagcagtacctaaatcggtgcgagtccctgttcaagggacagcgtaccaaactcagaaagctgaaaatgggccaagaaaacattcccgaggggtttatcgacagggatcttcgcaatactcagtacattgcaaagaaagccttggctatgctgaacgaaatctgtcggagagtggttgccacgacaggatctataaccgacaggttacgagaggattggcagctcgtcgacgtgctgaaggaacttaacctgccgaagtatgagactctaggtctcgtggaggtctacgaagataaagacggccgcaagattaaacggatcaaggattggaccaaaagaaatgaccacaggcatcacgcaatggatgcgctgacagttgctttcaccaaggacgtgtttatccagtatttcaacaataaaaacgccgcatggcaagccgactgcaaggagcattcggatattatcgggattaagactcgttactttgaaaatggacgcagcttgcctcccatgccactggtgcggttcagagctgaggccaaatcccacttagaaacactcctggtatcaataaaggcaaagaacaaggtcgtgacgaataacgttaattgcaccaaaaggaagggcggtgagaacaagaaacttcagcagagtcctcgagggcagctgcacttggagactatctatggctctcatcggcaatacgtgacaaaggaagagaaagtcaatgctagctttgactcctcaaagattgccaccgtgtgtaaacaggcgtatcgcaacgccctcctggaaagactagctgcattcggaaatgatcccaagaaggcctttacaggcaaaaacagcctggagaagaatccagtttaccttaacagggaacagactgctcgggtgcccgagcgagtaagaaccgtcgagctcgaaacggtgtacaccatccgcaaacctgtggacccaaacctgtctgtcgataaggttgtggacgccaaagtaaggtccattttggagcaacgtctgcgggaatatgatggggaggcaaagagagcgttcgtgaatttagacgagaacccgatctggctcaatgaagagaagggaatagccatcaaaagggtcacaattcgcggcatcaacaaggtgcagagtctgcacggtaaaaaggataaaaatgggaaccttattctggacgaaactggaaagaaaatccccgttgatttcgtgaataccggcaacaatcatcacgtcgctatataccgaaagcctgtgttgaacaagacaggtcaggagatgctcgacaatgaaggcaacccagtttatgagctggacgaggtggtcgtgagctttttcgaagccgtaactagagttaatctagggctgcccgtgattgataaaaactacaataagtctgagggatggcagtttatgttcaccatgaaacaaaacgaatattttgtcttccctaatgagaagacgcggtttgacccaaaagaagtggatcttctcaaccccgagaactacgcagtaatctccccgaatctgttcagggtgcagaagatcacagagaaggactatatgtttcgccatcacttggaaaccaaagtcgttgatgacaagttcttaaaagagattacttggaagcgtatactgacacctaacaaactcgaaggcatcgtgaaggtgagagtcaatcacattgggcagatcgtgtcagttggagagtactga

SEQ ID NO: 3352 - RNA, 4299 nt, synthetic construct
  misc_feature 1..4299: note = Cas9 variant
  source 1..4299: mol_type = other RNA
atgaagaacatcctgggcctcgaccttgggaccacaagcattggattcgcccacatagtggaggatgaaaataaagagaagtccgaaatcaaagagctgggtgtcagaattgtttctttgactacggacgaacagtcagattttgagaagggcaaaagtatcaccacaaacgctaataggactttaaagcatggggcacggctgaacctagaccgctaccaacagcgacgtaagtatctcattgatctgcttcacaaagccaatctgatcacccccagctccatattggcggagaacggaaagaatacaacccattctacttggcagctcagagctaaagccgtgacagaaaggatcgagaaggaagagttcgcacggattctgctggccatcaacaaaaagcgcggctacaagtcgtcaagaaaagctaagaccgaggacgaaggtcaggcaattgatgggatggccatcgctaaaaggctctatgacgagaatttaacgcctggacaactgagccttcagttgctgcagcagaacaagaaactactcccagatttttaccggagtgacctgcaaaaggaatttgatcttgtatggaattttcagaaacagttctatccggacatactgactgatattttctacaaggagttgcagggcaagggcaaagacgccacctccaaggcgttctctaaacgctatcactttgacacagcagaaaacaaggggagcaaagagtccgtgcgactccaagcctaccagtggagagctgaggccgtctcaaagcagctgagtaaggaagaggtggcatacgttttaactgaaatcaataacaatctgaacaacgctagcggatatctcggtgccatttctgataggtccaaagagctttacttcaatcggcaaaccgtgggccagtatctgtacgcgcagttgcaggaaaaccgtcataattcactaaagaacaaagtcttttatcgccaagactacctggatgagttcgagagaatctgggaaacacaggccctctttcacaaggagctgaccgacgaacttaaaaagcagatcagggatgtggtaattttctatcagcggaagcccaaaagccaaaaggggctgataagtttctgcgagtttgaatctaaagagatcgagattgaaaaggacggaaaaacgatcactaagaatataggcgcacgagttgtgcctaagtccagcccattgttccaggagtttaaaatttggcagatcctcaacaatgtcatctgtaagcgcaaaggtattagaaagaaaaagatctcggctaaaacaacccagctggatttactgaacgaatcttcccaaactattttctcactagacatggagtgcaagcagctcctgtttgatgagcttaatttgaagggggacctgaaaagtgataaggtgctcaaactgcttggatacagcccccaggaatgggagataaactacaatcagctggaaggcaacaggacacaaaaggccttgtatgaggcttacctcaaaatcgtggaaatggaggcccacgacgtcaaggacattctgcagatcaagtccaccaaagatgactggtctttagatgagagccctctgtcagcaagtgaaatccgggagtccgttaaggccattttccaggctctaggcatatgtacgaaaatcctctattttgacccactgcttcccgtgaaggatttcgaggaacaagacagctaccagttgtggcatctgctctattcttacgaatcagatgacagtaccagcgggaatgagacactgtatcgcattttagagaaaaagtacgcgtttaagagagaacacgcaaggatcctggccaacgtagcccttcaggatgactacggatccttgtctactaaagctattcgtaagatctatcctaatataaaagagaaccagtactcgaccgcatgcgaaatggccggttataagcatagcaaactctccctgacaactgaggaactagaggctcgggagctgaagaacatcattccactcctgaagaaaaatgcccttcgaaacccggtggtcgaaaagatcttgaatcaaatgattaacgtggttaatgcactgatcgagaaaaactcagaaagagatgcggagggcaagataaccaaatacttccactttgacgagattaggatcgaattagctcgcgagctcaagaaaaatgcccagaagcggtatgaaatgacacagaacattaataaggcaaaaagtgagcaccagaagatctctgaaatactgcaaaaagagttcgggatcaagaaccccaccaaaagcgatattatcagatacaggctttataaggagctggaacataatggatacaaggagttgtacactaacacgtatattgcccctgacgtgctcttttccaaaaatatcgacatagaacacattgtcccaaaggctcgcgtgttcgatgactcattcagcaacaaaacactggcctttaaggatttcaatatcaaaaagggcgagtctaccgcatttgactacatcacttccctaaagaacgaagagaaactgaaccagtatctcgctcgagtagagaatgcctacaagaccaaaaacattagtcccgcgaagtataaaaatctgcttaagaaggccagcgaaatcggtgatgggttcattaaccgggacttgcgtgatacacagtacatagctaaaaaggcaaaagagatcctgtttcaggttaccaagaatgtgttatctacttccggctcaattacagacagactcagggaagattggagtctggtcgacgtgatgaaagagcttaacatgcctaagtatcaaagcctgggactaacggaagtcgaggagcgcaaggatggcaataaagtgaccgttatcaaggactggactaaacggaacgatcatagacaccatgccatggacgctctcacagtggccttcaccaagccatcgtacattcagtacctgaatcacttgaacgcaaggaaagacgaaaataacaagaattattccgtaatcctggcgatagagaaaaaggaaacaatcaaggtccccactaacaatgggaaaaacaagcgagtgtttattgagccgatccctaacttccgccaggttgccaaaaagcacttagaggaaatttttatctctcataaagctaagaataaggtggtcaccaaaaacacgaataagcccgccggaaccaacaaacaacagataacactcactccacggggtcagctgcacaaggagaccatttacggcaaatatcagtactatgtgaataaggaagagaaggtaggggtgaaattcgataaggaaacaatcgcaaaagttagcaaccctctttacagagaggctctgttgaagaggctccaagccaatgacaacgatcccaaaaaggcatttactggaaagaatgccctgagtaaaaacccaatctatctagacgaggctaagaccaaaacgctgcccgaaaaggtcaatcttacatacctcgaggaagatttctcagtgcgtaaaaagattgtgcctaaaaacccaacctccaaggagtttgtcccgaatctgaagtctatagaaaaagttgtggacgagggcgtgcgcaacatcttgattgagcggctgagagtatacaataacgatcccgaaaaggcgttcgtcgacttagagaaaaatcctatctggctcaacaaggaaaaaggtattgccatcaagagggtgactataagcggggttaacaatgcacagccactgcatatcggcaaggatcaccttggaaaaacaaccctgaacaaggagggcaaagaaattcccgtggactatgtctccactgggaataaccaccatgtggctatctaccgagataaggagggaaatttgcaggagcagattgtttcattctttgaagccgtggtacggacccaacagggtctccctatcatagacaaaacatataagcaggaggaaggctggcagttcctgtttacgatgaagcaaaacgagatgttcgtctttccaaatgaggccaccgggttcaaccccgctgaaattgacctactggatccgaaaaataagaaacagatcagccctaacctttttcgcgtgcagaagatcgcaactaaagactacttctttagacaccatctcgagacaaatgtggaaaccgataacgtcctgaagaatacaacttggaagagggagggattgagtggcttaaaagacattgttaaggtgcggatcaaccacctgggtgatatagtatctattggggaatattga

SEQ ID NO: 3353 - RNA, 4302 nt, synthetic construct
  misc_feature 1..4302: note = Cas9 variant
  source 1..4302: mol_type = other RNA
atgaagaaaatcctgggcctcgaccttgggaccacaagcattggatacgcccaggtgaacgagtccgaagatttcaaggactcttcaatagagagaatcggtgtcagggttaatcccctgagtgtggatgaacaaactaactttgagaaaggcaagcctattagcatcaatgctgaccggacgttgaaatccggggcacgccgaaccttagatcgttatcaggacagaaggtctaacctgattgatgccctagtaaagtcggtgatcataacagaagacactgtcctcgcggaggatggaaagaataccacacactcaaccttcgctctgcgggccaaaagcgcaagtgagaaggtggaaaaagccgagtttgctcgcatccttctggcaattaacaagaaaagaggctacaagtcctctaggaagactaataacaatgacgatgaaggtcaggccatcgacgggatggctattgccaaaaagttgtatgatgagaacctcacaccaggacagctggcgtaccaactgctcaaagagggcaagaaatatttaccggacttctaccggagcgacctgcaggcagaatttgataagatctggaccttccagaaacagttttatcccgagatacttacggacgaattgcaaaaggagctggccggcaaggggcagcgcgctacttccgccattttctggaaaaagtacgattttaataccgcagaaaacaaaggaacacgagaggagaagaaactaaaggcttacgaatggagatcaaccagtgttgacaagaaactccagaaggaggaagtggcctatgtcatcactgagattaataacaatctgacaaacagctctggttaccttggcgcgatctccgataggtcaaaagaactgtatttcaacaagcagaccgtggggcaatacttgtttaaacagatccagaagaatcctcatacgaagctcaaaaaccaagtattctatcggcaggactactttgatgagttcgagattatatgggaaactcaggccaagttccacccagagctgacagaagagttaaagaataagatccgtgacattatcatattttatcagcgcaaactgaaaagccaaaagggactcattagtttctgcgaatttgagagaaaagaggttgaaatcgagaagggcggtaggcggatgaaaaagaccatcgggcttaaagtggcacccaagtcttcccctctgttccaggaatttaaaatttggcaggtcttgaacaatgtgctaatccgaaagaagggaagcaaaaagcgcagagtgaaagagccagatcagctgaacctcgtcgagcaagaacaggaggttatgttctttgacatgcagactaagcagacactgttcgatgaacttaatgtgaaaggcaacctgaaggctaagaggattatagagttgatcggccaagacgccaatgactgggaaattaactactcggagatcgaggggaatcggaccaacaaagctctctacgatgcctatctgaagatcttagacctggaaggatacgatacgaaagcactactcgacgtaaagacctctaaagatgaggtggaactggacgatattaatatatccggtcccgaggtcaaggaccttgtgaagcgcatctttgaatcattggagattgatacacagatcctggagttcgacgccgaactcgatggcgaggtttttgaaaaacagagtagctatctgctttggcatctgttgtactcctatgagggggacgattctcctagcggaaacgaaaagctctacaaactgttaaagcagaaattcggctttaagaaggagcacgctcaaattctggcgtcaatcactctaagtgacgactatggttccctcagcgcaaaagccatgagaaagatatacccatacatcagggagcagaccttcgataaagctgcctctctggcagggtatcgtcattcagccagtagccttacaaaggaagagattgctaatcggccgttgaaagacaagctggaactcatcaaaaagaactccctgcgaaaccccgtggtcgagaagattttaaatcaggtggtaaacatcgttaattctctgatagaggccaactcggaaaaagatagcgacggcaatattatctcctacttcaagtttgatgagattagaatcgaacttgcaagggacttgaaaaagaacgcgaaagagcgcgctgaaatgactctcaatataaacgccgcaaagatcgtgcacgagaagattttcaaactgctacaagccgagtttggagtcaagaatcctacccggaacgatatcattagatataaactgtacgaagaactcaagaataacggctataaagacctgtacacaaatatctatataccaagggaaattcttttctcaaagcagatcgatatcgagcacattatcccccagagtaagatgtttgacgattctttcagcaacaaaaccattgtgtttcgcaaggacaatttggataaagggaactccactgctttcgactacatagactcacgatttggaaaggataaactgacggacttcgaacagcggatcgagtttttattcgagcaaggtaagaagaacaaagaagagggcattagcaaggccaaataccagaagctcctgaaacgtgaagcagatatcggggacggatttattgagagagatcttagggacacacagtatatcgctaagaaggcccgcaatctgttgtacgaaatatgtcggatcgtcacccctactaccggctctattacagatagactcagggaggactgggatctggtgaacatcatgcaggagctaaatctggacaaattcaagaaactcggtctgaccgaaatggttgagaagaaagatgggtccttcaaggaacgaattgtggactggagtaaacgcaacgaccatcggcaccatgcgatggatgcccttactatcgcttttacaaagcacagccacatacaatatttgaattacctgaacgcaagaaagaatgagaaccataaacagcaccataatattatcggcatcgagaggaaggaaacggagttcgtaattgacgatttaggaaacaaaaagcgtaaatttcacctcccactgcccaatttccgcgaagaggccaagaagcatcttgaaaacgtcctggtgtcttttaaagctaagaataaagttgtgaccaagaacaaaaataagactgcctcctcaaagggcgagaaaataaaggtcgagctaacaccgcgggggcagctccacaaagaaaccgtgtatggaaagtacaaattctatgtaagtaaggaggaaagaatcggtggcaagtttgaccagaggacaattgagcgagtggcaaacagcactcacaaacggctgttgctgcaacgcttactcgaaaacgataatgacgcgaagaaagccttcaccgggaagaacgctctggccaaaaatcctatctaccttgatgacacgaagaccctgacattgcccgagattgttaaactcacttggctggaggaagattactcgatcagaaaggacataaccccagagaactttaaggatatcaaagtcattgacaagatcctagatgaaggagtgaaaaggattctgaaggagcggcttgcaaaacataataacaatcctaaggaggctttctccgacctcgagaagaaccccatctggctgaatgagaaaaagtctataagcattaaaaaggtgaaaatctcaggcatcaacaatgccgaagcattgcactataagaagaaccatctgggtattgagatcttagacgatgagaaaaagcgaataccagtcgactttgttagtacagggaataaccaccacgtggccatttacagagatgaaaaaggcaatctccaggaggacgtggtatccttcttcgaagctgtcgcgcgcgtgaaccagaatctgcccatcattgataagactcttaaagcctatctgggatggacctttttgttcacgatgaagcaaaacgagtactttatcttccctaacaagcagacaggctttaatccaaccgaaatagacctcctggattctatgaacaataaactaattagcccgaacctgttcagggttcagaagtttactgtgaaagactatttctttcgtcatcaccttgagacaaatgtcgaagatgactccaagctcaaaaacaccacttggaagcgggaggggctgggaggcatcggtaatatcgtgaaagttagaattaaccatatcgggcagattgtgaagataggagagtactga

SEQ ID NO: 3354 - RNA, 4305 nt, synthetic construct
  misc_feature 1..4305: note = Cas9 variant
  source 1..4305: mol_type = other RNA
atgaagaacatcctgggcctcgaccttgggaccaatagcattggatgggcctacgtgaaacaggctcaaaacgattccgagaagtctgaaatagcagagctgggtgtcagagttaatcccttgacagtggacgaaaagactaacttcgagaagggcaaacctatctcaacgaatgccgataggaccttaaagcgcggggcgcggcgaaacctgcagcgttataagctaagaaggcaggaactcattgagctgcttaaagactaccaggtaatcagtgataagacaattctggctgaggacggaaaagaaactacctttgagacattgcggctccgcgtgaaaagcgccaaagaacaagtctccctggaggagctggcaagaatcctcttaatgataaataagaagaggggctataaatcttcgcggaaggccaaaaacgaagatgagggtcagctgatcgacgggatggaaattgctcgccgactttacgatgagaatttgaccactggacagctgtcactacagctcctgaaggaaggcaaaaagagccttccagactattacagaagtgatctgcaacacgagttggacaaagtgtggaacttccagaagcagtttcatccggatatcctcacagacgagttctatacctccattcagggcaaggggcaaaaagcaacgagggaatcttttagctccaagtacggaatcgacactgccgagaataaaggttcacgggaagagaagaaactgcaggcttaccagtggcgtgccgatgcgacccacaaggaattaacaaaggaggagctggcattcgttataactgaaattaacaataacatcaataacagtagcggctatctcggggccatttctgaccgctccaaagagcttatctttgctaacgaaaccgtgggagagtacctgtggaagcaaatccagaatgatccccatacatcattgaaaaaccaggtcttctatagacaggactactttgatgagttcgaaaggatttgggagacccaaagcggcttttatcctcagatactaacggaaagtctgaagaatgagctccgggacatcctgattttctaccagcgaaaacttaagtctcagaaggccctggtgtccatctgcgaatttgagagcaaagagataccattgaaggataaacaaggtaaccccatttcgaagaatgggatccctgtaactaaactcgttggaccaaaggtggcacccaagtcttcccctctgttccaggagttcaaaatctggcagaacttaaataacgtcctggtgcgcccaaagggctcaagaaaaaggaaggtgacaaccaatcagcaaagtactctactcgaaggccaggaaccggtctttgagctgaaccttgaacagaaagagttgctgttcgaggaactcaatctgaaggggaaccttaaaacagactattgtctggagttgattggatacagcgctaaggaatgggagatgaattaccccaccctcgaaggtaacaagacgaataaagccctgtatgaggcgtacttaaagatcattgattccgagggctatgacgccaaaaagctgctaaaagttaagaccgataaggacgacataaacctcgatgacatcaaagtgtctgcaagcgaaattaagacaatgatctcagatatctttaacgagctggggattaatactaaaatacttgacttcgatgctgaattggagcggaagcagtttgaagcccaagctagttaccgcctgtggcacctcctgtattcctacgagggagacgatagcaaatctggcaacgagttactgtatagacttttggaagacaagttcggttttaagagggagcattcaaaaaccctcgccaatgtaagtctgctaagcgattacgggaacctgtccacaaaggcaatccgtactatttacccttatatcaaagaaaataagttctctaccgcctgcgagctcgctggctaccggcactcgaaactgagcatttccaaggaggaaaacgagaatcgaacacttaaggacaccttggatgtgctgaaaaagaactcattaagacagccagtcgtggaaaagatcctcaatcagatgataaacctgatcaatgagcttattgaaaagcacagtgagaaagacgagaagggaaacatcgttaaatattttaagttcgatgaaattcatatcgagctggcgagggaattgaagaaaaatgcagaggaacgccgggagctcgactctaaggtgagagagggcaaagacaggaacgaaaagataattactatcctgaaaagcgagtttgggctaccctaccctacgaagaatgatattacacgctatcgactgtacgaggaactcaaggacaacggatataaagatctgtacaccaacacttacatcccacgggaaaaacttttctccaaagagatagacatcgagcacattatccccaagtcacgtttgtttaatgatagcttctctaacaaaaccatttgttatagacaagacaatctgaacaagggtgaaaggacagcctacgattatatcgagggcttagggaagacccagctcgacgaatacctgaatcgcgtcgagaacctttatactaataaattcataacaaaggctaaataccggaacctgctaaagaaagagtccgaaattggagatggctttatcgagagagacctcagggaaacgcagtatatcgccaagaaggcaaaagagatgctgttgcagattacccgacatgtggtaagtactacaggtagcatcaccgatcgcctgcgggacgattgggaattagttaatgtgatgagagagctcaacctgccgaagtacaaagtccttgggctgacagagattcaagaaaggaagaatggccagactgtggaggtcataaccgactggacgaaacgtaacgaccaccgccaccatgccatggatgctttgaccgtggccttcacaaagcactctcatatccagtacctcaattttctgaacgcacggaaggacgaaaaacacaaggagtattccaatattatgggaatccagcaactagaaactgagaaaaccacagataaggacggcaaagatagaagggttttcaagactcctattcccaactttcgacaggtggcgaaagagcatctggaatcaatccttataagtcacaagaccaagaacaaagtagtcacgcgggctacaaataagatcgccgggagcaaaaagcagcaggagaccctctcgccacgcggacaactgcacaaagaaactgtgtacggtaagtatagaaggtacgttcagaaggaggagaaaattggctccaagttcgacttgcagacaatcgaacgggtggcaaaccctctgtataaacgattactcaccaagagactggaggaaaatgggggagatcccaaaaaggcctttactggcaagaacgctcttgccaaatctccaatttacctggacgagacccaaacacagcagttgcccgaaaaggtcaaactcgtgtggctggagacggatttcagcatccgcaaggacataacccctgataattttaaagacgagaagtcaattgacaaggtactagatgaaggtatcaaaaggatcctgaaggaccgtcttaaaagtttcgatggggacgcaaagcgggcttttactgatctcgagcagaacccaatttggctgaataaagaaaagggcatagccatcaaaagagtgacaatttccggagtttctaacgcggagccgttgcataccaagaaggaccacttaggcaatgaaatcttcgatgacacagggaaacccattcctgtcgattatgtgagcactggaaacaatcatcacatcgccatatacagggacgagaacggcaatctgcaagagaaggctgtgtcctttttcgaagcagtcacccgcgccaaccagggtctcccaacggttgataaaacatacaatcagcacctggggtggcagttcctttttaccatgaagcaaaacgagatgttcgtgtttcccaataaagaaactggattcgaccctcaggagatcgatctgttggacccaaagaacaagaaactaatttcacccaacctgtttcgagtgcagaagatcagcaccaaaaattatttctttagacatcacctcgaaacaagtgtagagactcataacgctctgaatggcgtcacctacaagtctcagcttggtttaaacggcattacagacatcataaaagtgcggattaatcacctgggggatatcgttcatatcggagagtattga

SEQ ID NO: 3355 - RNA, 4308 nt, synthetic construct
  misc_feature 1..4308: note = Cas9 variant
  source 1..4308: mol_type = other RNA
atgctgggctgcgagagaaagaggaaacggcgcgaaaaggagaaaatggccaagcccaaagactacaccatcgggctcgatattggaacaaacagcgtgggttgggtcgttactgacgatcagaataacatacttcgaatcaagggcaagaaagctattggggcacgtctgttcacggaaggaaaggtggccgcggagagaaggtcctttcggaccacacgcagaaggttgtctcggcgccgatggagaatcaaaatgttagaagaactgttcgacgaggaaattgctaaggtagatccttcatttttcgccaggctacacgagagttggatcagcccaaaagacaagcggaagcgttattccgcaatagtgtttccgtctcccgaagaggataaaaagttccatgagtcgtaccctactatctatcacctccgcgacaaactgatgaaggatgaccaaaaacatgatattagagaaatctacattgccgtccaccagatgatcaaggctaggggcaattttcttcatgacgagtcagtggaaacctatcggagcggtatgagttccctgggagggcgatctgagcgcaacatattgagcgttcagacactcgaagaactgaatgatctgttcgcagagaacgaaggcaccgaggaagtggagctcaatgtcgcctccgctgaacagattaacgacatcttaactggcgggcacctgaatgccgactcacaaaaagagattagtaaccttttgctgccaagctcttttccctccttcgatgacaaggcgaaggagaaacaggtgaagaaactaatcaataacgtagcaacaaatatctcaaaggcctggctcggatacaaagctgattttagcaccattctgaaccttgccaaggttgacaaggatcagaaaaagatattcgcatttgctctgcagggtggcgacgaagaggataaagtgcaagaattggagagtctcctggaacagtctcagacggacatcgtcgatagattaattgagatcaggcacgccatagtgctgtccgagattgtgcctgtcgggatgactctcagcgaagcgatgatcgacaagtatgatcagcataaagaggaccttatcaccctgaaggccgttattcggaatacaaaggacaaaaagaaagcagctaagttgcaagccatctacgatctatacgtgaaaaaccgccacgctgacctggccaaggcaatgaagctcactggaattaaaaagagatcggaactgcttgatccagaggagctgaaaaagggcatatcttccttgctcgacgattcacccgaagccgtagagatcaaacagaggctggaagagaagaccttcttacctctgcagcgtagtaacaataacggtgtgattccaaatcaactacatcaggtcgaactcgacgagatcatcaaaaagcagagcaagtattacccgttcctggctgagaaaaaccccgatgaatccgaggaagcgcagaagaaagcacctacaaaacttgacgccttgctgacctttcgggtgccatattacgttgggcccatgattacgaaagaggaacaagaggctcagaatggacactctttcgcctggatggtgcgaagagatcctcaggaccacgaggcaataactccatggaactttgaaaagaaggtcgataaaatggccagcgctacacagttcatcaagaggatgaccactaaagacacatatctcctgggcgaggatgtgcttcccgcctcaagtctgaagtaccaattgtttaccgtactcaatgaactgaacaatttacgcgttaacggcaaaaagctgacgtccgacgagaaggaacaggtgattgaggggctattcaaaaagcagaaaaccgtcaaggcagacaaatttgtgaagtattggcaggcgaagcatatcggagctgatattaaagtcaagggtctcagcgacccgtctaaattcaattcaacaatgagtacttacatcgattttaagaaaatattcggcgaccaactgaacgatgtgaatcggcagaacgactttgagaagatcattgaatacagcaccatcttcgaggatagaaaaattcttgaagacaagttgagggttgattttgcctggctgtccgaggagcagatcaagcagctctgtcgcctgcgattacaagggtggggacggctgtctgacaaacttttgacacgtctcactgatgcagacggccagaatgtgctggaaagactatggaactcgaacgataatttcgtacagatagtcagcgaccctaacattaaggccaaaatcgagcaagaaaatcagaagctgctcagggactcccagtcagataacgctgtggagagtattctggacgatgcctatacctctccccagaataaaaaggcaatccgccaagttatgcgggtggtccacgacatagtgaaggcttgcgatggtaacgtaccagccaaattcgcgatcgaatttgccagaagccaggaggacgatcctaagaggacaaccgctcgagtgaatcagatgcagaaaatttacgaccaaatctccgatgaggttgtctcacagggggtgaaggaacagcttagcggcatgaaatctttgaaggaccgctattacctgtatttcatgcagggaggccgggatgcatacactggggccaagttaaacattgacagactctccgactatgatgtggaccatatcatgccccaaagttttgtcaaagatgacagcctggataatagggttcttgtggctcgtgccgtgaacaatcagaagtctgacaaagtaccagcactgttgttcggaaacaaggtcgtggcggatctcggtataacggttcgcgagatgtgggacaaatggcagaagctgggcatgatttccaagcggaaactatcaaatctgctcacagatagtgacgccctgaccgaatacagagctcaagggtttatcaggcgacagcttgtggagactagccaggtcatcaagttgaccgccacaattctgcagtcggagttccccgattccaaaatcattgaggtgcctgcaaagtacaactctatagttcggaaacaatttgacttatataagagccgcgaggtgaatgatttccaccatgctatcgacgcctacctctcaaccattgtaggaaactatctgtaccaggtctatccaaaccttagaaggatgtttgtgtacggcgagttcaagaaatttagttccaatgcagaggaatctgcccacgacgtggctcggcgagtcaagagcatgaacttcctggatgacctactcagaggtactcacggggataatatctattgtcgctccacaggcgagattgtttttaacaggaatgacatcatatcaaaactgaagcaggcgtacagcttcaaacagatgttggtgacgcaagaagtattcaccaagaaaagtgccctgtttaaccagactgtgtacccgtctcccaagcgtgatggatccaagcggagcggcttaatccctagaaaaagggggatggacccagagatttatggaggttacgcacataatcaggattcgtatttcgtcctcgctaagatcgagaaagtgaagggctacacactgcagattgttggggtgcccatccgctcacttgaaataattaacaaagccgaggacttttctaccgccctgttggatatcatcaagagtaaggtcatgtataatgaaaagacaggacaacctaagcgaggcattaaaaacgtggagatactcgttaataagctgccatacagacagcccatcctagagaaagacgtgtcctatatgctgggtagctctgcttacaagtacaacattaagcagatcactcttagccggcagtccatgaaatatattctcgattacatcgacgatccgaatttcaccaagcacgaaatgacgatgatagacgagcaaaacgaaagggagtgcctgttgtcagtctatgacgaaatcctggagaaagtagataagtacttacctctctttgacgggaataaattccgcgagaagctgcatagtgcacgtaaggaatttgtgagcctttctgttgatgacgaggcctccgcgattgagaaaatcctgagaggcttgcacgctaactcagaaatgccaagtctcgaaaacctgaagattaaacccgccctaggattctttcagatgaagaatggcatcaccctgagcaacgatgcagtgcttctctatcagtcccctacagggctgttcgagcggagggtcaaagtgtctgacttgttaaagtga

SEQ ID NO: 3356 - RNA, 4308 nt, synthetic construct
  misc_feature 1..4308: note = Cas9 variant
  source 1..4308: mol_type = other RNA
atgaagaacatcctgggcctcgaccttgggaccacaagcattggattcgcccacatagtggaggatgaaaataaagagaagtccgaaatcaaagagctgggtgtcagaattgttcccttgactacggacgaacagtctgattttgagaagggcaaatcaatcaccacaaacgctaataggactttaaagcatggggcacggctgaacctagaccgctaccaacagcgacgtaagtatctcattgatctgcttcagaaagccaatctgatcaccagtagctccatattggcggagaacggaaagaatacaacccactctacttggcagctcagagctaaagccgtgacagaaaggatcgagaaggaagagttcgcacgggtactgctggccattaacaaaaagcgcggctacaagtcgtcaagaaaagctaagaccgaggacgaaggtcaagcaatcgatgggatggccattgctaaaaggctctatgacgagaatttaacgactggacagctgagccttcagttgctgcagcaaaacaagaaactactccctgatttttaccggagtgacctgcagaaggagttcgatcttgtgtggaattttcagaaacagttctatccagacatcctgaccgattccttttacaaggaattgcaaggcaagggcaaagacgccacatctaaggcgttcagcaaacgctatcattttgacactgcagaaaacaaggggtccaaagagtcagtccgactccaggcctaccagtggagagtggaggctataagtaagcaactgagcaaggaagaggttgcctacgtgttaaccgaaattaataacaatctgaacaacgcatctggatatctcggtgctatctccgataggtcaaaagagctttacttcaatcggcagacagtcggccagtatctgtacgcccagttgcaagaaaaccgtcacaatagcctaaagaacaaagtgttttatcgccaggactacctggatgagttcgagagaatttgggaaacccaggcgagttttcataaggagctcacggaggaactgaaaaagcagatcagggacgtagttatcttctatcaacggaagccgaaatctcagaaggggcttatttccttctgcgaatttgagagcaaagagatagaaatcgagaaggatggaaaaactattacaaagaccatcggcgcccgagtggtccccaagtcgtctcctctgttccaggaatttaaaatatggcagattttgaataacgtgatctgtaagcgcaaaggtatcagaaagaaaaaggtgtccgcaaaaactacacaactcgacctgttaaatgagtcaagtcagaccattttcagcctggatatggagtgcaagcagctactctttgaggaactgaaccttaagggggacttgaaatccgataaggtcctgaaactcctgggatactctccacaggaatgggagatcaattacaaccaacttgaaggcaataggacgcagaaggctctgtatgaggcctacttgaaaattgttgagatggaagctcacgacgtgaaggatatactccagatcaagagcgccaaagacgactggtcactggatgagagtcccttatccgcaagcgaaattcgggagtctgtaaaggccatcttccaagctctgggcatctgtaccaaaattctatattttgaccctctcctgccagtgaaggagttcgaaaaacaggattcataccagctttggcacttgctgtatagttacgagagcgacgattccacatctgggaacgaaactctctatcgcatactggagaagaagtacgcgtttaaaagagaacatgtcaggatcttagcaaatgtggccctgcaggacgattacggatcgcttagcaccaaggctattcgtaaaatctatcccaacattaaggagaatcaatactccatcgcctgcgaaatggcaggttataaacactcaaagttgagtctcacaactgaggagctggaagcccgggagctaaagaacataatccctctgctcaaaaagaacgctctgcgaaatccagttgtggaaaagattcttaaccagatgatcaatgtcgtgaacgccttgattgagaaaaattctgagagagacgcagaaggcaaaatcaccaagtacttccattttgatgagataaggattgaactggcgcgcgagctcaaaaagaacgctcagaagcggtatgaaatgacacagaatatcaacaaagccaagttagagcaccagaaaattagcgagatcctgcaaaagcagttcgggatcaaaaatccgaccaagtccgacataattagatacaggctttatcaggaactggagcacaacggatacaaggaattgtacactaatgcatatatcgcccccgatgtactctttagcaaaaacattgacatcgagcatatagttcctaaggctcgcgtgttcgatgactcattctctaataaaacgctggcctttcgagagttcaacattaagaaaggcgaatccacagcatttgactacatcaccagtctaaatagcgaggaggaactgaaccaatatctcactcgggtcgaaaacgcttacaagaccaagtctatctccccaacaaaatataagaatctgcttaaaaaggcctcagagattggtgatgacttcatcaaccgtgatttgagagacacccagtacattgcgaaaaaggccaaggaaatactgtttcaggtgactaaaaatgtcttaagtacaagcgggtcgatcacggataggctccgcgaggactggggcctggtggatgttatgaaggagcttaacatgcccaaatatcaatccctgggactaaccgaagtggaggaacggaaggacggcaataaagtaactgtcattaagaactggacaaagagaaatgatcacaggcatcacgctatggacgcactcaccgtggccttcacaaaaccttcttacatccagtacctgaaccatttgaatgctcgaaaggatgagaacaataaaaactatagcgttattctggccatcgaggaaaaggagactataaaagtgcgcaccaataacgggaagaataaacgggtctttatcgaaccaattcccaacttcagacaggtggcaaagaagcacttagaggaaatctttatttcacacaaaacgaagaacaaagtagtgaccaagaatgttaacaaaccggcgggaacagacaagcagcaaatcactctcacccctaggggtcagctgcataaggagacaatatacggcaaatatcagtactatgtcaataaggaggagaaaattggggtgaagttcgataaagaaactatcgccaaggtgagtaaccccctttaccgtgaagctctgttgaagcgcctccaggccaatgacaacgaccctaaaaaggcatttaccggcaaaaatgctctgtccaagaaaccaatctatctagatgagtctaagacgaagacactgcccgaaaaagtcaaccttacctacctcgaggaggacttcagcattcggaaggatatatccccagacaattttaaagatctgaagtcaatcgaaaaagttattgaccaaggagtgaagagaatcttgattaaaaggctgcaggcctacgataacgaccccaagaaggcattcgtggatttagagaaaaatcctatctggctcaacaaggaaaaaggtatagccatcaagcgagtaactattagcggggtcaataacgctcagccactgcacatcggcaaagaccatcttggaaagacaaccctgaataaggagggcaaagaaattccggtggattatgttagtactgggaacaatcaccacgtggcgatctaccgggacaaggagggaaacttgcaggagcaaatagtctctttctttgacgccgtggttcgcgcacagcagggtctccccattatcgataaaacctataagcaggctgaaggctggcaattcatgtttacaatgaaacagaacgagatgttcgtgtttcctaatgaaacgaccgggttcaacccagccgagatcgacctgctagatcccaagaataagaaactgatttcccctaacctttttagagtacagactatcagcgtcgtgaagtacggaaattcggtggtcagggacttcaaatttcggcatcacctcgagacaaccctgcaagatgacaagatattgcagggcattacattccagcagatcaaatcattagaaccactgcgaaacattgttaaggtgagaatcaatcatctcggtgatatagtatctattggggagtattga

SEQ ID NO: 3357 - RNA, 4308 nt, synthetic construct
  misc_feature 1..4308: note = Cas9 variant
  source 1..4308: mol_type = other RNA
atgaagaacatcctgggcctcgaccttgggaccacaagcattggattcgcccacatagtggaggatgaaaataaagagaagtccgaaatcaaagagctgggtgtcagaattgtttctttggctactgacgaacagtcagattttgagaagggcaaaagtatcagcacgaacgcaaataggaccttaaagcatggggcccggctgaacctagaccgctaccaacagcgacgtaagttcctcattgatctgcttcagaaagcgaatctgatcacatccgcttctatattggccgagaacggaaagaatactacccactcgacatggcagctcagagcaaaagccgtgaccgaaaggatcgagaaggaagagtttgctcgggtactgctggcaattaacaaaaagcgcggctataaaaattcaagaaaaactaagacagaggacgaaggtcaagccatcgatgggatggctattgccaaatgcctctacgacgagaacttaacccccggacagctgagccttcagttgctgcagcaaaataagaaactactccctgatttctataggagtgacctgcagaaggaatttgatcttgtgtggaacctgcagaaacagttctacccagacatcttgacggattccttttataaggagctccaaggcaagggcaaagacgcgacttctaaggcattcagcaaacggtaccattttgacaccgccgaaaataaggggtccaaagagtcagtccgcctgcaggcttatcagtggcgagccgaggcaataagtaagcaattaagcaaggaagaggtggcttacgttctgacagaaattaacaataacctcaacaattcttccggataccttggtgccatctcagatagaagcaaagagctgtatttcaacaggcagactgtgggccagtacttgtatgcgcagctacaagaaaatcggcacaacagtctgaagaataaagtcttttaccgtcaggactatctcgatgagttcgagcgcatttgggaaacccaggcctcttttcataaggagctgacagacgaacttaaaaagcagatcagagatgtggtaatcttctaccaaaggaagctgaaatcccagaaggggttggttagcttctgtgagtttgaatcgaaagagattgagatagaaaaggacggaaaagcaatcaccaagtctattggcgctcgggtggtcccgaagtcctcacccctcttccaggagtttaaaatctggcagatactgaacaatgtgacgtgcaagcgaaaaggtattcgcaagaaaaagagtagcgccaaatccactgaattagatctgttcaacgagccttctcaaagcatcttttcactagacatggagtgtaagcagctcctgttcgatgaacttaatttgaagggggacctgaaaagtgataaggtgctcaaactgcttggatattccccacaggagtgggaaatcaactacaatcagctggagggcaacagaacacaaaagagcttgtacgaagcatatctcaaaattatcgagattgagggctacgaagtcaaggacatactgcagatcaagtctaccaaagacgattggtcattagacgagagtcccctgagcgcctccgaaattagggagcgggttaaggtgatctttcagactctagggatctgcacaaaaattctctatttcgatcctctgcttccagtaaaggaatttgagcaacagtactcttatcagttgtggcatctgctctactcgtatgagagcgacgattccacctcaggaaatgaaacgctgtaccgcatattagagaaaaagtacgcattcaagagagaacacgccaccatcctggctaacgtggcgcttcaggacgattatggtagtttgtctacaaaagcaattaggaagatctacccctatattaaagagaatcaatacagcactgcctgtgaactcgctggctataagcactccaaactgtcactaaccacagaggagctggaagcccgtgagctcaagaacatcatacctctgcttaagaaaaacgcattgcggaatccagtcgtggaaaagatcctgaaccagatgattaatgttgtgaacgccttaatcgagaaaaatagcgagcgagacgctgaagggaagattactaaatactttcacttcgatgagatcagaatagaactcgccagggagctgaagaaaaacgcacaggaacgctatgagatgacccagaatattaacaaggcgaaacttgagcatcaaaagatctctgaaaagctgcagaaacagtttggaattaagaatccgacaaaatccgacatcatacggtacagattgtaccaggagctcgaacacaacggctataaggagctgtacaccaatacttatatcgctcccgatgtcctattcagtaagaacattgacatcgaacacattgtgcctaaagccagggtattcgatgacagcttttctaataagacgctggcattcaaagagtttaacatcaagaaaggtgagtccacagccttcgactacataacctcactcaattgcgaaggggagctgaaccaatatcttactcgcgttgaaaacgcttacaagaccaagagtattagcttgacaaaatataagaatctgttaaagaaggcctcggagatcggcgatggatttatcaaccgagacctccgggatacccagtacattgctaaaaaggctaaggaaatcctgttccaggtgactaaaaatgtcctttccacatctggcagcattacggaccgtctgagagaggattgggggctagtggacgtcatgaaggagctcaacatgccaaaataccaatcactgggattgaccgaagtggaggaaaggaaggatggtaataaagttactgtgataaaggactggacaaagcgcaacgatcatcggcaccatgccatggacgcgctgaccgtagcctttacaaaacccagttatatccagtacttaaatcacctcaacgctagaaaggatgagaataacaaaaattattccgtcattctggcaatcgagaagaaagaaactattaaggtgcctatcaacaatggcaaaaacaagagggttttcatagagccaatccttaattttcgacaggtggccaagaaacatctggaagagattttcatctctcacaaggctaaaaacaaggtcgtgaccaaaaacattaataagcccgccgggacggacaagcagcaaatcaccttgacaccgcgcggacagctccacaaagaaactatatacggcaagtatcagtactatgtaaacaaagaggagaaggtgggtgttaaatttgatgaacggaccattacaaaggtcagcaatcctctgtacagagaggcactactgaagaggcttcaggcgaacgacaatgaccccaaaaaggccttcgctgggaaaaacgccctctccaagaatccaatctacctggatgaagcaaaaactaagaccttgcctgagaaggtgaacctgacgtatttagaagaggacttttcaatccgtaaagatattagccccgacaatttcaaggatctcaaaagtatagagaaggtgatcgaccaaggcgtcaaacgcattctgatcaagcggcttcaggcttacgataacgaccccaaaaaggccttcgttgatctggaaaagaatccaatttggttgaacaaagagaagggaatcgcaataaaaagagtgacaatctctggcgtgtccaatgcccagcctctccatattgggaaggaccacctgggaaaaaccactctaaacaaggaaggtaaggaggtaccagtcgattatgtgagcacaggcaataaccatcacgttgctatctacagggacaaagaagggaatctgcaggagcaaattgtgtcgtttttcgaggcggtcgtgcgagcccagcagggacttccgatcatagacaagaactataaacaggcagaaggctggcaatttatgttcaccatgaagcagaacgagatgtttgttttccccaatgaagctactggttttaaccctgccgagattgatctcctggaccccaaaaataagaagttgatctcaccaaacttattccgggtgcagaccatctctattgtaaaatacgggaatagtgtcgtgcgcgattttaagttcagacaccatctggagacaacgctccaagacgataaaatcctgcagggcataacctttcagcagattaagtcccttgaacctctgaggaacatcgtgaaagtccggattaatcacttgggagacatcgttaacataggcgagtattga

SEQ ID NO: 3358 - RNA, 4311 nt, synthetic construct
  misc_feature 1..4311: note = Cas9 variant
  source 1..4311: mol_type = other RNA
atgaagagaatcctgggcctcgaccttgggaccaacagcattggatgggccctggtgaatgaggctgaaaacaaagatgagaggtcctctatagtcaagttgggtgttcgggtgaatcccttaacagtagacgaactgactaacttcgagaaaggcaagtcaatcacgaccaatgcagatcgcacactaaaacgagggatgcgtagaaacctccagaggtacaagctgcggcgcgaaactcttaccgaggtgctgaaggagcacaaattgattacagaagacaccatcctcagtgagaatggaaacagaactacatttgaaacctataggctgcgggccaaggcggtcacggaggagattagcctggaagagttcgctcgcgtgctcttaatgatcaataaaaagcgaggctacaaatcctctagaaaggccaagggtgttgaagaggggactctgatagatggaatggacatcgcaagggaactttataacaataacttgacccctggcgagctgtgcctacaactcctggatgccggcaaaaagtttcttccagacttctaccggtcggatctgcagaatgagttggaccgtatttgggaaaaacagaaggagtattacccggaaatcctcacagatgtgctgaaagaggaattacgcgggaagaaaagagacgctgtctgggcaatttgtgccaagtattttgtgtggaaggagaactacactgagtggaataaagaaaagggaaaaaccgagcagcaagaaagggagcataagctggaaggtatctactcaaaacggaagcgagatgaggctaagcgcgagaacctccagtggagagtaaacggccttaaagaaaagctgagcttggagcagctagttatagtgttccaggaaatgaatacacaaattaacaatagttccgggtatctgggagccatctctgacaggagcaaagagctctactttaacaagcagaccgtcggccagtatcagatggagatgctggacaaaaatcccaacgcgtcccttcggaatatggtgttctaccgccaagattatctggacgaatttaacatgttgtgggagaagcaggcagtgtaccacaaggaactcacggaggaactgaaaaaggagattagagatatcatcattttctatcagaggcgtttaaaatcacaaaagggtctgatagggttttgcgagttcgaaagtcggcagatcgaggtcgacattgatggcaaaaagaagatcaaaactgttggaaatcgagtgataagcagatcttcccctctatttcaggaatttaagatttggcagatcctcaacaatatcgaggtaacagtggtcggcaaaaagaggaaacgccggaagctgaaagaaaactactcagcccttttcgaggagttgaatgacgctgaacaactggagctcaacgggagcagaaggctgtgtcaggaagagaaggaacttctggcccaggagttgtttgtgcgcgataagatgaccaaaagtgaggttctcaagctgttattcgacaatccacaggaactggatctaaactttaaaactattgacggaaacaagacaggttacgcactcttccaggcttattctaaaatgatcgagatgtccggccatgaacccgtggattttaagaagcctgtcgagaaagtggtagagtacattaaggccgttttcgacctgcttaattggaacaccgacatattggggtttaatagcaacgaagaactggataatcaatcgtattacaaactctggcacctgttatattctttcgaaggagacaacacgccaaccggcaatggtcgactgatccagaagatgacagagctttacgggtttgaaaaagagtatgcgactattttggccaacgtgtccttccaggatgactacggctcactcagtgcaaaggctatccataagatcctgccccacctaaaagagggaaatcggtacgatgtcgcctgcgtgtatgctggctaccgtcacagcgaatcctctctgaccagagaggaaattgccaacaaggtcctcaaagacaggctgatgcttttgcctaagaatagcctgcataacccagtggttgagaaaatattaaatcaaatggtgaacgtaatcaatgtcattatcgatatttatgggaagccggacgaaatccgcgtggagctcgcacgggagctgaagaaaaacgccaaggaaagagaggaacttacaaaatcaatagctcagactaccaaggcgcacgaggaatacaaaacactgttgcagaccgagtttggactcactaacgttagtaggacggatatcctgcgatataagctatacaaagagctggaatcctgtggttataagacactctacagcaatacctacatttctcgcgagaagctgttctcaaaagaatttgacatcgagcatattatcccccaggcacggcttttcgatgacagtttcagcaacaagactttggaggccagatccgtgaatatagaaaaaggcaacaataccgcttatgattttgtcaaggagaaattcggggaatctggagccgacaactcgctggagcaatacttaaataacattgaagacctctttaagagcggcaagatctccaaaacaaagtataataaactgaagatggcagagcaggatattcctgacggtttcatcgagagggatcttcgtaacacccagtacatagccaaaaaggctctgtcaatgctaaatgaaatcagtcaccgcgtggtagccacttctgggagcgtgacagacaagctccgggaggattggcaactgattgacgttatgaaagaattgaactgggagaagtataaagcactgggcttagtcgaatactttgaggatagagacggaaggcagatcggccgaattaaggattggacgaaacggaatgaccaccgccatcacgcgatggatgctctcaccgtggccttcactaaggacgtgtttatccagtatttcaacaataagaacgcatccctggatccaaacgccaatgagcatgctattaaaaacaagtactttcagaatgggagagccatagcacccatgcctcttagggagttccgggctgaggccaaaaagcacctggaaaacacattgatctcaatcaaagcgaagaataaggtcattaccggaaacatcaataaaacacgaaagaaaggtggcgttaacaagaatatgcaacagactccaagagggcagctccatctggagaccatttacggaagcggcaaacagtatctaacgaaggaagagaaagtgaacgcctcttttgacatgcgcaagataggtaccgtgtccaagagtgcttacagggacgcactgcttaaacgtctctatgagaatgataacgaccccaagaaagccttcgctgggaagaatagcctggataaacaaccgatctggttggacaaggaacagatgcggaaggtacctgagaaagtcaagattgtgacactggaagccatctacactattagaaaagagatctctcccgatttaaaggttgacaaagtgatagatgtcggcgtgaggaagatcctcattgaccgcctgaacgagtatggaaatgatgcaaagaaagcgttttccaaccttgacgaaaatccaatctggctgaacaaggagaaaggcatttcaatcaagcgagttaccataagtgggattagcaacgcccagtcgttgcacgtgaaaaaggataaggacggaaaacctatcctcgacgaaaatggcagaaacatccccgtagatttcgtcaatacaggtaacaatcaccatgtggctgtgtactatcggccagtcattgacaagagggggcagctggttgtggatgaggccggaaaccccaaatacgaactagaggaggtagtggtctccttctttgaagcagtgactcgcgctaatctgggccaacctataatcgacaaggattacaaaaccacggagggttggcagttccttttctctatgaagcagaacgaatatttcgtttttccaaatgagaaaacaggcttcaacccgaaggaaattgacctcctggatgtggagaattacgggttgatcagccccaacttatttcgtgtccaaaagttctcactgaaaaattatgtgtttagacaccatctcgagaccactattaaggacacaagttccatcctgcggggaataacctggatcgatttcaggtctagcaaaggccttgacactattgttaaggtgcgcgtcaaccacatcgggcagattgtatccgtgggagaatactga

SEQ ID NO: 3359 - RNA, 4311 nt, synthetic construct
  misc_feature 1..4311: note = Cas9 variant
  source 1..4311: mol_type = other RNA
atgaagagaatcctgggcctcgaccttgggaccaacagcattggatgggccctggtgaatgaggctgaaaacaaagatgagaggtcctctatagtcaagttgggtgttcgggtgaatcccttaacagtagacgaactgactaacttcgagaaaggcaagtcaatcacgaccaatgcagatcgcacactaaaacgagggatgcgtagaaacctccagaggtacaagctgcggcgcgaaactcttaccgaggtgctgaaggagcacaaattgattacagaagacaccatcctcagtgagaatggaaacagaactacatttgaaacctataggctgcgggccaaggcggtcacggaggagattagcctggaagagttcgctcgcgtgctcttaatgatcaataaaaagcgaggctacaaatcctctagaaaggccaagggtgttgaagaggggactctgatagatggaatggacatcgcaagggaactttataacaataacttgacccctggcgagctgtgcctacaactcctggatgccggcaaaaagtttcttccagacttctaccggtcggatctgcagaatgagttggaccgtatttgggaaaaacagaaggagtattacccggaaatcctcacagatgtgctgaaagaggaattacgcgggaagaaaagagacgctgtctgggcaatttgtgccaagtattttgtgtggaaggagaactacactgagtggaataaagaaaagggaaaaaccgagcagcaagaaagggagcataagctggaaggtatctactcaaaacggaagcgagatgaggctaagcgcgagaacctccagtggagagtaaacggccttaaagaaaagctgagcttggagcagctagttatagtgttccaggaaatgaatacacaaattaacaatagttccgggtatctgggagccatctctgacaggagcaaagagctctactttaacaagcagaccgtcggccagtatcagatggagatgctggacaaaaatcccaacgcgtcccttcggaatatggtgttctaccgccaagattatctggacgaatttaacatgttgtgggagaagcaggcagtgtaccacaaggaactcacggaggaactgaaaaaggagattagagatatcatcattttctatcagaggcgtttaaaatcacaaaagggtctgatagggttttgcgagttcgaaagtcggcagatcgaggtcgacattgatggcaaaaagaagatcaaaactgttggaaatcgagtgataagcagatcttcccctctatttcaggagttcaagatttggcagatcctcaacaatatcgaggtaacagtggtcggcaaaaagaggaaacgccggaagctgaaagaaaactactcagcccttttcgaggagttgaatgacgctgaacaactggagctcaacgggagcagaaggctgtgtcaggaagagaaggaacttctggcccaggagttgtttattcgcgataagatgaccaaaagtgaggtgctcaagctgttattcgacaatccacaggaactggatctaaactttaaaactatcgacggaaacaagacaggttacgcactcttccaagcatattctaaaatgattgagatgtccggccatgaacccgttgattttaagaagcctgtggagaaagtcgtggagtacataaaggccgtattcgacctgcttaattggaacaccgacatcttggggtttaatagcaacgaagaactggataatcagccatattacaaactctggcacctgttatattcgttcgaaggagacaacacgcccaccggcaatggtcgactgattcagaagatgacagagctttacgggtttgaaaaagagtatgcgactatcttggccaacgtttctttccaggatgactacggctccctctcagcaaaggctatccataagattctgcctcacctaaaagagggaaatcggtacgatgtggcctgcgtctatgctggctaccgtcacagtgaaagctccctgaccagagaggaaatagccaacaaggtgctcaaagacaggctgatgcttttgccaaagaatagtctgcataacccggtcgtggagaaaatcttaaatcaaatggttaacgtgattaatgtaatcattgatatctatgggaagcccgacgaaatacgcgtcgagctcgcacgggagctgaagaaaaacgccaaggaaagagaggaacttacaaaaagcatcgctcagactaccaaggcgcacgaggaatacaaaacactgttgcagaccgagtttggactcactaacgtgtcaaggacggatattctgcgatataagctatacaaagagctggaaagttgtggttataagacactctactccaatacctacatcagccgcgagaagctgttctctaaagaatttgacattgagcatatcatacctcaggcacggcttttcgatgactcattcagtaacaagactttggaggccagaagcgttaatattgaaaaaggcaacaagaccgcttatgattttgtgaaagagaagttcggggaatccggagccgacaattctctggagcactacttaaacaatatcgaagacctctttaagtcgggcaaaattagcaagacaaaatataacaagctgaaaatggcagagcaagatatcccagacggtttcatagagagggatcttcgtaatacccagtacatcgccaagaaggctctgtccatgctaaacgaaatttcacaccgcgtcgtggccacttctgggtctgtaacagacaaactccgggaggattggcagctgatcgacgtgatgaaggaattgaattgggagaaatataaggcactgggcttagttgaatactttgaggatagagacggaaggcaaattggccgaatcaaagattggacgaagcggaacgaccatcgccaccatgcgatggatgctctcaccgtcgccttcactaaggacgtgtttatacagtatttcaataacaaaaatgcaagcctggatcccaacgccaacgagcacgctattaagaataaatactttcagaacgggagagccatcgcacctatgccacttagggagttccgggctgaagccaagaaacatctggaaaatacattgatctccattaaggcgaagaacaaagtgatcaccggaaatattaacaagacacgaaagaaaggtggcgtcaataaaaacatgcagcaaactcccagagggcagctccacctggagaccatatacggatcaggcaagcagtatctaacgaaagaagagaaggttaatgccagctttgacatgcgcaagatcggtaccgtgtctaaatccgcttacagggacgcactgcttaagcgtctctatgagaacgataatgacccgaaaaaggccttcgctgggaaaaacagtctggataagcagcctatttggttggacaaggaacaaatgcggaaagtgcccgagaaggtaaaaatcgtcacactggaagccatttacactatcagaaaggagataagcccagatttaaaagtggacaaggttatcgatgtgggcgtcaggaagattctcatcgaccgcctgaatgagtatggaaacgatgctaaaaaggcgttttctaatcttgacaaaaaccctatttggctgaataaggaaaaaggcatctccataaagcgagtgaccatttcagggatcagtaacgcccagagcttgcacgttaagaaagataaggacggaaaacccatcctcgacgagaacggcagaaatattccagtggatttcgtaaacacaggtaataaccatcacgtcgctgtgtactatcggcccgtgatagacaagagggggcagctggtcgttgatgaagccggaaatcctaaatacgagctagaagaggtggtagtgtcgttctttgaggcagtcactcgcgctaacctgggccttccaatcattgacaaggattacaaaaccacggaaggttggcagttcctcttttccatgaagcaaaatgagtatttcgtgtttccgaacgaaaagacaggcttcaatcccaaagagatcgacctgttggatgttgaaaactacgggttaatttctcctaatctgtttcgtgtgcagaagttcagcctcaaaaactatgtctttagacatcacctggagaccactatcaaggacacatcaagtatacttcggggaatcacctggattgatttcaggtcctctaaaggcctggacactatcgtgaaggttcgcgtgaatcacattgggcagatcgtcagcgtaggagagtactga

SEQ ID NO: 3360 - RNA, 4311 nt, synthetic construct
  misc_feature 1..4311: note = Cas9 variant
  source 1..4311: mol_type = other RNA
atgaagagaatcctgggcctcgaccttgggaccaacagcattggatgggccctggtgaatgaggctgaaaacaaagatgagaggtcctctatagtcaagttgggtgttcgggtgaatcccttaacagtagacgaactgactaacttcgagaaaggcaagtcaatcacgaccaatgcagatcgcacactaaaacgagggatgcgtagaaacctccagaggtacaagctgcggcgcgaaactcttaccgaggtgctgaaggagcacaaattgattacagaagacaccatcctcagtgagaatggaaacagaactacatttgaaacctataggctgcgggccaaggcggtcacggaggagattagcctggaagagttcgctcgcgtgctcttaatgatcaataaaaagcgaggctacaaatcctctagaaaggccaagggtgttgaagaggggactctgatagatggaatggacatcgcaagggaactttataacaataacttgacccctggcgagctgtgcctacaactcctggatgccggcaaaaagtttcttccagacttctaccggtcggatctgcagaatgagttggaccgtatttgggaaaaacagaaggagtattacccggaaatcctcacagatgtgctgaaagaggaattacgcgggaagaaaagagacgctgtctgggcaatttgtgccaagtattttgtgtggaaggagaactacactgagtggaataaagaaaagggaaaaaccgagcagcaagaaagggagcataagctggaaggtatctactcaaaacggaagcgagatgaggctaagcgcgagaacctccagtggagagtaaacggccttaaagaaaagctgagcttggagcagctagttatagtgttccaggaaatgaatacacaaattaacaatagttccgggtatctgggagccatctctgacaggagcaaagagctctactttaacaagcagaccgtcggccagtatcagatggagatgctggacaaaaatcccaacgcgtcccttcggaatatggtgttctaccgccaagattatctggacgaatttaacatgttgtgggagaagcaggcagtgtaccacaaggaactcacggaggaactgaaaaaggagattagagatatcatcattttctatcagaggcgtttaaaatcacaaaagggtctgatagggttttgcgagttcgaaagtcggcagatcgaggtcgacattgatggcaaaaagaagatcaaaactgttggaaatcgagtgataagcagatcttcccctctatttcaggagttcaagatttggcagatcctcaacaatatcgaggtaacagtggtcggcaaaaagaggaaacgccggaagctgaaagaaaactactcagcccttttcgaggagttgaatgacgctgaacaactggagctcaacgggagcagaaggctgtgtcaggaagagaaggaacttctggcccaggagttgtttattcgcgataagatgaccaaaagtgaggtgctcaagctgttattcgacaatccacaggaactggatctaaactttaaaactatcgacggaaacaagacaggttacgcactcttccaagcatattctaaaatgattgagatgtccggccatgaacccgttgattttaagaagcctgtggagaaagtcgtggagtacataaaggccgtattcgacctgcttaattggaacaccgacatcttggggtttaatagcaacgaagaactggataatcagtcgtattacaaactctggcacctgttatattctttcgaaggagacaacacgccaaccggcaatggtcgactgattcagaagatgacagagctttacgggtttgaaaaagagtatgcgactatcttggccaacgtttccttccaggatgactacggctcactcagtgcaaaggctatccataagattctgccccacctaaaagagggaaatcggtacgatgtggcctgcgtctatgctggctaccgtcacagcgaatcctctctgaccagagaggaaatagccaacaaggtgctcaaagacaggctgatgcttttgcctaagaatagcctgcataacccagtcgtggagaaaatcttaaatcaaatggttaacgtgattaatgtaatcattgatatctatgggaagccggacgaaatacgcgtcgagctcgcacgggagctgaagaaaaacgccaaggaaagagaggaacttacaaaatcaatcgctcagactaccaaggcgcacgaggaatacaaaacactgttgcagaccgagtttggactcactaacgtgagtaggacggatattctgcgatataagctatacaaagagctggaatcctgtggttataagacactctacagcaatacctacatctctcgcgagaagctgttctcaaaagaatttgacattgagcatatcataccccaggcacggcttttcgatgacagtttcagcaacaagactttggaggccagatccgttaatattgaaaaaggcaacaagaccgcttatgattttgtgaaagagaagttcggggaatctggagccgacaattcgctggagcactacttaaacaatatcgaagacctctttaagagcggcaaaatttccaagacaaaatataacaagctgaaaatggcagagcaagatatccctgacggtttcatagagagggatcttcgtaatacccagtacatcgccaagaaggctctgtcaatgctaaacgaaattagtcaccgcgtcgtggccacttctgggagcgtaacagacaaactccgggaggattggcagctgatcgacgtgatgaaggaattgaattgggagaaatataaggcactgggcttagttgaatactttgaggatagagacggaaggcaaattggccgaatcaaagattggacgaagcggaacgaccatcgccaccatgcgatggatgctctcaccgtcgccttcactaaggacgtgtttatacagtatttcaataacaaaaatgcatccctggatccaaacgccaacgagcacgctattaagaataaatactttcagaacgggagagccatcgcacccatgcctcttagggagttccgggctgaagccaagaaacatctggaaaatacattgatctcaattaaggcgaagaacaaagtgatcaccggaaatattaacaagacacgaaagaaaggtggcgtcaataaaaacatgcagcaaactccaagagggcagctccacctggagaccatatacggaagcggcaagcagtatctaacgaaagaagagaaggttaatgcctcttttgacatgcgcaagatcggtaccgtgtccaaactggcttacagggacgcacttctcaagcgtctgtatgagaacgataatgaccccaaaaaggccttcgctgggaaaaacagtttggataagcagccgatttggctggacaaggaacaaatgcggaaagtgcctgagaaggtaaaaatcgtcacattagaagccatttacactatcagaaaggagataagccccgatctcaaagtggacaaggttatcgatgtgggcgtcaggaagattctgatcgaccgccttaatgagtatggaaacgatgctaaaaaggcgttttctaatctggacgaaaacccaatttggttgaataaagagaagggcatctccataaaacgagtgaccatttcagggatcagtaacgcccagagcctccacgttaagaaggataaagacggaaagcctatcctggacgaaaacggcagaaatattcccgtggatttcgtaaacacaggtaataaccatcacgtcgctgtgtactatcggccagtgatagacaaaagggggcagctagtcgttgatgaggccggaaatcccaagtacgaactggaggaggtggtagtgtcgttctttgaagcagtcactcgcgctaaccttggccagcctatcattgacaaagattacaagaccacggagggttggcaattcctcttttccatgaaacagaatgaatatttcgtgtttccaaacgagaagacaggcttcaatccgaaggaaatcgacctgttggatgttgagaactacgggttaatttctcccaatctgtttcgtgtgcagaaattcagcctcaagaactatgtctttagacatcacctggagaccactatcaaagacacatcaagtatacttcggggaatcacctggattgatttcaggtcctctaagggcctggacactatcgtgaaagttcgcgtgaatcacattgggcaaatcgtcagcgtaggagaatactga

SEQ ID NO: 3361 - RNA, 4311 nt, synthetic construct
  misc_feature 1..4311: note = Cas9 variant
  source 1..4311: mol_type = other RNA
atgaagagaatcctgggcctcgaccttgggaccaacagcattggatgggccctggtgaatgaggctgaaaacaaagatgagaggtcctctatagtcaagttgggtgttcgggtgaatcccttaacagtagacgaactgactaacttcgagaaaggcaagtcaatcacgaccaatgcagatcgcacactaaaacgagggatgcgtagaaacctccagaggtacaagctgcggcgcgaaactcttaccgaggtgctgaaggagcacaaattgattacagaagacaccatcctcagtgagaatggaaacagaactacatttgaaacctataggctgcgggccaaggcggtcacggaggagattagcctggaagagttcgctcgcgtgctcttaatgatcaataaaaagcgaggctacaaatcctctagaaaggccaagggtgttgaagaggggactctgatagatggaatggacatcgcaagggaactttataacaataacttgacccctggcgagctgtgcctacaactcctggatgccggcaaaaagtttcttccagacttctaccggtcggatctgcagaatgagttggaccgtatttgggaaaaacagaaggagtattacccggaaatcctcacagatgtgctgaaagaggaattacgcgggaagaaaagagacgctgtctgggcaatttgtgccaagtattttgtgtggaaggagacttacaccgagtggaacaaagaaaagggaaaaacagagcagcaagaaagggagcataagctggaaggtatctactcaaaacggaagcgagatgaggctaagcgcgagaatctccagtggagagtaaacggccttaaagaaaagctgagcttggagcagctagttatagtgttccaggaaatgaacacccaaattaataacagttccgggtatctgggagccatctctgacaggagcaaagagctctactttaataagcagacggtcggccagtatcagatggagatgctggacaaaaaccccaatgcgtcccttcggaacatggtgttctaccgccaagattatctggacgaatttaatatgttgtgggagaagcaggcagtgtaccacaaggaactcactgaggaactgaaaaaggagattagagatatcatcattttctatcagaggcgtttaaaatcacaaaagggtctgatagggttttgcgagttcgaaagtcggcagatcgaggtcgacattgatggaaagaagaagatcaaaacagttggcaaccgagtgataagcagatcttcccctctatttcaggagttcaagatttggcagatcctcaataacatcgaagtaaccgtggtcggcaaaaagaggaaacgccggaagctgaaagaaaattactcagccattttcgaggagcttaacgacgctgaacaattggagctgaatgggagcagaaggctctgtcaggaagagaaggaactgcttgcccaggagctgtttgtgcgcgataagatgactaaaagtgaggttttgaagctcctgttcgacaacccacaggaattagatctgaattttaaaacaatcgacggaaacaagaccggttacgcactattccaggcttattctaaaatgattgagatgtccggccatgaacccgtggattttaagaagcctgtcgagaaagtggtagagtacataaaggccgttttcgacctcctgaactggaatacggacatccttgggtttaacagcaatgaagagttggataaccaatcgtattacaaactgtggcacctcctgtattctttcgaaggagacaataccccaacaggcaacggtcgattaattcagaagatgactgagctgtacgggtttgaaaaagagtatgcgaccatccttgccaatgtgtccttccaggatgactacggctcattgagtgcaaaggctatccataagattctcccccacctgaaagagggaaaccggtacgatgtcgcctgcgtgtatgctggctaccgtcacagcgaatcctctctaacaagagaggaaatagccaataaggtcctgaaagacaggctcatgctgcttcctaagaacagcttgcataatccagtggttgagaaaatcctgaaccaaatggtgaatgtaattaacgtcatcattgatatctatgggaagccggacgaaatacgcgtggagttagcacgggagctcaagaaaaatgccaaggaaagagaggaactgactaaatcaatcgctcagaccacaaaggcgaacgaggaatacaaaacccttctgcagactgagtttggattgacgaacgttagtaggacagatattctccgatataagctgtacaaagagctagaatcctgtggttataagaccctgtacagcaatacttacatctctcgcgagaaactcttctcaaaagaatttgacattgagcacatcataccccaggcacggctgttcgatgacagtttcagcaacaagacccttgaggccagatccgtgaatattgaaaaaggcaacaagacagcttatgattttgtcaaagagaagttcggggaatctggagccgacaattcgttggagcattacctgaacaatatcgaagacttatttaagagcggcaaaatttccaagaccaaatataacaagctcaaaatggcaaagcaagatatccctgacggtttcatagagagggatctgcgtaatactcagtacatcgccaagaaagctctttcaatgctgaacgagattagtcaccgcgtggtagccacatctgggagcgtgacggacaagctacgggaagattggcagctcatcgacgttatgaaagagctgaattgggaaaagtataaagcattgggcctggtcgagtactttgaagatagagacggaaggcaaattggccgaatcaaggattggaccaagcggaacgaccaccgccatcacgcgatggatgctttaactgtggccttcacaaaagacgtgtttatacagtatttcaataacaagaatgcatccctcgatccaaacgccaacgagcatgctattaaaaataagtactttcagaacgggagagccatcgcacccatgcctctgagggagttccgggctgaagccaaaaagcaccttgagaataccctgatctcaattaaggcgaaaaacaaggtcatcacaggaaatattaacaaaactcgaaagaaaggtggcgttaataagaacatgcagcaaaccccaagagggcagttgcatctcgaaacgatatacggaagcggcaaacagtatctgaccaaggaggaacgcgtgaatgcctcttttgacatgaggaagatcgagacagtgtccaaaagtgcttaccgtgacgcactactgaagcggctttatgagaacgataatgaccccaaaaaggccttcgctggtaaaaacagcctcgataagcagccgatttggctggacaaggaacagaaaagaaaggtacctgagaaagtcaagatcgtgactttggaagccatttacaccatcaggaaagagatatctcccgatctgaaggttgacaaggtgatcgatgtcggggtgcgcaaaattttaatcgaccgactcaatgagtatggcaacgatgcaaagaaagcgttttccaatctggacgaaaacccaatttggcttaataaggagaaaggaatctcaataaagagagttacaattagtggcatcagcaacgcccaatcgctgcacgtgaagaaagataaggacgggaaacctatcttggacgaaaacggacggaatattcccgtagatttcgtcaacactggcaataaccaccatgtggctgtgtactataggccagtcatagacaagcgcggtcagctcgttgtggatgaggccgggaatcccaaatacgaactggaggaggtagtggtctccttctttgaagcagtgacccgtgctaacctaggacagcctatcattgacaaggattacaaaacgacagagggctggcaattcctgttttctatgaagcagaatgaatatttcgtttttccaaacgagaagaccggtttcaatccgaaagaaatcgaccttctcgatgtggagaactacggcctgattagccccaatttgtttagagtccagaagttctcactgaaaaactatgtgtttcggcaccatttagagactacaatcaaggacaccagttccatactcagggggatcacttggattgatttccgctctagcaaaggactggacaccatcgttaaggtgcgagtcaatcacattggccaaatcgtatccgtgggggaatactga

SEQ ID NO: 3362 - RNA, 4311 nt, synthetic construct
  misc_feature 1..4311: note = Cas9 variant
  source 1..4311: mol_type = other RNA
atgaagagaatcctgggcctcgaccttgggaccaacagcattggatgggccctggtgaatgaggctgaaaacaaagatgagaggtcctctatagtcaagttgggtgttcgggtgaatcccttaacagtagacgaactgactaacttcgagaaaggcaagtcaatcacgaccaatgcagatcgcacactaaaacgagggatgcgtagaaacctccagaggtacaagctgcggcgcgaaactcttaccgaggtgctgaaggagcacaaattgattacagaagacaccatcctcagtgagaatggaaacagaactacatttgaaacctataggctgcgggccaaggcggtcacggaggagattagcctggaagagttcgctcgcgtgctcttaatgatcaataaaaagcgaggctacaaatcctctagaaaggccaagggtgttgaagaggggactctgatagatggaatggacatcgcaagggaactttataacaataacttgacccctggcgagctgtgcctacaactcctggatgccggcaaaaagtttcttccagacttctaccggtcggatctgcagaatgagttggaccgtatttgggaaaaacagaaggagtattacccggaaatcctcacagatgtgctgaaagaggaattacgcgggaagaaaagagacgctgtctgggcaatttgtgccaagtattttgtgtggaaggagacttacaccgagtggaacaaagaaaagggaaaaacagagcagcaagaaaaggagcataaactggaaggtatctactcaaagaggaagcgggatgaggctaaacgagagaatctccagtggcgcgtaaacggccttaaggaaaaactgagcttggagcagctagttatagtgttccaggaaatgaacacccaaattaataacagttccgggtatctgggagccatctctgacagaagcaaggagctctactttaataaacagacggtcggccagtatcagatggagatgctggacaagaaccccaatgcgtcccttaggaacatggtgttctaccggcaagattatctggacgaatttaatatgttgtgggagaagcaggcagtgtaccacaaagaactcactgaggaactgaagaaagagattcgcgatatcatcattttctatcagagaaggttaaagtcacaaaaaggtctgatagggttttgcgagttcgaaagtcgtcagatcgaggtcgacattgatggaaagaagaaaatcaagacagttggcaaccgggtgataagccgatcttcccctctatttcaggagttcaaaatttggcagatcctcaataacatcgaggtaaccgtggtcggcaagaaaagaaagaggcgcaaactgaaggaaaattactcagcccttttcgaggagttgaacgacgctgaacaactggagctcaatgggagccggagactgtgtcaggaagagaaggaacttctggcccaggagttgtttattagggataaaatgactaagagtgaggtgctcaaactgttattcgacaacccacaggaactggatctaaattttaagacaatcgacggaaacaaaaccggttacgcactcttccaggcttattctaagatgattgagatgtccggccatgaacccgttgattttaagaaacctgtggagaaggtcgtggagtacataaaagccgtattcgacctgcttaactggaatacggacatcttggggtttaacagcaatgaagaactggataaccaatcgtattacaagctctggcacctgttatattctttcgaaggagacaataccccaacaggcaacggtcgcctgattcagaaaatgactgagctttacgggtttgaaaaggagtatgcgaccatcttggccaatgtttccttccaggatgactacggctcactcagtgcaaaggctatccataaaattctgccccacctaaaggagggaaaccgatacgatgtggcctgcgtctatgctggctaccggcacagcgaatcctctctgacacgtgaggaaatagccaataaagtgctcaaggacagactgatgcttttgcctaaaaacagcctgcataatccagtcgtggagaagatcttaaaccaaatggttaatgtgattaacgtaatcattgatatctatgggaagccggacgaaataagggtcgagctcgcacgcgagctgaaaaagaatgccaaagaacgggaggaacttactaagtcaatcgctcagaccacaaaagcgcacgaggaatacaagaccctgttgcagactgagtttggactcacgaacgtgagtagaacagatattctgaggtataaactatacaaggagctggaatcctgtggttataagaccctctacagcaacacttacatctctcgagagaaactgttctcaaaggaatttgacattgagcatatcataccccaggcacgccttttcgatgacagtttcagcaataaaaccttggaggcccggtccgttaacattgaaaagggcaataaaacagcttatgattttgtgaaggagaagttcggggaatctggagccgacaactcgctggagcactacttaaataacatcgaagacctctttaaaagcggcaagatttccaaaaccaagtataataaactgaagatggcagagcaagatatccctgacggtttcatagagagagatcttaggaacactcagtacatcgccaagaaagctctgtcaatgctaaatgaaattagtcaccgtgtcgtggccacatctgggagcgtaacggacaagctccgcgaggattggcagctgatcgacgtgatgaaagaattgaactgggagaagtataaagcactgggcttagttgaatactttgaggatcgggacggaagacaaattggcaggatcaaggattggaccaagcgaaatgaccatcggcaccatgcgatggatgctctcactgtcgccttcacaaaagacgtgtttatacagtatttcaacaataagaacgcatccctggatccaaatgccaacgagcacgctattaaaaacaagtactttcagaatgggcgcgccatcgcacccatgcctcttagagagttcagggctgaagccaaaaagcatctggaaaacaccttgatctcaattaaggcgaaaaataaggtgatcacaggaaacattaataaaactcggaagaaaggtggcgtcaacaagaatatgcagcaaaccccacgagggcagctccacctggagacgatatacggaagcggcaaacagtatctaaccaaggaagagaaggttaacgcctcttttgacatgagaaaaatcggtacagtgtccaagctggcttaccgcgacgcacttctcaaaaggctgtatgagaatgataacgaccccaagaaagccttcgctgggaagaatagtttggataagcagccgatttggctggacaaagaacaaatgcgtaaggtgcctgagaaagtaaagatcgtcactttagaagccatttacaccatccggaaagagataagccccgatctcaaggtggacaaggttatcgatgtgggcgtcagaaaaattctgatcgacaggcttaacgagtatggaaatgatgcaaagaaagcgttttctaacctggacgaaaatccaatttggttgaacaaggagaaaggcatctccataaagcgcgtgacaatttcagggatcagtaatgcccagagcctccacgttaagaaagataaggacggaaaacctatcctggacgaaaacggccgaaacattcccgtggatttcgtaaatactggtaacaatcatcacgtcgctgtgtactatagaccagtgatagacaagcgggggcagctagtcgttgatgaggccggaaaccccaaatacgaactggaggaggtggtagtgtcgttctttgaagcagtcaccagggctaatcttggccagcctatcattgacaaggattacaaaacgacagagggttggcaattcctcttttccatgaagcagaacgaatatttcgtgtttccaaatgagaagaccggcttcaacccgaaagaaatcgacctgttggatgttgagaattacgggttaatttctcccaacctgtttcgcgtgcagaagttcagcctcaaaaattatgtctttcgtcatcacctggagactacaatcaaggacacctcaagtatacttagaggaatcacttggattgatttccggtcctctaaaggcctggacaccatcgtgaaggttagggtgaaccacattgggcaaatcgtcagcgtaggagaatactga

SEQ ID NO: 3363 - RNA, 4311 nt, synthetic construct
  misc_feature 1..4311: note = Cas9 variant
  source 1..4311: mol_type = other RNA
atgaagagaatcctgggcctcgaccttgggaccaacagcattggatgggccctggtgaatgaggctgaaaacaaagatgagaggtcctctatagtcaagttgggtgttcgggtgaatcccttaacagtagacgaactgactaacttcgagaaaggcaagtcaatcacgaccaatgcagatcgcacactaaaacgagggatgcgtagaaacctccagaggtacaagctgcggcgcgaaactcttaccgaggtgctgaaggagcacaaattgattacagaagacaccatcctcagtgagaatggaaacagaactacatttgaaacctataggctgcgggccaaggcggtcacggaggagattagcctggaagagttcgctcgcgtgctcttaatgatcaataaaaagcgaggctacaaatcctctagaaaggccaagggtgttgaagaggggactctgatagatggaatggacatcgcaagggaactttataacaataacttgacccctggcgagctgtgcctacaactcctggatgccggcaaaaagtttcttccagacttctaccggtcggatctgcagaatgagttggaccgtatttgggaaaaacagaaggagtattacccggaaatcctcacagatgtgctgaaagaggaattacgcgggaagaaaagagacgctgtctgggcaatttgtgccaagtattttgtgtggaaggagaactacactgagtggaataaagaaaagggaaaaaccgagcagcaagaaagggagcataagctggaaggtatctactcaaaacggaagcgagatgaggctaagcgcgagaacctccagtggagagtaaacggccttaaagaaaagctgagcttggagcagctagttatagtgttccaggaaatgaatacacaaattaacaatagttccgggtatctgggagccatctctgacaggagcaaagagctctactttaacaagcagaccgtcggccagtatcagatggagatgctggacaaaaatcccaacgcgtcccttcggaatatggtgttctaccgccaagattatctggacgaatttaacatgttgtgggagaagcaggcagtgtaccacaaggaactcacggaggaactgaaaaaggagattagagatatcatcattttctatcagaggcgtttaaaatcacaaaagggtctgatagggttttgcgagttcgaaagtcggcagatcgaggtcgacattgatggcaaaaagaagatcaaaactgttggaaatcgagtgataagcagatcttcccctctatttcaggagttcaagatttggcagatcctcaacaatatcgaggtaacagtggtcggcaaaaagaggaaacgccggaagctgaaagaaaactactcagcccttttcgaggagttgaatgacgctgaacaactggagctcaacgggagcagaaggctgtgtcaggaagagaaggaacttctggcccaggagttgtttattcgcgataagatgaccaaaagtgaggtgctcaagctgttattcgacaatccacaggaactggatctaaactttaaaactatcgacggaaacaagacaggttacgcactcttccaagcatattctaaaatgattgagatgtccggccatgaacccgttgattttaagaagcctgtggagaaagtcgtggagtacataaaggccgtattcgacctgcttaattggaacaccgacatcttggggtttaatagcaacgaagaactggataatcagccatattacaaactctggcacctgttatattcgttcgaaggagacaacacgcccaccggcaatggtcgactgattcagaagatgacagagctttacgggtttgaaaaagagtatgcgactatcttggccaacgtttctttccaggatgactacggctccctctcagcaaaggctatccataagattctgcctcacctaaaagagggaaatcggtacgatgtggcctgcgtctatgctggctaccgtcacagtgaaagctccctgaccagagaggaaatagccaacaaggtgctcaaagacaggctgatgcttttgccaaagaatagtctgcataacccggtcgtggagaaaatcttaaatcaaatggttaacgtgattaatgtaatcattgatatctatgggaagcccgacgaaatacgcgtcgagctcgcacgggagctgaagaaaaacgccaaggaaagagaggaacttacaaaaagcatcgctcagactaccaaggcgcacgaggaatacaaaacactgttgcagaccgagtttggactcactaacgtgtcaaggacggatattctgcgatataagctatacaaagagctggaaagttgtggttataagacactctactccaatacctacatcagccgcgagaagctgttctctaaagaatttgacattgagcatatcatacctcaggcacggcttttcgatgactcattcagtaacaagactttggaggccagaagcgttaatattgaaaaaggcaacaagaccgcttatgattttgtgaaagagaagttcggggaatccggagccgacaattctctggagcactacttaaacaatatcgaagacctctttaagtcgggcaaaattagcaagacaaaatataacaagctgaaaatggcagagcaagatatcccagacggtttcatagagagggatcttcgtaatacccagtacatcgccaagaaggctctgtccatgctaaacgaaatttcacaccgcgtcgtggccacttctgggtctgtaacagacaaactccgggaggattggcagctgatcgacgtgatgaaggaattgaattgggagaaatataaggcactgggcttagttgaatactttgaggatagagacggaaggcaaattggccgaatcaaagattggacgaagcggaacgaccatcgccaccatgcgatggatgctctcaccgtcgccttcactaaggacgtgtttatacagtatttcaataacaaaaatgcaagcctggatcccaacgccaacgagcacgctattaagaataaatactttcagaacgggagagccatcgcacctatgccacttagggagttccgggctgaagccaagaaacatctggaaaatacattgatctccattaaggcgaagaacaaagtgatcaccggaaatattaacaagacacgaaagaaaggtggcgtcaataaaaacatgcagcaaactcccagagggcagctccacctggagaccatatacggatcaggcaagcagtatctaacgaaagaagagaaggttaatgccagctttgacatgcgcaagatcggtaccgtgtctaaatccgcttacagggacgcactgcttaagcgtctctatgagaacgataatgacccgaaaaaggccttcgctgggaaaaacagtctggataagcagcctatttggttggacaaggaacaaatgcggaaagtgcccgagaaggtaaaaatcgtcacactggaagccatttacactatcagaaaggagataagctctgatttaaaagtggacaaggttatcgatgtgggcgtcaggaagattctcatcgaccgcctgaatgagtatggaaacgatgctaaaaaggcgttttccaatcttgacaaaaacccaatttggctgaataaggaaaaaggcatctcaataaagcgagtgaccattagtgggatcagcaacgcccagtcgttgcacgttaagaaagataaggacggaaaacctatcctcgacgagaacggcagaaatattcccgtggatttcgtaaacacaggtaataaccatcacgtcgctgtgtactatcggccagtgatagacaagagggggcagctggtcgttgatgaagccggaaatcccaaatacgagctagaagaggtggtagtgtccttctttgaggcagtcactcgcgctaacctgggccttcctatcattgacaaggattacaaaaccacggaaggttggcagttcctcttttctatgaagcaaaatgagtatttcgtgtttccaaacgaaaagacaggcttcaatccgaaagagatcgacctgttggatgttgaaaactacgggttaattagccccaatctgtttcgtgtgcagaagttctcactcaaaaactatgtctttagacatcacctggagaccactatcaaggacacaagttccatacttcggggaatcacctggattgatttcaggtctagcaaaggcctggacactatcgtgaaggttcgcgtgaatcacattgggcagatcgtctccgtaggagagtactga

SEQ ID NO: 3364 - RNA, 4311 nt, synthetic construct
  misc_feature 1..4311: note = Cas9 variant
  source 1..4311: mol_type = other RNA
atgaagagaatcctgggcctcgaccttgggaccaacagcattggatgggccctggtgaatgaggctgaaaacaaagatgagaggtcctctatagtcaagttgggtgttcgggtgaatcccttaacagtagacgaactgactaacttcgagaaaggcaagtcaatcacgaccaatgcagatcgcacactaaaacgagggatgcgtagaaacctccagaggtacaagctgcggcgcgaaactcttaccgaggtgctgaaggagcacaaattgattacagaagacaccatcctcagtgagaatggaaacagaactacatttgaaacctataggctgcgggccaaggcggtcacggaggagattagcctggaagagttcgctcgcgtgctcttaatgatcaataaaaagcgaggctacaaatcctctagaaaggccaagggtgttgaagaggggactctgatagatggaatggacatcgcaagggaactttataacaataacttgacccctggcgagctgtgcctacaactcctggatgccggcaaaaagtttcttccagacttctaccggtcggatctgcagaatgagttggaccgtatttgggaaaaacagaaggagtattacccggaaatcctcacagatgtgctgaaagaggaattacgcgggaagaaaagagacgctgtctgggcaatttgtgccaagtattttgtgtggaaggagaactacactgagtggaataaagaaaagggaaaaaccgagcagcaagaaagggagcataagctggaaggtatctactcaaaacggaagcgagatgaggctaagcgcgagaacctccagtggagagtaaacggccttaaagaaaagctgagcttggagcagctagttatagtgttccaggaaatgaatacacaaattaacaatagttccgggtatctgggagccatctctgacaggagcaaagagctctactttaacaagcagaccgtcggccagtgccagatggagatgctggacaaaaatcccaacgcgtcccttcggaatatggtgttctatcgccaagattacctggacgaatttaacatgttgtgggagaagcaggcagtgtatcacaaggaactcacggaggaactgaaaaaggagattagagatatcatcattttctaccagaggcgtttaaaatcacaaaagggtctgatagggttttgtgagttcgaaagtcggcagatcgaggtcgacattgatggcaaaaagaagatcaaaactgttggaaatcgagtgataagcagatcttcccctctatttcaggagttcaagatttggcagatcctcaacaatatcgaggtaacagtggtcggcaaaaagaggaaacgccggaagctgaaagaaaactattcagcccttttcgaggagttgaatgacgctgaacaactggagctcaacgggagcagaaggctgtgccaggaagagaaggaacttctggcccaggagttgtttattcgcgataagatgaccaaaagtgaggtgctcaagctgttattcgacaatccacaggaactggatctaaactttaaaactatcgacggaaacaagacaggttacgcactcttccaagcatactctaaaatgattgagatgtccggccatgaacccgttgattttaagaagcctgtggagaaagtcgtggagtatataaaggccgtattcgacctgcttaattggaacaccgacatcttggggtttaatagcaacgaagaactggataatcagccatactataaactctggcacctgttatactcgttcgaaggagacaacacgcccaccggcaatggtcgactgattcagaagatgacagagctttatgggtttgaaaaagagtacgcgactatcttggccaacgtttctttccaggatgactatggctccctctcagcaaaggctatccataagattctgcctcacctaaaagagggaaatcggtacgatgtggcctgtgtctacgctggctatcgtcacagtgaaagctccctgaccagagaggaaatagccaacaaggtgctcaaagacaggctgatgcttttgccaaagaatagtctgcataacccggtcgtggagaaaatcttaaatcaaatggttaacgtgattaatgtaatcattgatatctacgggaagcccgacgaaatacgcgtcgagctcgcacgggagctgaagaaaaacgccaaggaaagagaggaacttacaaaaagcatcgctcagactaccaaggcgcacgaggaatataaaacactgttgcagaccgagtttggactcactaacgtgtcaaggacggatattctgcgatacaagctatataaagagctggaaagttgcggttacaagacactctattccaatacctacatcagccgcgagaagctgttctctaaagaatttgacattgagcatatcatacctcaggcacggcttttcgatgactcattcagtaacaagactttggaggccagaagcgttaatattgaaaaaggcaacaagaccgcttacgattttgtgaaagagaagttcggggaatccggagccgacaattctctggagcactatttaaacaatatcgaagacctctttaagtcgggcaaaattagcaagacaaaatacaacaagctgaaaatggcagagcaagatatcccagacggtttcatagagagggatcttcgtaatacccagtatatcgccaagaaggctctgtccatgctaaacgaaatttcacaccgcgtcgtggccacttctgggtctgtaacagacaaactccgggaggattggcagctgatcgacgtgatgaaggaattgaattgggagaaatacaaggcactgggcttagttgaatattttgaggatagagacggaaggcaaattggccgaatcaaagattggacgaagcggaacgaccatcgccaccatgcgatggatgctctcaccgtcgccttcactaaggacgtgtttatacagtacttcaataacaaaaatgcaagcctggatcccaacgccaacgagcacgctattaagaataaatattttcagaacgggagagccatcgcacctatgccacttagggagttccgggctgaagccaagaaacatctggaaaatacattgatctccattaaggcgaagaacaaagtgatcaccggaaatattaacaagacacgaaagaaaggtggcgtcaataaaaacatgcagcaaactcccagagggcagctccacctggagaccatatacggatcaggcaagcagtacctaacgaaagaagagaaggttaatgccagctttgacatgcgcaagatcggtaccgtgtctaaatccgcttatagggacgcactgcttaagcgtctctacgagaacgataatgacccgaaaaaggccttcgctgggaaaaacagtctggataagcagcctatttggttggacaaggaacaaatgcggaaagtgcccgagaaggtaaaaatcgtcacactggaagccatttatactatcagaaaggagataagcccagatttaaaagtggacaaggttatcgatgtgggcgtcaggaagattctcatcgaccgcctgaatgagtacggaaacgatgctaaaaaggcgttttctaatcttgacaaaaaccctatttggctgaataaggaaaaaggcatctccataaagcgagtgaccatttcagggatcagtaacgcccagagcttgcacgttaagaaagataaggacggaaaacccatcctcgacgagaacggcagaaatattccagtggatttcgtaaacacaggtaataaccatcacgtcgctgtgtattaccggcccgtgatagacaagagggggcagctggtcgttgatgaagccggaaatcctaaatatgagctagaagaggtggtagtgtcgttctttgaggcagtcactcgcgctaacctgggccttccaatcattgacaaggattacaaaaccacggaaggttggcagttcctcttttccatgaagcaaaatgagtacttcgtgtttccgaacgaaaagacaggcttcaatcccaaagagatcgacctgttggatgttgaaaactatgggttaatttctcctaatctgtttcgtgtgcagaagttcagcctcaaaaactacgtctttagacatcacctggagaccactatcaaggacacatcaagtatacttcggggaatcacctggattgatttcaggtcctctaaaggcctggacactatcgtgaaggttcgcgtgaatcacattgggcagatcgtcagcgtaggagagtattga

SEQ ID NO: 3365 - RNA, 4311 nt, synthetic construct
  misc_feature 1..4311: note = Cas9 variant
  source 1..4311: mol_type = other RNA
atgaagagaatcctgggcctcgaccttgggaccaacagcattggatgggccctggtgaatgaggctgaaaacaaagatgagaggtcctctatagtcaagttgggtgttcgggtgaatcccttaacagtagacgaactgactaacttcgagaaaggcaagtcaatcacgaccaatgcagatcgcacactaaaacgagggatgcgtagaaacctccagaggtacaagctgcggcgcgaaactcttaccgaggtgctgaaggagcacaaattgattacagaagacaccatcctcagtgagaatggaaacagaactacatttgaaacctataggctgcgggccaaggcggtcacggaggagattagcctggaagagttcgctcgcgtgctcttaatgatcaataaaaagcgaggctacaaatcctctagaaaggccaagggtgttgaagaggggactctgatagatggaatggacatcgcaagggaactttataacaataacttgacccctggcgagctgtgcctacaactcctggatgccggcaaaaagtttcttccagacttctaccggtcggatctgcagaatgagttggaccgtatttgggaaaaacagaaggagtattacccggaaatcctcacagatgtgctgaaagaggaattacgcgggaagaaaagagacgctgtctgggcaatttgtgccaagtattttgtgtggaaggagacttacaccgagtggaacaaagaaaagggaaaaacagagcagcaagaaagggagcataagctggaaggtatctactcaaaacggaagcgagatgaggctaagcgcgagaatctccagtggagagtaaacggccttaaagaaaagctgagcttggagcagctagttatagtgttccaggaaatgaacacccaaattaataacagttccgggtatctgggagccatctctgacaggagcaaagagctctactttaataagcagacggtcggccagtatcagatggagatgctggacaaaaaccccaatgcgtcccttcggaacatggtgttctaccgccaagattatctggacgaatttaatatgttgtgggagaagcaggcagtgtaccacaaggaactcactgaggaactgaaaaaggagattagagatatcatcattttctatcagaggcgtttaaaatcacaaaagggtctgatagggttttgcgagttcgaaagtcggcagatcgaggtcgacattgatggcaaaaagaagatcaaaacagttggaaaccgagtgataagcagatcttcccctctatttcaggaatttaagatttggcagatcctcaataacatcgaggtaaccgtggtcggcaaaaagaggaaacgccggaagctgaaagaaaattactcagccattttcgaggagcttaacgacgctgaacaattggagctgaatgggagcagaaggctctgtcaggaagagaaggaactgcttgcccaggagctgtttgtgcgcgataagatgactaaaagtgaggttttgaagctcctgttcgacaacccacaggaattagatctgaattttaaaacaatcgacggaaacaagaccggttacgcactattccaagcatattctaaaatgattgagatgtccggccatgaacccgtggattttaagaagcctgtcgagaaagtggtagagtacataaaggccgttttcgacctcctgaactggaatacggacatccttgggtttaacagcaatgaagagttggataaccagtcgtattacaaactgtggcacctcctgtattctttcgaaggagacaataccccaacaggcaacggtcgattaattcagaagatgactgagctgtacgggtttgaaaaagagtatgcgaccatccttgccaatgtgtccttccaggatgactacggctcattgagtgcaaaggctatccataagattctcccccacctgaaagagggaaaccggtacgatgtcgcctgcgtgtatgctggctaccgtcacagcgaatcctctctaacaagagaggaaatagccaataaggtcctgaaagacaggctcatgctgcttcctaagaacagcttgcataatccagtggttgagaaaatcctgaaccaaatggtgaatgtaattaacgtcatcattgatatctatgggaagccggacgaaatacgcgtggagttagcacgggagctcaagaaaaatgccaaggaaagagaggaactgactaaatcaatcgctcagaccacaaaggcgaacgaggaatacaaaacccttctgcagactgagtttggattgacgaacgttagtaggacagatattctccgatataagctgtacaaagagctagaatcctgtggttataagaccctgtacagcaatacttacatctctcgcgagaaactcttctcaaaagaatttgacattgagcacatcataccccaggcacggctgttcgatgacagtttcagcaacaagacccttgaggccagatccgtgaatattgaaaaaggcaacaagacagcttatgattttgtcaaagagaagttcggggaatctggagccgacaattcgttggagcattacctgaacaatatcgaagacttatttaagagcggcaaaatttccaagaccaaatataacaagctcaaaatggcagagcaagatatccctgacggtttcatagagagggatctgcgtaatactcagtacatcgccaagaaggctctttcaatgctgaacgaaattagtcaccgcgtggtagccacatctgggagcgtgacggacaaactacgggaggattggcagctcatcgacgttatgaaggaactgaattgggagaaatataaggcattgggcctggtcgaatactttgaggatagagacggaaggcaaattggccgaatcaaagattggaccaagcggaacgaccaccgccatcacgcgatggatgctttaactgtggccttcacaaaggacgtgtttatacagtatttcaataacaaaaatgcatccctcgatccaaacgccaacgagcatgctattaagaataaatactttcagaacgggagagccatcgcacccatgcctctgagggagttccgggctgaagccaagaaacaccttgaaaataccctgatctcaattaaggcgaagaacaaagtcatcacaggaaatattaacaagactcgaaagaagggtggcgttaataaaaacatgcagcaaaccccaagagggcagttgcatctcgagacgatatacggaagcggcaagcagtatctgaccaaagaagagaaggtgaatgcctcttttgacatgcgcaagatcgagacagtgtccaaaagtgcttacagggacgcactactgaagcgtctttatgaaaacgataatgaccccaaaaaggccttcgctggtaaaaacagcctcgataagcagccgatttggctggacaaggagcaaatgcggaaagtacctgaaaaggtcaaaatcgtgactttggaggccatttacaccatcagaaaggagatatctcccgatctgaaagttgacaaggtgatcgatgtcggggtgaggaagattttaatcgaccgcctcaatgaatatggcaacgatgctaaaaaggcgttttccaatctggacaaaaacccaatttggcttaataaggagaaaggaatctcaataaagcgagttacaattagtggcatcagcaacgcccagtcgctgcacgtgaagaaagataaggacgggaaacctatcttggacgaaaacggaagaaatattcccgtagatttcgtcaacactggcaataaccaccatgtggctgtgtactatcggccagtcatagacaagaggggtcagctcgttgtggatgaggccgggaatcccaaatacgaactggaggaggtagtggtctccttctttgaagcagtgacccgcgctaacctaggactgcctatcattgacaaggattacaaaacgacagagggctggcagttccttttctctatgaagcaaaatgaatatttcgtttttccaaacgagaagatcggtttcaatccgaaagaaattgacctcctggatgtggagaactacggcttgatcagccccaatttatttcgtgtccagaagttctcactgaaaaactatgtgtttagacaccatctcgagaccactataaaggacacaagttccatcctgcgggggattacctggatcgatttcaggtctagcaaaggacttgacactattgttaaggtgcgcgtcaatcacatcggccagatagtatccgtgggggaatactga

SEQ ID NO: 3366 - RNA, 4311 nt, synthetic construct
  misc_feature 1..4311: note = Cas9 variant
  source 1..4311: mol_type = other RNA
atgaagagaatcctgggcctcgaccttgggaccaacagcattggatgggccctggtggatgaggctgaaaataaagacgagaggtcctctatagtcaagttgggtgttcgggtgaaccccttaacagtagatgaactgactaatttcgagaaaggcaagtcaatcacgaccaacgcagaccgcacactaaaacgagggatgcgtagaaatctccagaggtacaagctgcggcgcgaaactcttatggaggtgctgaaggagcacaaattgattaccgaagatacaatcctcagtgagaacggaaatagaaccacttttgaaacatataggctgcgggccaaggcggctaccgagaaaattagcctggaggagttcgcccgcgtcctcttaatgatcaacaagaaacgaggctacaagtcctgcagaaaggcaaaaggtgccgaagaagggacgctgatagacggaatggatatcgctagggagctttataataacaatttgactcctggcgaactgtgtctacaactcctggacgcaggcaagaaataccttccagatttttatcggtctgacctgcagaacgagttggatcgtatttgggagaagcagaaagaatactatccggagatcctcaccgaagtgctgaaggaggaattacgcgggaaaaagagagacgccgtttgggctatttgcgccaagtcgttcgtgtgggaggagtactacacagaatggaataaagagaagggaaaaactgaacagcaagagagggaacataagctggagggtatctattcaaaacggaagcgagatgaggcgaagcgcgaaaacctccagtggagagtcaatggccttaaagagaagctgagcttggaacagctagtgatagtactgcaggagatgaacattcaaatcaacaatagttccgggtacctcggagcaatttctgacaggagcaaagagctgtattttaacaagcagaccgttggccagtaccagatggaaatgcttgacaaaaatcccaacgcctccctgcggaatatggtgttctatcgccaagattacttggacgagtttaacacactctgggaaaagcaggctgagtatcacaaggaactgaccggtgagctcaaaaaggagatcagagatatcgtcattttctaccagaggcgtctgaaatcacaaaaggggctagtgggattttgtgagttcgaaagtcggcagatagaagtggagatcgacggcaaaaagaagattaaaacggtcggcaatcgagttatccctagaagctctccactctttcaggagttcaagatatggcagattctgaacaatatcgaagtgactgtagtggggaaaaagggaaaaaggcgcaagcaaaaagataactcccccacactttttgacggtttggatgacaccgagcagctggaactcaatggctcacggtacctgtatcaggaggaaaaggagcttctggcccaggaattgttcgtcagagataagatgactaaaagcgacgtgctcaagctgttattcgataaccctcaagagctggacctaaattttaaaacaatcgacgggaacaagaccggatacacgttattccaggcatatagtaaaatgattgagatgtctggccatgaaccagttgattttaagaagaccgtggagaaagtcgtggaacacgtaaaggctgttttcgacctgcttaattggaacacagatatcttgggttttaactccaatgaggagctggacaaccagagctactataaactctggcatctgttatactcgttcgaaggggataatactcccaccggcaacgccaggctggtgcagaagattacagagctttatggatttgaaaaagagtacgcgataatcttggccaatgtcactttccaagacgattacggctctctctccgcaaaggctattcacaagatcctgcctcacctaaaagaagggaaccgctatgacgtggcctgcgcttacgccggatataagcattcagagagtagcctgaccaaagaggaaatcgcaaataaggccctcaaagatcgactgacacttttgccaaagaacaatctgcggaacccggtcgtggagaagattttaaatcagatggttaacgtgataaatgctatcattgacacctacggtaaacccgatgaaatccgtgtagagctcgcgagagaactgaagaaaaacgcaaaggagagggaggaacttactaaatttattgccgagacgacacgcaagcacgaagagttcaaaatcctgttgcagtccgaatttggcctcaccaatgtctctcggactgacatactgagatataagctatacaaggagctggagagctgtgggtataaaaccctctactcaaacacatacatccctagggaaaagctgttcagtaaagagtttgatattgaacatatcattccacaggctcgacttttcgacgactccttcagcaacaagaccttggaggcccgctctatcaatctggagaaaggaaacaagactgcatatgattttgtgaaggaaaaattcggcgagtcaggtgccgacaatagtttagatcactacctcaacaatatagaagacctgtttaagagcgggaaaatttccaagacaaaatataacaaacttaagatggctgagcaagatatccccgacggcttcattaatcgggatctgagaaacacgcagtacatcgccaaaaaggcactatctatgctcaatgaaatatcgaggcgtgttgtggcgaccagcggaactatcacagacaaactgcgccaggattggcaattggtcgacgtgatgaaggagctgaactgggagaaatataaggctttaggcctcgtagaatactttgaggataaggacgggcggcagattggaagaatcaaagattggaccaagaggaatgaccaccgacatcacgccatggacgcactgacagtggccttcactaaagatatttttatccagtatttcaacaataagaacgcttcccttaattcaaacaccaacgaatacgccataaagaataagtactttcagaacggtcgggcaattgctcctatcccactgcgcgagttcagagttgaagccaagaaacatttggagaatacgctcatcagtattaaggcgaaaaacaaggtcgtgaccggcaatatcaacaaaacaaagaaaaggggaggggtgaataagtatctgcaacagactccccggggccagctacacctggagaccatttacggttctgggaagcagtatcttacaaaagaagagaaggtcaacgccagctttgacatgaaaaagatagctactgtttccaaatcagcataccgagatgtgctcctgaagagattgcatgaaaatgacaacgatccgaagaaagccttcaccggcaagaatagcctggacaaacaacctatctggttagataaggagcagacgcgcaaagtgcccgaaaaggtaaagacagtcaccctcgagactatttatacagtgaggaaagagatctctccagacctgaaggttgataaagtgattgacgctggagtccgtaagatccttaccggccggctgaacgaatacgggaatgatgccaaaaaggcattttccaacttggacgagaatcctatatggctcaacaaggaaaaaggaatcagtattaagagagtgactatcagcggcatttctaatgcgcagtccctgcacgttaaaaaggacaaagatggtaagcccatcctagacgaggattcaaggaacataccagtggacttcgtaaacaccgggaataaccaccatgtcgccgtgtatcgccgacccgtgattgataaaagaggacagctggtcatcgacgaggctggcaatcctaagtacgaacttgaggaagttgtggtaagtttctttgaggccgtgacacgggcaaacctcggtcaaccaatcattgataaggactacaaaacgagcgaaggctggcagttcctgttttcgatgaagcagaatgagtatttcgtctttccgaacgagaaaaccgggttcaatcccaaggaaatagatttgttagacgctgagaactacggagtgatctcccctaatctgtttagggttcaaaaattcgcccacaagaactatgtgtttcgccatcacctcgaaactacaattaaggatacctctagcatcctgaaaggcattacatggatcgacttccgttcaagtaaggggcttgatgcaatagtcaaagtgagagttaatcacatcggacagattgtgtccgtcggcgagtactga

SEQ ID NO: 3367 - RNA, 4311 nt, synthetic construct
  misc_feature 1..4311: note = Cas9 variant
  source 1..4311: mol_type = other RNA
atgaagtacatcaaatatattctgggcctcgacatagggagcaactccatcggatgggcccttattcagctggatttgttacaaaagaccaaaagaatcattgctgcaggttctaggatcatacccatggaccagaaggtgctgtcagatttcggcaaagggatcacaattagtcctactgcccagcggacgagctaccgcaatgcgcgacactgccgtgagagacatctactcaggcgggaacgcctgcacagagtccttcatatcctgggatttttgccaacccactatgacaagcagattgatttctccaagaggtacggcaaatttgttgacaacacagagccgaagatcgcttataatgaaggtaaattcctctttatggattctttccaagagatgctgtcggactttaagtcacatcagcccgatctgttctacactaaaaagaacggggaagagagcaagataccttatgactggaccatttactacctccggaaaaaggccttaagtcagaaaatctccaaggaggaactggcatggattatccttaattttaaccagaaacgcggatattaccaattgcgagaggaagagggcaataaggagaacgatttcgaaatcatttctagcaaaataatctccgtgattaagaaggacaaagataagaaatataataagtactggtatgacatcatactggagaacggcctagtataccaggccgctttttataatgacttcgtgtacaactggattaatcaggatagagaatttatcatcgagaggacatcactcaaaaacggggcagaaaaggtcaagctgagttaccttccaaccttcgacgagattgataaaatggacaagaaagagcaggataagtattacaaaaagatcaagattaaaactgaaaatagcataggaaacaagacagtgggttgttatatctacgaccacattctgcaaaaccccaatgagaaaatcaagggcaaattggttcggaccatcgaacgtaagtattacaaggaggaactcaaagccattctggagaagcagatagctttacagcctgagctgttcacggatcaactccttgccgactgcatccgcgaactgtattctaaaaacgaggcgcagcagagaaatttggcagccagggattttgtgcacctactggtcgaagacattatcttctaccagcggccactccgacgccaaaagtccactctggctaactgttcacttgagagcagaagttacattgataaagactctcataccaggaaggaagcacccctgaaagtgtgccctaagtccaatccatattaccaggagtttcgggtattgcagtggctccagaacctgaagatctatgagatagacagcgatcaagaagttacacaccagttcatcaaaactttagaggacaagcagcagctgtttgaatttctaatggcccaaaaagagattgattgtgaggaactcctgaagtactttcttaatcagacctatccgaacgctaaagagaaggccttgaagtcggaactgaaaaagtggaaagacacataccgctggaattatgtgtacgatatcggggagaagtcttccaaaaagtaccccatgaacgaaaccagatatgagctcaagaggcatctggagaaagtcgcgaatcttcctgacgatttcctgtcaagtgaagtggagtacttgctctggcacctgatttatagcgtgaaggacaaagtcgcctacgaaaagggattaaagaagtttgcacagaagcaccatctggataaagactccttcgttgagtcttttaagaaattcaacccatatcccagcgaatacggctcatttagtgagaaggctatccgtaaactactccctctgatgcggttcggtgcccactgggatttcaatcatatagacaagaacacgcagaaacgaattgaggatcttatcactggggtggaaaatgaggaaattagaacaatcttgagggagaaggctgaaaagtatcaactggagaaagagaccgactttcaggacctcccactgtggttagcccagtacatagtatacaaccgccacgcagaagcctccagcctggagaagtggacttctgtgaacgatcttgaaacatatttgaatgagttcaaacaacattcactccggaaccccatcgtcgaacaggtggttatggaaaccctgagagtggtcagggacatttggcagcagtacggacaaggccaggctagtttcttcaatgagatccacattgaactaggccgcgagctgaagaaaacggcgaaggaacgagagaagctcagcaaacagaaccagaagaatgaggatatcaacctgtccataaaagaaaaacttaaagagttggaaaagtataatacccgggcatactctattacacaccaagagaagtataaactgtggttagaacagaagcatatctcgccgtacactgggcagatcattagccctgagaacctctttaccgacaattatgagatcgaacacattataccccagtcccgtttctttgatgactcactgagtaacaaagtggtatgcgagtctatcgttaataaggccccatacaaagatagacaacttggactggagttcattaagaaccagggtggcaggatcgtgaaggagttgagcaaagaaaataagacaattaaaatctttactgaggagcagtaccgcaccttcataaaggaacattattccaacaatcctgagaaaacaaagaagctcctgctagaagagatccccgagaaaatggtcgctcggcaaatgaacgacacctgttacatttcaaagtttatcagcgaaattctgtctaaaatcgtgagatccgatgagcaggacgaaggggtccacagtaagaacgtgatactctgcactggaaaaattacgagcatcctgaggcaggattggggccttaatgacatctgggataacttgattctgccacgattcgagcgcatgaataacttactccagaaggaaaaatttacaatatattctatcgagaagcaaaagaaaattcccgttgtgcctatcaatgaccagttcaagtccttccagaaaaagcggattgaccacagacatcacgccatggatgcaatcataatcgcctgtaccactagggagcatattaactacatcaataaccagcacgctctggaaaaagagaaggacaagaaagaaaagcaagaggaacgtgataaacttcgcgagaagctgtgcattaaaaagtataataaccggtcagagggtaattacagttggatctttaagaaaccatgggacaccttcacacaggaagtaagagtcgccctagaggatatagtggttagctttaagcagaacctcagggtgattaataaagcaaccaactattacgaacgatgggtcgaggaaaatgggaagtacatcaaaaagatggtgaagcaggagggcactaactgggcgatccggaaaccgctgcatgaggaaacaatttcgggaaagatctatttggaccgcgagaaaataacgaagaacgatattctgaccgctactagaaaaacagtagactcctctttcgatgacaagaggatcaaaaagattaccgatacaggcatccaaaagatattactcaattacctgaaatataaggggagccccgaaattgccttttcacctgagggacttgaggaactgaacaaaaatttgagtatctacaacgacggtaagccacacaaacccatctataaggtgcggatttacgagaagggctccgggcgattcgcactcggagaaaaaggcagaaagtataaaaagtacgttcagggtgcctctaatctgtactttgggatctatcagggcgctaaacgcagcttcgccactattcctctaaacgaggtcatagaaaggcagaagcaaggactgccatccgtgcccgagtacaatgagaagggcgaccttctcctgttttcattgagcccgaacgatctggtgtatgtccctatcgaaggggagattatcgaaaatatcgacttccgtaacttaagtaaagagcagaaggaacggatttacaatgttaacgatttttcttccacctgttatttcacgccaaatagaatagcaaaagctatcttccccaaggaggtggacctccagaggaaaggagataagctgagcggttcgtacgacaccaagacagcctcacttgagggcattcaaatcaaagaagtgtgcattaagctgaaagtagatcgcttggggaacatctctaaggcgtga

SEQ ID NO: 3368 - RNA, 4314 nt, synthetic construct
  misc_feature 1..4314: note = Cas9 variant
  source 1..4314: mol_type = other RNA
atgaagtacatcaaatatattctgggcctcgacatagggagcaactccatcggatgggcccttattcagctggatttgttacaaaagaccaaaagaatcattgctacaggttctaggatcatacccatggaccagaaggtgctgtcagatttcggcaaagggatcactattagtcctacggcacagcggaccagctaccgcaatgcccgacactgccgtgagagacatctactcaggcgggaacgcctgcacagagtccttcatatcctgggatttttgccaacacactatgacaagcagattgatttctccaagaggtacggcaaatttgttgacaacactgagccgaagatcgcgtataatgaacggaaattcctctttatggattctttccaagagatgctggctgactttaagatacatcagcccgatctgttctacaccaaaaagaacggtgaagagtcgaagattccttatgactggacaatctactacctccgcaaaaaggccttatcacgaaaaattagcaaggaggaactggcatggatcatccttaattttaaccagaaaagagggtattaccagttgagggaggaagaggaggaaaataaggagaacgatttcgaaattataagttccaaaatcatttctgtgatcaagaaggacaaagataagaaatataataagtactggtatgacataattctggagaacgggctagtataccaagccgctttttataatgacttcgtgtacaactggatcaatcaggatcgggaatttatcattgagcgtatcagcctcaaaaacggcaccgagaaggtcaagctgtcctaccttccaactttcgacgaaattgataaaatggacaagaaagagcaggataagtattacaaaaagataaagatcaaaacagaaaattcaattggcaacaagaccgtggggtgttatatctacgaccacatcctgcagaaccccaatgagaaaattaagggaaaattggttcgcacgatagaaagaaagtattacaaggaggagctcaaagcaatcctggaaaagcaagtggccttacagcctgagctgttcactgatcagctctttgctgactgcattagggaactttatagtaaaaacgaggcccaacagcggaatctggcggcacgagatttcgtccacttgtttgtggaagacatcattttctaccagcgcagcctaagaaggcagaagtctaccctggccaactgttccctcgagtcacggagctacatcgataaagacagtcatacacgcaaggaggctccactgaaagtatgccccaagtctaatccttattaccaagaatttagagttcttcagtggctgcagaacttgaagatatatgagatcgacactgatcaggaagtgacccacgagttcattaaaacactcgaggacaagcaacagtttttcgattttctgatgaatcagaaagaaatcgactgtgaggaattactgaagtacttcctaaaccagacctatccaaatgccagggagaaagcactcaagtccgaactgaagaaatggaaggatacgtaccgttggaactatgtctacgacattggtgagaaaagctcgaagaaatacccgatgaatgagactcggtatgaacttaagcgacatttggagaaggtggctaacctgcccgatgactttctctcttccgaagtggagtacctgctttggcacctgatctattcagtcaaagataaggttgcctacgaaaaaggcttgaagacattcgcgcaaaaacaccatctcgacaaggatagttttgtggagagcttcaagaaattcaagccttatccatccgagtacgggtcttttagcgaaaaagccataagaaagctgttacccctgatgaggttcggatcatattgggactttaatcacattgataaaaacacccagaagcgcatcgaggacctaattactggcgtagaaaatgaggaaatccggacaatactcagagagaaagcagagaagtaccagctggaaaaggagaccgacttccaggatcttcctttgtggctggctcaatacatcgtgtataacaggcatgccgaagctagttccctcgagaaatggacgagcgtcaacgacctggagacctacttaaatgaatttaagcagtattctctgcgcaacccaattgtggagcaggttgtgatggaaacacttcgagtcgtgcgggatatctggcaacagtacggtcaggggcaggcctcattctttgacgagattcacatcgaattgggacgtgagctcaaaaagactgcaaaagagagagaaaagctgagtaagcaaaatcagaaaaacgaggatataaatctaagcattaaggaaaaactgaaggagctcgaaaaatataacaccagggcctactccatcacacatcaggagaagtataagctgtggcttgagcagaaacacatctctccctacactggccaaattatctcgccggaaaatttgttcaccgacaactacgagattgaacacataatccctcagagccgctttttcgatgactccctgtcaaataaggtagtttgcgagagtattgtgaacaaagctccctataaggatcggcagttaggcctcgaatttatcaaaaatcaagggggaagaattgtcaaggagctgtctacagagaacaagaccatcaaaatattcactgaagaacagtacaggacgtttatcaaggaacattatagcaataacccagagaaaacaaagaaacttctgttggaggaaattcctgagaagatggtggcgcgacagatgaatgacacctgttacatctccaagttcatttcagaaatcctcagcaaaatagtccgctctgatgagcaggacgaaggtgtgcactccaagaacgttattctgtgcactggcaaaatcaccagtgcactaaagcaagattggggagtgaacgacgtatggaatgacctgatcctcccccggttcgagagaatgaacgatctgacacagagcaccctttttactacatataatgagaaataccagaagtatttgccaacggtccccatggaatactctaacggattccagaaaaagaggattgaccatcgtcaccacgccatggatgctataatcattgcctgtgcaacccgcgagcatatcaattacattaacaatcaacacgccctggaaaagggcaaagacaagaaagagaagcagaaagaacatgataagttacgggagaagctctgcatcaaaaaggacaacaaaggttccgaggaaaattattcatggatatttaagaaaccttgggatactttcacacaggaggtgcaggctgccctggaagggatcgttgtgagttttaagcaaaaccttagagtcattaataaggcaaccaactactatgagaggtgggtggaagagaatggcaaatacatcaagaaaatggtaaagcaggagggaacaaactgggcgattcgaaaaccactgcacgaagagactatcagcggcaagatatatctagaccgggaagagattaccaagaatgatatcctcacggctacccgcaaaacagtggactcgtccttcgatgagaagagaatcaaaaagattactgacaccgggatccagaaaatactgttgaactacctgaagtataaaggatctccggaaattgcctttagccccgagggtttagaggagctcaacaagaatctgtcaatctacaacgacggcaagcctcataaaccaatttacaaggttaggatctatgaaaaagggagtggacggttcgcacttggcgagaagggtcgaaaatacaagaagtatgtccagggggcccccaatctgtactttggcatatatcaaggagctaacaaaagatccttcgccacaattcctttgaatgaggtgatcgaacgccagaagcagggcaggccatctatccccgagtacaacgaaaaaggggatccgctcctgtttagcctatcccctaatgacctggtgtatgtcccagttgagggagaaattatcgaggatattgacttccagaacctttcaaaggagcaaaaagaacgtatatacaatgtgaacgatttcagcagtacttgttactttacccccaatcggatcgcaaaggctattttccctaaggaggtggacctccagagaaaaggtgataagctgcccggctcttatgacacgaaaacagcctccttggaagggatccagatcaaggaggtatgcattaaactgaagatagataggttaggaaacatcagcaaggcgtga

SEQ ID NO: 3369 - RNA, 4317 nt, synthetic construct
  misc_feature 1..4317: note = Cas9 variant
  source 1..4317: mol_type = other RNA
atgaagaccatcctgggcctcgaccttgggacaaacagcattggatgggccctgataaaacagaatttcgagaacaagtacggtgaaatcttgggcatggggtccagaattatccccatgtctcaagatattttaggagagtttggcaaaggtaattcagtgagtcagactgctgcaaggacggactatcgggccacccgccgactgcgtgaaagattcctactcaggcgggagcgcctgcacagagtccttaacgttctgaatttcttgcctgaacattacgcgagccagatcgatttcgacaagaggtttgggaaattcaaggtggagacagagccaaagctcgcttggaaaaacatagatggaaagttttccttcctgtttcagacttctttcaatgaaatgctggaggactttaaagcccacggccaagatctcaaggtaccgtatgactggaccatctactatttacggaaaaaggcactgtcgcagaagattgaaaaagaggagcttgtgtggatcttgctgaacttcaatcagaagcgcggctactatcagctacgaggggaagaggaagaggaaaaccccaataaactcattgagttttactcactgaagatcatagatgtccttgccgacgagcctcaaaaaggaaagagcgatatttggtacagtctggtgttggaaaacggttggatctatagaaggtcctctaaaacaagcctcctggactggaaggataagattcgggacttcatcgttaccactgacttaaatgatgacggctccgtgaaaacagataaggaggggaacgaaaaacgttcattccgcgctccaggagagaatgactggaccctggtcaagacgaaaactgaacaggagatcgatagaagtaggaagaccgtgggcaactacatttatgagacactccttcagaaccccaagcagaaaataaagggtaaactggtacggactatcgaacgaaagttttacaaagaggaattgaagcgcattctagagaagcaaaaagaatttcatagagagctggagagcaatgacctctataacgattgcatcagggaactgtaccggaataacgaggcacaccagcttaccctgtctaagaaagactttgttcatttgttcatggaagatataattttctatcagcgccctctcaagtcccaaaaatcaagcatcagtaattgtacactggagttcagaaagtacaaggacgagaacgggatcgaacacacccagtttttaaaagccattccaaagtctaatccctactatcaggagttcaggatctggcagtggatttttaacctgaatatatacaaaaaggataacgacgacaatgtgacgaaagaatttctaaacactacacgtgattttgagaatctcttcgaatttctgaacaatcggaaggagatcgagcaaaaacctcttttgaagttcctgctcgaacagaaggagttcaaaggaaagctgcttaacgctgaaaccgagaaatttcgatggaactatgtcgaagacaagaaatacccatgcaatgagactagaacaatgatttccgagaggctgaagaaggtggaaaacatcagcgatgacttcttgacccgcgagatggaacagaaaatctggcacattatatattcggtgaatgataagacggagtacgaaaaagccctcaagtcttttgcggagaaaaacaatctggacgagaactccttattcgaagcatttaagaagctgccgcccttcaaatcagagtatggcagttttagcgaaaaggccatcaaaaagctactccctctgatgcggcttggcaaatactggtcctacgctaagattgatttgtattctaagaatagaatccagaaaattatcaccggggagttcgacgagaacataaaggatagggtccgcgaaaaagccatccgactgacagcagagaatgactttcaaggactccagctgtggttagctcagtacattgtttatggtcggcatagcgaagcctcaatgatcggcaagtggaacagtgcggatgacctggaggagttccttaaagaatttaagcagcactccttgcgtaatccaattgtggagcaagtaatcactgaaaccctcagaatagtgaaagatatttggctgaagtacgggaacggagccaaggacttctttaatgagatccatattgaactaggcagggagatgaaacagacaaaggacgaacgcgcaaacgctactaaaaccatcacagagaatgagaacaccaacctgcggataaaggccctcctggctgaaatgatgaatgatcacagcgtcgagaacgtgagaccctattctcctatgcagcaggaaatccttaaaatttacgaggacggtatcttgaagtcagatattgaaatcgacgatgacatactgaagattagtaaaactgcccaaccaagctcctctgatttaaagaggtataaactctggctggagcagaagtacaaatcgccctacacggggcagatcatcccgcttaataagctgttcacacctgagtatgaaattgagcacatcattccccaaagccgatacttcgacgattccttttcaaacaagataatctgtgaaagtgcagttaataaattgaaggacaactatattggcctcggattcatcaaacagtttggcgggaccattatcgagtgcggattcggtaagcgcgtgaaagtctttgaggtgggcgaatacgaggagttcgtaaagaagcattatgccaataaccgggggaaaagaaataagctgctactggaagaaataccagagaaaatgatcgagaggcagatgaacgatactcgtcacatttctaagtacatcagcggcattctctcccatatcgttcgcgtggaagacggaaccgatgagggtgtcaatagcaaaaacgtgatacctgggaatggcaagattacaacccagctgcggcaagactggggacttaacgacgtctggaatgaattgatcctgcccagatttgagaggatgaaccagttaactaactcaacagatttcacgtcttggaatgaaaaccaccagaagtatctcccaaccgtgcccgttgagttttccaaaggcttcagtaagaaacgaatcgaccatcggcaccacgctctggatgcgcttgtgattgcatgtgccactaaggaccatgtaaatctgctaaacaatcagagcgctaaatctgccacaaagcgctacgatctcaaaaagaagctgatgaaatttgagaagaccgtctacaaagaccctcaaacagaaaagagaatagagagggaagtgccaaaacacttcttgaagccgtgggagactttcaccgttgatgcaaagaaccggctggaaacgatcattgtgtcctttaaacagaatttacgagtcatcaacaaggccaccaattattacgagaaatatgtggagaaggacggggtaatgatgaaagaaagagtggagcagacaggaactaactgggctattcgcaagcccatgcataaggaaaccgtttcaggtaaaatcgatctcccttgggtcaaggtgccaaaaggcaagatactgacagccactaggaaaagtcttgacaccagcttcgatctgaaggcaatcgcgtcgattacggacacagggatccagaagattttgaaaaattacctcgagtttaaggagtcccccgaactggctttctctcctgagggaatcgaagacatgaacaaaaatatagagaagtataacggcggtcgtccacaccaacccattagcaaagtgcgggtctttgaactagggtcaaagttccaggttggccagaccggaaataaaaaggataagtacgtggaggccgcaaaaggcactaacctgtttttcgccatctatgaggacaagaaagggaagagaagttacgaaacaatcccgcttaatgaggtgattgaaaggcaaaaacagggactctccgtagtcgatctgaagaacgtgaacgactttttcttgtgccctaatgatctggtttacatcccatctggcgacgagtttgaaaaccgcggtagcatagagattgagaatatcaccaaggaaaaatccgagcgattctataaggtggtctcatttagcgggagtcagattttcttcgtgagacacgatatcgctgtttctatagtgaacaaaggagaattttccactttaaataagatggagcgggccattgacggcagcatggtaaaagaaatctgtatcaagctcaagattgataggctgggtgacgtccttaaagcatga

SEQ ID NO: 3370 - RNA, 4317 nt, synthetic construct
  misc_feature 1..4317: note = Cas9 variant
  source 1..4317: mol_type = other RNA
atggtgaagaaaggctacaccatcgggctggacattggaacaactagcgtcggttgggccgttacggatgacgatttcgagctcgtgaacaagaaaatgtccataaaggacaaatctggctcaaccatcaagagagtaaggaagaatctttggggagtgcggctgtttgatgaagctaaaacagcagagaacactcgccgaacccgtggggtcagaaggcggattcgcagaaggaaggaacggttgaattatttacagggcatcttcagtagcgagatggccaaaatggacgaaaactttttcatgcgcctggaggagtcctttttcaagctatctgataaatcggaacaaaataagtttccctacgcgcttttcaagaacgagattgaagagaaggcttattaccgacagtttcctacaatctatcacctgagaaagcatcttatggagcacgaagagtcagacctgaggaaaatatacttgggtctccatcacatcctgaagtatcgggggcatttcgtgcaggaaggacagaaaatggatgttgccaatattgacatccaaggcaacctgaaggagctctttaatgcattaaacgaaaatttcagcaacaaagaggatgactttgagcaggaacgtatgaaggatggcgtgaagcgcgccaaagtcctgttcgacaccgagaagctcgctgcagtggaagagattttgaaagaaaagatcagtaaatcctggaaggtaaataagatatctaaagggattctggccgagaagaaagacctaccaatcttcaaggctattgttggaaacaaaatcgatctcgccggtatctttgactgcccggattacgcggagaaggtgaatgaaagcattaaggagctgaaagacaaggtctacttcaacaaagaagattttgaggaaactttcgagaaactttcccagctgttgaaagaggaggaactcgaaatactgatcttagcaagaaagtgttatgaggccgtgctgctcgctgacattatgcagggcgagcaatcacttagtgatgccatggtggcaaagtacaacgaccacaaaaaggatctggtcatctttaaaaagttcgttatagactattttagcgaagatgtgtacttcgacttgtttaaaaatacacagctagctgggaactatcactcttacgtaaagggagagaggaaaggcaataagttcaaccatgcctccctggacgatttttataagttcgtgaaaaaggaactcgacaaaaaggcggaggaactgtcagagcaccccgtctacaaacagattcttcagaagatcgagctggaaacctttttgcctaagcaacggatgttcaaaaatggtgccatcccataccaggtgcatctccacgagctgcgagcaattatcaagaaacaggaaaagcgcttcccctttttagctgagaaaattataatcaaggataaccaaaaggacattagcgaatataaaatcgagacgctgatgaagttcagaatcccttactatgttgggccactaattgaggccagggaaggagagctcggcaaaaagcggactaattacagtcgctttgcttggatgcagaaatctcccgaatcccagaacataggcatcaccccttggaatttccacagcgtggtcgataaggacgcctcggcatctgagtttattgaaagaatgacagggttctgctcctattttccagaggagccggtgctgcccaagaactcacttatctaccagcaattcactgtatttcaggaattgagtattgttggatattacgatgagcagaataggaaacattacctggacggtgaaacccgtcggcgaatcttcgaggatctctttaagaaaaacagaacagtgagcgccggcctgcttaggaagtggctggtctgtaatcagcgcacctcccaagaggaaaaagagatacggttgttcgggctcgacctgaagaaaaacggattaggctctggtaattttaacacgaagtatactacatacctggatctaaaggacgctgggatcaccgaaaaacagctcaagcagcacaaagatttcttcgagaagattgtgaaatatcagactatctttgaagacaagaagattctgaaaagaaggatcatacttttgaacgaggagcaacctctgctcagcgaggaacagattaagaatctggcgaaaaagcattacacaggctggggaaacttatcactgaaacttatcgacggcattcaggataaggggaagaccatcttggactatctcgaaacgcaggattacaatcaaaacctgatgcagctaatgaatgacgagaacaaaagtttcgaaatgcagatagagcaagcacgcgccggaaaggtccagtttggtaaaatcgattattccttcgtggagcagctggctggcagcccagccattaagcgagggatctggcagtctctccaaattgttgaggaactggtggcatttcttggaaaagaaaatatcaagaagatagtaattgagatggcccgggaaaaccagtcaagtaaacgtaccaagagcagacagaaacagatcgaggctttgtaccaaaaggtcacaggcgacctgaaaaatgagcaggaaaagatcgatgtgatgcagaacttcgacaatgagagggtttttctttactatctccagaacggtaagtgcatgcactccggggaaaaactggagctttctcaactgtcggagtacgaaattgatcatatcattccccagacttatataaaggacgatagcttcgacaataaagtgttggtcacccgcaacgccaatcagcaaaagggcggagatgtgccttcctacgacgtaatcgacaaaatgaagtcatattgggagaaactcaaggaaaacaacctgattagtgagaagaaatttgcaaatctaacaaagggcaaattcgatgaccagcagctgtctgggtttatcaaccggcagctcgtggaaactagacaaattaccaagaatgttgcgatcatactggataaaatctacaacgacgaggctaagaatgagaaggaagtcgccattatcacacttaaaagcgcattgacctcccagtataggcagggaattatctacgtgccaaacgatgacttcgatgagctgaagttagtgtcaaaaactaatagccgactcaaggaagtcaaactgcacgacggtttctacaaggttcgcgagataaacgattatcaccatgcccacgacgcttaccttaataacgtggtggccacgtatctgtacgaagcaatgcccgatctacggccgctctttgtatatggcgagcattctagagagattcacaagaggttcctggggaaatacgctacaacccgtaagggacagtttaaacaattgctggtcgacatgcaggacgaatattggatgcgcaaggataaagagggcaatttcatcgacggtgaaatcttatggcggagagatgaggtgctccagattgttaagaaggtgctggactacaggaacatacagatcactaaaaagttagaaatgatggtcaccgggggcgaggagaaatccttttaccaagatagtcgatgtcggaaggacaaaacagccattccttataagaccaattgggatcccagcaaatacggaggcttcaagtctccacgcactgcgtatgccatccctgtgattaagaaaaacaagcccaaactggaaccagttttgctcgtgaatagatccaaggtagagacagacgggcagtttgattgcgaaaaattcaaggagctgaaccccacgctaaagatcctgggacagcctatatggaaataccagtcatttgagatgttcgacggcaccaagaggtatatcgctagtgcaagcgaaattcacaaaggtaaccaaatcaagttttcgcaggagcatatgaaattcatttcctgttgccagaagtacgatgaagtcaagaataaacttgcctttgacttcgtgaacgagtctaagcacctcttccaagaaatcctgactgctataaaagataatattcatcggtatcgattgatcgccgaggggatcgaggtgcacagaaagtttagcaacatgctggaaaatattgagaaattatcaacacaggaactcgtcgacaacctgcttgacgcaatcaatataaccagtgttggaacaactaacaatgcgttcggccgcgtgaggtacaagggttcctacctgaacgagatttggtctgccaccttgatccatcagagcgtaacgggcctctatgaaacccgtgagaagctgatttga

SEQ ID NO: 3371 - RNA, 4323 nt, synthetic construct
  misc_feature 1..4323: note = Cas9 variant
  source 1..4323: mol_type = other RNA
atgaagaccatcctgggcctcgaccttgggacaaacagcattggatgggccctggtggagcaggatttcgaaaataaacaaggtttgatattaggcatggggtccagaatcattcccatggacgctggaatcattggcaagtttgcagagggttcttcaatcagtcagactgccgaaaggacggggtaccggagcatacgccgactgcgtgagagacacctactcaggcgggaacgcctgcatagagtccttaacatcctgaaattcttgcctgagcactatgcggctgagattgattttgaaaagaggttcggacagtttctcgccgagaccgaaccaaaactggcatggaagaagtccgccgagggcaaattcgagtttctgttccagcggtcttttgacgaaatggttgctgatttcaaggcaaatggccaagacatcaaaattccgtacgattggacaatctattacctccgcaagaaagccttaactcagaagatatcgccccaggagctggcttggattatccttaactttaatcagaagcgagggtattaccaattgagaggagaagaggaagaggagaaccctaataaaaaggtggagttctattcactgaaaattgtagacgtggtcgccgatgaacagccaaacaagaaaggtgacacctggtacagcctacatctcgaaaatggctgggtgtacaggcggagttccaagatccccctgtatgattggaaagacaaggttcgtgattttatcgtgacaaccgacattaacgaggacgggtctgaaaaacttgataaagacggagaggtcaagcgcagcttcagagcgcctaaagaggatgactggactctgataaagaaaaagacagaacaggagatcgaacagttcaatcaaaccgtgggctcctacatttatgaggcattgctcgataacccaacgcagaagatcaggggtaaactggtacggactatagaacgaaagttttacaaatcagagttaaagaaaattctggagaagcagatcgaactccaacccgagcttttcaccgaagacctgtataatgcctgcgctcgcgagttgtacagaagtaacgttgcccaccagcagcagctaagctctagggattttgtgtatctgttcctcaatgacatcatattttaccaacggcctctgcgctcccagaagtcacttatcagcaactgtagtctggagttcagaacaattaaagataaggacgggaacggacagataatctacttgaaagcaattccaaagtctaatccgtattaccaggaatttagggtctggcaatggctctataacctgaaaatcttcactaaggaggatgacaaggacgtgaccaatcagtttatcaacaaagtggaagatttagaggctctgttcgaatttctaatgaatcagaaggaggtcaaccatacagacattctcacctacctgatagagcccatcgttaaatccaagtatcctaatgccaaaggcaaggcgttcaaagatgaacttaagaaggagttgaaaaagtaccgttggaactatgtgtacgacgccgataaagacgaaagcaagtcgtacccaatgaatgagacgcggtatgaactgcgaaaaagactcgataaggtagagaacgtgcccgcagactttatgactaggaagattgagcagcacctgtggcacatcatttactctgtcacagataaaatcgagttcgaaaaggctcttaaatccttcgccaataagtatgacctgcatcaagaatcatttgtggagaacttcaaacgctttaagcctttcgatagtgactacggcacctatagcgaaaaggctattaaaaagttgctcccactgatgcgggttgggaaatactggtcctgggagggaatcgataataacactaagaaaagaattggtaagatcattacaggcgagtatgacgaaaccatcaagaatagggtgcgcgagaaagccatagacttaacggaagagaaccactttcaggggctgcagctatggctcgcacagtacattgtctacgatcgacattctgaggccgacatcgctggaaagtggaacagcgtggcggatctggaacaatatctttcagagttcaaacagcacagtttgcggaatcccattgtagaacaggttatcaccgagacactgcgtgtggtcagagacatatggaagcaatacggcaaaggtgcaaaggattattttgacgaaatccacattgagctcgggagggagatgaaaaacactgccgaggaacgcaagcggctgtccagcatcatttctgaaaatgagaccacaaacttaagaatcagggctatactggaggaacttatgtacgatgagaatatggaaaacgtgcgaccgtattcacctatgcagcaggaggccttgaagatttacgaagacggcgtcctcagtagctccgtggagatccccgaagatatcgagaaaatttctaagaaatcggagccaactaagagcgaaatccagcgctataaactgtggctagagcaaaagtaccggtccccttacaccggaagacccattccactgtcaaaactcttcacacccgcatatcagatagaacatatcattcctcaggccaggtttttcgacgatggctttagtaataaagttatctgcgagtctgaggtgaacgctctgaaggacaaaatgcttgggttggagttcattcagaattactatggacaaaaggtaaccactagctttggtgaagtcacgatcctgacagaagatgcctacaaagcattcgtgaaggagcactatgacaagaaccgttccaaacgcaataagttactcctggaagagataccagagaaaatgatcgaccggcagatgaacgataccagatacatttcaaagtatatcagcaaagttctttctaatctggtgaggggcgaaaaggacgatgagggggtcaactccaagaatattatcccgggaaacggcaaaataagtggtactttgaagcaggactgggggctcaacgatgtgtggaatgacctgattctaccccgattcgaacggatgaaccagctgaccaatagcacagattttaccgcgtggaacgagaaacatcaaaagttcctccctactatcccactggaactttctaaaggctttcagaagaagcgcatcgaccacagacatcacgctttggatgccctgattatagcatgtgccacaagggaccacgtaaatttactcaacaataaacatgctaagtcccggaacgagcgatacgatctgcagcacaaacttagacatacgaccccctggcaagacaaggagggaaaagtgcgcactaagttcacagaatttaaaaagccttgggagaccttcacacaggacactaagaaagaactggagaagatcgttgtctcatttaaacagaatctaagggtgattaacaaggccaccaattactatgaaaagatcgtggatggcaagaaggtcatgttcaaacaggagggggttaactgggcaattcgtaagccaatgcacaaagagacggtgagtggaaagatcgacctcccccgggtgaaagtaagcaagggtaagatactgaccgctacaagaaaatcgttggatacttcctttaatgccaagaccatcctgtctattacagacactggcatccaaaagattttactcaactacctgaaggcgaaagggaatccggaacttgccttcagccctgagggaatcgaagagatgaaccagaacatatcactgtataatgatggcaagccacaccagcccattttgaaggtcagggtgtttgagcagggtagtaaattccctctcggggaaaccggcaacaagacgacaaaatacgttgaggctgcaaagggaaccaatctgttctttggcgtgtatgaaaacaatcaagggaaacgctcctacaacactatccccctaaatctggtcatcgagcgacagaagcagggacttaactctgtgccagaaacaaatgagaaaggccatagactcctgttcagcttgtcccctaacgacctggtttatgtgcccattgagggtgaagtatttgataagaccaatccagacgtcaaccggatctacaagatagtgtcattcagcgggagtcagatgttttgcgtgaggcaagatgtcgccacttctattgtttacaaattagagttctccagcctcaataagatggaacgcaccatcgacggaattatgatcaaagagatatgtattaagctgaaagtggatcgtcttggcaacatctcgaaggcttga

SEQ ID NO: 3372 - RNA, 4323 nt, synthetic construct
  misc_feature 1..4323: note = Cas9 variant
  source 1..4323: mol_type = other RNA
atgaagaccatcctgggcctcgaccttgggacaaacagcattggatgggccctggtggagcaggatttcgaaaataaacaaggtttgatattaggcatggggtccagaatcattcccatggacgctggaatcattggcaagtttgcagagggttcttcaatcagtcagactgccgaaaggacggggtaccggagcatacgccgactgcgtgagagacacctactcaggcgggaacgcctgcatagagtccttaacatcctgaaattcttgcctgagcactatgcggctgagattgattttgaaaagaggttcggacagtttctcgccgagaccgaaccaaaactggcatggaagaagaatgccgagggcaaattcgagtttctgttccagcggtcctttgacgaaatggttgctgatttcaaggcaaacggccaagacatcaaaattccgtacgattggacaatctattacctccgcaagaaagccttaactcagaagatatctccccaggagctggcttggattatccttaattttaaccagaagcgagggtattaccaattgagaggagaagaggaagaggagaatcctaacaaaaaggtggaattttattcgctgaaaattgtagacgtggtcgccgatgagcagccaaataagaaaggtgacacctggtactcactacatctcgaaaacggctgggtgtacaggcggagcagtaagatccccctgtatgattggaaagacaaggttcgtgattttatcgtgacaaccgacattaatgaggacgggtccgaaaaacttgataaagacggagaggtcaagcgctctttcagagcgcctaaagaggatgactggactctgataaagaaaaagacagaacaggagatcgaacagttcaaccaaaccgtgggcagctacatttatgaggcattgctcgataatccaacgcagaagatcaggggtaaactggtacggactatagaacgaaagttttacaaatccgagttaaagaaaattctggagaagcagatcgaactccaacccgagcttttcaccgaagacctgtataacgcctgcgctcgcgagttgtacagaaggaatgttgcccaccagcagcagctatcaagtcgggattttgtgtatctgttcctcaacgacatcatattttaccaacgccctctgagaagccagaagtctcttatctccaactgttcactggagttcaggacaattaaagataaggacgggaatggacagataatctacttgaaagcaattccaaagagcaacccgtattaccaggaatttcgtgtctggcaatggctctataatctgaaaatcttcactaaggaggatgacaaggacgtgaccaaccagtttatcaataaagtggaagatttagaggctctgttcgaatttctaatgaaccagaaggaggtcaatcatacagacattctcacctacctgatagagcccatcgttaaaagtaagtatcctaacgccaaaggcaaggcgttcaaagatgaacttaagaaggagttgaaaaagtaccggtggaattatgtgtacgacgccgataaagacgaatctaagtcctacccaatgaacgagacgcgatatgaactgagaaaaaggctcgataaggtagagaatgtgcccgcagactttatgactcgcaagattgagcagcacctgtggcacatcatttacagcgtcacagataaaatcgagttcgaaaaggctcttaaatcgttcgccaacaagtatgacctgcatcaagaatcttttgtggagaatttcaaacggtttaagcctttcgattccgactacggcacctattcagaaaaggctattaaaaagttgctcccactgatgagagttgggaaatactggagttgggatatcattgacgacaagactaaaacaaggatcggaaagattatcaccggtgagtatgatgagacgataaagaaccgcgtgcgagaaaaagccattgacttaaccgaggaaaatcactttcagggcctgcagctatggctcgcacagtacatcgtctacgatcggcatagcgaggccgacattgctgggaagtggaactccgtggcggatctggagcaatatctttctgagttcaaacagcacagcttgcgtaaccccatcgtagaacaggttataacagaaactctgagagtggtcagggacatctggaagcaatacggaaaaggcgcaaaggattattttgacgagattcacatcgaactcggtcgcgagatgaaaaataccgccgaggaacggaagagactgtcaagtattatctccgagaacgaaacaactaatttaaggatacgagctattctggaggaacttatgtacgatgagaacatggagaatgtgcgcccgtatagccctatgcagcaggaagccttgaagatctacgaggacggggtcctctcttcaagtgtggaaatccccgaggatattgaaaagatcagcaagaaatccgagccaaccaagtctgagattcagcggtataaactgtggctagaacaaaagtacagatcgccttacacaggcaggcccataccactgagcaaactcttcacccccgcatatcagatcgagcatattatccctcaggcccgtttcttcgacgatggattttccaacaaagttatttgcgaatcagaggtgaatgctctgaaggacaaaatgcttggcttggagttcatccagaactactatgggcaaaaggtaactacgagttttggagaagtcacaatactgaccgaggacgcctacaaagcattcgtgaaggaacactatgataagaatcgctctaaacggaacaagttactcctggaggaaatcccagagaaaatgattgacagacagatgaatgatactaggtacatcagcaagtatatttccaaagttctttcaaacctggtgcgaggtgagaaggacgatgaaggcgtcaatagcaagaacatcataccggggaatggaaaaattaccggcatcttgaagcaggactggggtctcaacgatgtgtggaacgacctgatcctaccccggttcgagcgcatgaatcagctgacaaactctaccgattttactgcgtggaatgaaaaacatcaaaagttcctcccttccgtaccactggagcttagtaaagggtttcagaagaagagaattgaccacaggcatcacgctttggatgccctgataatcgcatgtgccacacgggaccacgtgaacttactcaataacaaacatgctaagagccgaaatgaaagatacgacctgcagcacaaacttcgccatacgaccccctggcaagataaggagggcaaagttaggactaagttcacagagtttaaaaagccttgggaaaccttcacacaggacactaagaaagagctggaaaagattgtcgtgaactttaaacagaatctacgtgtgatcaacaaggccaccaattactatgagaaaattgtcgatggaaagaaggttatgttcaaacaggaaggcgtgaactgggcaatccggaagccaatgcacaaagagacggtgtctgggaagatagacctccccagagtaaaagtctccaagggaaagatcctgaccgctacaaggaaatcattggataccagttttaatgccaagactattctgagcatcacagacactggtattcaaaagatcttactcaactacctgaaggcgaaaggcaatccggagcttgccttctcgcctgaagggatagaggaaatgaaccagaacatttccctgtataatgatggaaagccacaccagcccatcttgaaggtgcgcgtttttgagcagggctctaaattccctctcggtgagaccgggaacaagacgacaaaatacgtggaagctgcaaagggcaccaatctgttctttggagtctatgaggacaaccaaggcaaacgaagctacgatactatccccctaaatattgtgatcgaaagacagaagcaggggctgaactcagttccagagacaaatgaaaaaggacatcggcttctcttcagtctgtcccctaacgacttggtgtatgtacccatagagggcgaggtctttgatgaaaccaatccagacgtgaacaggatttacaaggtggtctctttcagcggttcccagatgttttgcgttcgccaagatgtggccacttcaatcgtatacaagctggagttcagcagtttaaataaaatggaacgtaccattgacgggatcatgataaaggagatttgtatcaaactcaaggtggacagactgggaaacatctctaaagcttga

SEQ ID NO: 3373 - RNA, 4332 nt, synthetic construct
  misc_feature 1..4332: note = Cas9 variant
  source 1..4332: mol_type = other RNA
atgatcaagctgctctaccttgagaaactgaagcagtataccatgaaaaagattttgggcttagacctggggacaagctccataggatgggccctagtgaacgaagctgaaaattctgatgaagtctcaagtatcattaaactcggtgttagagtgaaccccctgactgtagacgagatgcaaaatttcgaaaagggcaagagcatcacgaccaacgcagataggacacttaaacggtccatgcgccgaaatctgcagcgttacaagttgagaagggacgccctcattgagctgctgaaaaaggtggggtttatcactgataaaaccatactctctgagcagggaaaccggacaaccttcgaaacttatcgcttaagagcgaaggctgccgaggaagagatctcgctgaaggagcttgcaagggtcttgctgatgattaataaaaagcggggctacaaatcaagccgcaaggccaaaggtgaagaggaaggggctctaatcgacggaatggagattgcaaagaaactctatgatgaagacctgacacctggccagctttgcctgcaattgctcgagagtggcaagaagtttttcccagatttttaccgatccgacctgcaggaggagttcaacaaaatctgggattttcagaagcagttcaatttattttctttctgtgacgtggccaaagaggaagttaaggggaaaaacaagagccaaacctgggctatactggccaagtattttgtggagacgaaaaaggtcaatgtgtggaacgaacacgaggcgcagactgagaatagagaagaggtatacaaactcgttggacttaagaggaccgtgaaaggtgaggaactgaagaaggaaaactaccggtggcgtgtccaggcattgacagagcagctagatctggagaaaattgccgtggtgctccaagaaatcaatggccagatttccgcttcaagtgggtatctgggagccatcagcgaccgctctaaggtcctttacttcaacagacagactgttggccaatatcagatggcagagctgaacaaaaatccgaacatgtccttgaggaatatggtgttttaccggcaggactatctcgatgagttcaacgtaatctgggaaaagcaggctgagttccataaagaactgacccccgagttaaagaaggaaattcgagacataatcatattttaccaacgcagactgaaatcacagaagggtctaatcagcttctgcgagtttgaaaatagggaggtggtcgtggagaaagaagggaagaaacagacaaagataattggatgtaaagttatccctcggagtcacccactcttccaggagtttaagatctggcaaaccctgaacaatattgaagtgttcgtcggcgagaagaaaggcaagcgcaaaaagtctaacgtgtccagcgatctttttggggacacggaagatgccttgatcactgagggaagaaggttcctgtatcaggaggagaaaaagattctcgcgaaggaactgtcgattaaaaagggtcttacaaaagccgaaatcctgcgtttgctctttgagaatccccaggaactggacattaacttcaagcagatcgatggcaatcaaaccgggtttgcattattctctgcttactccaacatgatcgagaaatacggatatgagcctctggactttaagaagccagccgaagatctaatttcacagctcaaaactgtattcacagacctgggctggaataccgatcttttgttcatagacctggacaaggagaacaaagaatgggagaagcagccctactttcggctctggcatctgttatatagtttcgagggtgataatacgcctaccgggaacggcaaactgatcgaaaagattatgcagctttgcggaatcgagaaggaatacgctattgagttggccaacgttagcctccaagacgattatggctccctgtctgcaaaagccatcaagaaaatactactgtacctcaaggaagggaatcagtatgacatggcttgtgagtacgcgggataccgacacagcaaatcaagtctgacaaaggaggaaatcgagaacaaagtgcttaaggataagttggaaattctgccgaaaaattccttaagaaacccagtcgtggagaagatcctcaatcagatggtcaacgtgattaatactgttatggaagtgtatggtaggcccgacgagatccgcgtagagctggcacgggaacttaaaaagagcgccaaagagagagaggaactgaccaaggctgtcgccaagaacacaagggaacatgaggagatacgcaaagtgttgcaatctgaatttggcatgattaatgtttcacgaaacgatatcattcggtacaagctctatgaggaactgaaagacaatgggtacaagactctatatagtaaccagtacatccctcgtgagaaactgttcagcaaggagatagatatcgaacacattatcccacagtccagactctttgacgattctctgtcgaataagacccttgagtataaaagcattaacatcgaaaagggaaataaaacagcatacgacttcgtgaaggagaaatacggcgaagagggtttgcagcaatatctgaacaggtgcgagaacttatgtaaggataagaaagccaagctccgcaaactgaagatggaacttaatgagatacccgacgggtttattgaccgggatctgagaaacacccagtacatcgctaaaaaggccctatccatgctcactgaaatctgcaggcgagtcgtggcaacgacaggctcaattaccgacaagctgcgcgaggattggcagttggtagacgtgatgaaagaactgaatttacctaagtatgaggcgctcggactggttgaggtctacgaagataaagacggccggaagatcaaaagaattaaggattggactaaaaggaacgaccaccgtcatcacgctatggatgcccttaccgtggcattcacaaaggacgtgtttatacagtatttcaataacaagaatgccgcttgggagagtgattctaaagaacataccaacatcgtcgggattaagactcgctactttgagagcggaaaagccgttccacccatcccgctgggtcaattccgggtggaagcaaagtgtcacttggagaatctcctggtgtccattaaagctaagaacaaggtagtcacaacgaatgtgaactgcatcaaaaagaaaggcgggacctataagaatactcagcagacacctagaggacagctacacctggagaccatatacggctcacataaccaatacgttacaaaaatcgaaaaggtgaatgccagctttgacgcggtcaagattgccactgtgtctaaacaggattataggaacgcacttctcaagcgactggaggttttcggtaacgaccccaaaaaggctttcaccgggaaaaattccttggaaaagaacccaatctacctggaccgggcccagacgattcaagtgcctgataaggtacagaccgtcgagttagagacagcttatactatccgcaaacccgtggacccaaccctcaatgtggataaggtcgttgacaaaaagataagactgattcttgaacagaggctgaaagagtacggcggagatgccaagaaagcatttgtgaacttggacgaaaatcccatctggctcaacgaggaaaagggcatcagtattaagcgggtaacaatacgagggatcagcaaagcgcaggccctgcacgataagaaagacaaggatggaaatttcattctagacgagactggcaaaagaatccctgtggattttgtcaacaccggtaataaccatcacgtggctatttatcgcaagccagttctggacaagaaagggcaagtgatcttcgacgatgagggaaatccgatgtacgaacttgacgaggatgtcgtgccctttttcgaagccgttacgagggcaaacctcggcatacctatcattgacaaggattataaaaagtctgagggttggcagtttctgttctccatgaaacagaatgaatactttgtgttcccaaacgagaagacaggctttaatcccaaggaggtcgacttgttagatcctgacaactacgctatgatctcaccaaatctgttccgtgtacagaaaattgggctcaacgattataccttccggcatcacctggaaactacaatccaaaacgaccttaagtttataacctggattagatgtggaaaaagtggcatcaaggatatcgtgaaagttaggattaatcacatcgggcagatagtgagcgtcggagagtactga

SEQ ID NO: 3374 - RNA, 4332 nt, synthetic construct
  misc_feature 1..4332: note = Cas9 variant
  source 1..4332: mol_type = other RNA
atgaagaaaatcctgggcctcgaccttgggaccgccagcattggatccgcttacgtgctggaggcagaaaagtctgccgatcagacaaaaatagtctatttgggtactagaatcattttatcaagtgcggacgctgagaacttcagcaagggcctgtcctgctctcccacgaccgataggacatttaaacggtcgatgcgccgacgtctacaaagatacaagcagaggcggtcaagcctcatccagcagttcaagaaaattgggatcataactaataccgaacaaatcattcgcgagcctatcagtgaaacacacgagctgcttagaattaggtccaaggccgtttctgagcatgtgagcctggaagagtttgcacggatcttgctcaccataaacaaacgccgaggatataagtccaatagaaaaacttcaaagagtacagaagaggacggcaagctggtagatgccatggctgtgaccaaagagctgattaagctcaaaaagacgccaggtcagtacatgttcgaaaggtttaaacgggggaagtatgcagagatcgacttctacccgtttgatttaattaacgaactgaaacagatctgggaggtccagggacaaaagtatcccgacgtgcttactgaaggcttgctgagctctctactcaagcagaaaaccggcaaggccaaagagctgatctactccaagtcagatcttaatcctgctgaggttccaattgactaccagaaagggaagaagctgcgtaaaacaatattgaacaagtatttcgcctacgaaagccgcagtctcgcggtgactaatatcattcccgtcgagcaggcaatcaccgccatagtggctatttgtaaacaaatcaacaattcttccggatatctgggtgccatcggcgatagaagcagggtattatacgcaaacaatcagacaattgggcagtatctgtacgaacggatcaaggctaaccctcacgaccgcattcgaggagaggttttctatagacaagattacctcgacgaatttgacaggatatgggagtgccagcagaattactatccagccatccttaccaacgatcggaaacagtacattcgcaatagaatcatcttttatcaaaggcccctgaagtcgaagaaatctgagttggcgttctgtgaatttgagtcccgtgaagtggagcataacggcaagaaatacacggaaggtctacacgtcgcccctaagtcaagtccagtgttccagcatttccggctgtggcagcgactcgggcagattgaggtgagcccgctgagaaaatgggacaagcaatccaacgagctttttgaacagcagaataacgcagatagggagggaatactgaatactgaagctaagcagaaattgttctcttatctcaacctgttagaccacctgacagataatgagatcctaaacattctcggctacagccccgacaagtggaaaatcaattttcgcgagattatcggcaaccggaccaataacctgatgatgaaggccttcttttcaatgaaagaaatgactgatggggagcaaatagactgggaaaagaatcttacaaaaatcaccaacggacagagtttgatttcccctgagcagatcgtcgatctgattagacagttctttgaaagggagggtatcacgaccagcctcctgtatttcgacccagctacagataattttcgcgagcaatctcactactcactttggcatctgttgtacagttatgaagacgacaacagccccactggcaccacatccctctgcaagactctggccaagcgatacgggatacctcacgagttatgtccactgctagcatctctcaccttcgaacggcagtatggatcgctgagcacaaaagccatgcgtaaacttttgccctttatgcaggagaagagatacgatgaggcttgcgaactggcgggctataggcattccgcatggattaccaaggaggaaaatgccaaacgcactctcaagaacaagctgccgttactgcggaaaggttcacttagaaaccctgttgtggagaagatcttgaatcaaatgacgcacgtaattaacacacacatcgctgaatacgggaatcccgacgagataaggatcgaaatggcccgagatatgcaggcaaacagtaaacagcgcaaggccatgaccgctgccattactgaggcaaccaaacggaatacacagttcatcgaggaaattcaaaaggagtttggcttcaacccatctaagaatgacctcatcaaatataagctgtggaaagaactagcgcctctgggaaacaagaccctctacagcaatatatacattcccaaagaggagctgttcactgctaagtttgaaatcgagcatatcattccaagagcccttttctatgatgactccttttcaaacaagacattggaactgaatagcgtgaacaaattaaagggcaataaaacggcactcgattacctggacacccttgggcaggagaaggccaacgattatatcctgagggtcgaagagttgaaaaagattggagctataactcaggccaaatacaagaagctcctgatccgtgagaaagacctaggtgatgacttcacaaatcgcgatctgaccaacacacggtatattatcagacacgcagctgacagggacctcactaacacccgatacattatccggcatgccgcggatatgctgcttcaggtgacgccctctatagttcacaccaatggctccatcacagccattttgcgcagagactgggggctgttagatatcctcaaggaactgaaccttcctacttatgagagtattgacaggaaaatcagcgatccagaagagaagctgacccaatctgtggaccggaaagatggacaggctataaagatgattaaggactggtccaaacgagatgaccatagacaccacgcaatggatgccctaatcacagctctcactacccgcaagcatgtccagtacctgaatggcaactcaggtgccgaagagacggacaaagcacagaagttggagcaactgaaagcgttaaggaagcagctcatcgggagtgatggccactttattccgcccatgcatgacatacgtgtgcaggccaaggaagctctgagccgggtaatcatttcgacaaaagttaagggaaaagtgaccactcctaatacaaacatcatttgttccagagacaagaccactggcaggaaaatctacgtccgccaaaccacacttacgccacgaggggccctgcacttggataccaagtatggaataaatagatactatcaggagcgggaagtgtctatcggtagcaagctcactcaggaggaaattaggctggtctcaagtccccacatccagtccattctactggagcgccttcgtgcattcgacaacaatcctaaatctgcttttacaggcagaaacagcgtggataagaaaccactcgaggacaagaataaaaagctggtttacaccgataagaaagtgaagcaaacaatcttggccaaccggttcgtaaaaagggaccgcgtcaattccaagctggatttagacaacgtgatagatactgggattaaacgaatcctcgaaagacggctgaagcagtatggaggcaaatacgagaccgcattttcagaccttgaaaataaccccatctggctgaacgaggagaagggtattgccatcaagagcgttaggatacgcgggaaaaataacacgattacaatcagacagaccaatacttgcaggattaagtatgtggctaacgataataaccatcacttggcggtctacgccctcccggacggcagtatcaaagacgatatagtgtctttctttgacgcagtagaacggtcccgtaagcgcctgcctattatcgataaacataagaatcagagcctaggatggaagtacctgttctcgatcaaacaaaacgagtattttcttctcccacaacaggtggaaaagattgacatcgataccggcgagatttcaatgcagacaactttctctcccaaagacctgagtcacgaatacataatgaatcctgataactatgctgagttggcctcccatatcttccgagttcagagcatttctaagacaccccaggggaatagagacgtcaggatctacttatttaaacagcagtatatcagcggatcccaaaaggattcactgcacctcaagggcattacccaccggcagataagtagcgccaaagacctggctgagcttgtgaagatccgcgtgaaccatctgggtagaattgtctctgttggggaaaaatga

SEQ ID NO: 3375 - RNA, 4341 nt, synthetic construct
  misc_feature 1..4341: note = Cas9 variant
  source 1..4341: mol_type = other RNA
atggtgaagaacatcctgggcctcgaccttgggaccaatagcgtcggatgggccctgattaaacaggatttcgagaacaagcaaggtgacatattgggcatggggtccagaatcattcccatgtctcaggatgttttaggagactttggcaaaggtaattcaatcagtcagacagctgaaaggactaagtaccggagcgtgcgccgactgcgtgagagattcctactcaggcgggaacgcctgcacagagtacttaacgtgctggattttcttcctgagcattatgcatcccagattgacttcaataaaaggtttgggaagttcaaggaagagacggagccaaaactcgcctactctaacgatggatttatcttcaagaaatcgtttgaagagatgatatcagacttcaagacccaccaaccggaactgctggagaataacaaaaaggtcccctatgattggacaatctactatctccggaataaggcgttaagccataaaattgagaaggaagaactggcttggatccttttgaactttaatcagaaacgcggctactatcagctgcgaggcgaagaggaagaggagaaccctaataagctaattgagttctacagtctcaaaatcgtggacgttctggccgatgagccacagaaggggaaatccgacatatggtactctcttattctggaaaacggatggatctatagaaggagctccaagattcccttgctcgattggaagggtaaaactcgggactttatcgtgaccacagacctgaatgatgacggctcagtcaagaccgataaagaggggaacgaaaagcgtagtttccgcgcacctggagagaacgactggactttagtgaaaaagaagacagagcaagaaatcgataatagcgacaaaaccgtaggcgcctacatttatgaggctctgctccagaacccaaagcagaaaataaagggtaaacttgttagaacgatcgaaaggaagttctacaaggcagagctgaaacagattttggaaaagcaaatggagtttcaccccgagctacggcaggatgacctgtattctgattgcgtgcgagaactctacaaaaataacgaggcccatcagctgactctttccaagaaagacttcgtccacctgtttatggaagatatcatattctatcaacgccctttgagatcacaaaagagcagtatttctaattgtaccctcgagtttaggaagtacaaagacgagaacgggacagaacacatccagtacctgaaggctttaccaaaatccaatccgtattaccaggagttccggatctggcagtggatgtataacctgaatatttacaagaaagaagacgatactaacgtgaccaaggagtttctaaatagcaaagccgacttcgaatcgctctttgagttcctgaacaataagaaggaggtggatcagaaagcgcttttgaagcattttaaaatcaacgacaagacacaccgctggaaatatgtcgaagataagaagtacccctgcaatgagaccaaaacgatgatttctgaaagactgaagaaagttgagaacatatccgacgatttcctcactagggaaatggagcagaagatctggcatattatctattcagtgaacgacaaagtaaagtacgagaaggcactgaaaagttttgccgaaaagaataaccttgatgagagctccttcttcgaggcttttaaaaagttccctccatttaaatctgaatacggagccttcagcgaaaaggcaatcaagaaactgttgcccctcatgcgtctgggcaagtattgggacgatgacgagattttaaaatactcagatatatattttaagaatatcgagtacctgctaggcgtgctcaaacagaaggacaaaaacattagtgacgataatcggcaaaactggaataagtccatcaacaataagctgcgagaggaacttgaaattttccagaacgctgagatcgagagctttcaggggttgagactgcacatagcccagtatatcctctacggaaggcactctgaagcggccatgctgggtaaatggaactcagcagacgatttagaggagttcctgaaggaatttaaacaacatagtcttcgcaatcctattgtcgaacaggtgatcacagagaccttgcgggttgtgaaggacatttgggtcaaatatggcaatggggctaaggatttctttaacgagatccacatagaactcggaagagagatgaagctgccagccgaagacaggaaaaagattactaatcagatcagcgagaacgaaaacacaaatctacgcattaaagctctgctcgccgagatgatggtggattcctctgtagagaacgttcgacccttctcgccgatgcagcaagaaatcctgaagatatacgaggacggcgtgcttaatagcgatatcgaaattgaggacgatatcttgaaaatttccaagaccgcacagccttcacccagtgacctgaagcggtacaaattatggctcgaacagaagtataaatctccatacacgggtcaaatcatacctctgaacaagttgtttacccccgagtatgagattgaacatatcatcccacagagccgttacttcgatgactccttctcaaataaagtcatttgtgaggccgctgtgaacaagctgaaggacaattttatcgggttgggcttcattaaacagtttggaggcacaatagtcgaatgcgggaacggaaagagcgtgactgttctcaaagaggatcagtatgaggacttcgtgaagaaacactacgcgaataacagatctaagaggaataagctgctactggaagatatccccgagaaaatgattgaacgccaaatgaacgacacccggtatatctccaagtacattagtggtgtactcagcaatatcgtcagaacagaggatggcactgacgatggggtgaactctaaaaatatagttcctggaaacggcaagatcaccaacacactgaaacaggactggggtcttaatgatatttggaacgacttgatcctgccaaggtttgaacgaatgaatcagttaaccaactccactgatttcacggcatggaatgagaaccatcagaagtttctcccgacagtgcccgtcgagttctcaaaagggtttagtaagaagcgcattgaccaccggcaccatgccctggacgctcttgtgatcgcctgtgcaaccaaagatcacgtaaatctgctaaacaatcaaagcgccaagtcggacactaaaagacatgatctcaagaggaaactgatgaagttcgaaaaggtggcttacaaccaccctcagaccggcgagcgtatagaacgcgaggttccaaaacagtttttgaagccctgggaaacattcaccgtcgaggccaaaaatggactggagactattatcgtgtccttcaagcagaacttacgggtgatcaataaagcaacaaaccactatgaaaagtacgtcgagaaggacggcgcgaaagttaaggggagagtggaacaagctggaacgaattgggccattaggaaacctatgcataaggagaccgtgtctggtaaaatagatctcccacgaatcaaggtacccaagggcaaaattctgactgcaacacggaagaaccttgacaccagctttgatctgaaaacaatcgggtcaattactgacaccggaatccagaagatattgaaaaattatctccagtacaaggataacaacccggaactggccttcagtcctgagggcatcgaggacatgaataaaaacattgaaaagtttaatgatggtaaggtccaccaaccaatcattaaagtgcgcatcttcgagctagggtccaagtttcccctgggccagtctggaaacaaaaaggacaaatatgttgaagctgccaagggcacgaatcttttctttgcagtgtacgaggataagaacgggaaaagaagctatgagaccatacctctcaatgaagtcattgagaggcagaagcagggactgacagtggttgacttgaaaggcgtgaacgacttctacctgtcccccaatgatttagtatacgtcccatcagaagacgagctcgaaaacgtgagcatgatcgattataataagctgagtaacgagaaagtgtacaaggtcgtttcttttactggtaatcaaatcttctttgtgcggcaggacgtagctacctccattgtgaacaaggccgagttcagctcgcttaataaaatggaacgagcgatcgggggaacaatgataaaggaggtctttgtgaaaattaagatcgatagactgggcaacatttcaaaagtttga

SEQ ID NO: 3376 - RNA, 4347 nt, synthetic construct
  misc_feature 1..4347: note = Cas9 variant
  source 1..4347: mol_type = other RNA
atgaagcacatcctgggcctcgaccttgggaccaacagcattggatgggccgtggtcaaagaggctcagaatgataacgaacaatccgagatagttgacgtgggtgtaagagtgaatcccctgacaactgatgaaaagacgaacttcgagaaaggcaagcctatctctaccaatgcagacaggacattgaaacggtcagcccgccgaaacttacagcgttacaagctgagaaggaaggaactaattgagctcctgaaagagcatcagcttatcagtgaaaatactattctgaccgagaacgggaagggaacaacctttcagactttggaactccgggcgaaaagcgctaaggagaaaatctccctgggcgagctggcccgcgtcttcctcacaataaataagaagagaggttataaatcttcgaggaaggccaaaaacggggatgaaggacaattaatcgacggcatggagattgcaaagcggctgtacgaagagaatcttaccacgggccagttgtcactgcagctactcaaagaagggaagaaaagcctgccagattattaccgcagtgaccttcagtttgagctggataaggtgtggaacttccaaaagcagtcccactctgacatcttgactgatgagttttatgctcagctcaaaggaaagggtcagcgagcaaccagcgccctgttcttagctaaataccaaatttatacagccgaaaataagggctccagagaggacaaaaagctgcaggcgtaccagtggagggttgatgcactctcaaaggaacttactcgggaggaactggcctttgtgatcaccgagataaacaataacttgaacaatagtagcgggtacctaggagctatttctgaccgttccaaagagctgtatttcaacaatgaaacagtcggcgagtacctctggaagcaaatcgccgcaaacccgcataattcactgaaaaaccaggtgttttatcgccaggactaccttgatgagttcgagcagatttggaagacccaaagcgctttttatcccgaaatcctgacggacgagttgaaaaaggagctcagagatgtagttatcttctaccagaggaagctgaaaagtcagaagtctttagtgtccttttgcgagttcgaaaataaagaaattgagataaagaacgaggacggtactacaaccaaaaaggtcatcgggctgaaggtggcccctaaaagctcgccactattccaggaatttaagatttggcaaaatctcaacaatgtgctgatccggaaaaagggatctaaaactaagaaagtcgcgaagaaccagcaggccgttcttttcgaggaagagaagacaatatccgaattggatctggaggcaaaacaggctctctttaatgagctgaaccttaagggcaatctgaaagccgactattgtttggaaattctcggctactcacccaaggagtgggaaatgaactacagtatcctggaggggaaccgaaccaataaggctttatatgaagcctacctgaagatcacggatctagagggatatgacgcaaagaaccacctcaaagtgaagctgaataaagatgaggtagaacttgacgatttgaaggtgcctgccagcgagattaaagacatggtccaagctatcttcaaggaagcgggtattaacaccgacatactgcattttaatgcagagctcgatggcaaggacttcgaaaaccaggcctcctaccagctgtggcacttactgtattcttacgagggggatgacagcaaatcaggaaatgagcttttgtataagctcctggaaacaaaatttggcttcaagaaagagtacgctcagatcctagccaacgtgagtctgtccgatgactacggtaatctcagcactaaggcaatgcgcgaaattatcacccacctgaagcaagggtttccattcacaggcagaaaagataggcccgacgagccttctgcctgcgagtttgctggatataagcattcaaaacacagtcttactaaggaagagaacgaaaaacgggttttgaaggatagcctggaggtgttaaagaaaaattccctccgccagccagtcgtggaaaagatcctgaaccagatgattaatcttgtaaacgccctgttgaaaaagtacagaaccgagaatccgaacttcaaatttgacgagataaggatcgaactcgcacgtgagctgaagaaaaaggcggaggaacgggctaacatgacagccaatattaacaaggcaaaaaccgaacatgagaagatcattaaaatcctaaagaatgagttcggcctgcccaaccctactcgaaatgatataatcagatataggctctacgaggaactgaaagacaacgggtataaggatctttacaagggagactatattccacgcgaaaaattgttctctaaggagatcgacattgaacacatcatacccaaagcccgggtttttgatgactcgttcagcaataagacgattacatacagaaaaaccaacctggagaagggtgagaggactgcttacgattatatcgaatccttaggcgagaagcaactcgaagagtttctgtcacgcattgagaatctttacgaaatcgggaaacctagtcgactgcacaaccggcgtaatccactaaagaaagtggaggaaaagggaatatctgacagcaaatataagaagctcctgaaaaaggagtccgaaatcggcgatggtttcgtcgagagagacttgagggagacccagtacattgccaaaaaggcaaaagaaatcctgttacagattacacgctcagtgctcagcacctctgggggcatcactgatcggctgagagaggactgggatcttataaacgtcatgaaggaactgaatttgcccaaatatagggctctcggactgacaaagatggaggaccgaaagtacggccagcaagtggaagttattacggattggaccaaacgcaacgacctacggcatcacgccatggatgcgctgactgtggcctttacaaagcataatcacatccagtatcttaactacctcaacgctcgcaaaaatgagaagcataaagagcacaacaatatcatggcaattcagcagctggaaaccatcaaggtaacagacgagaacgggaatgaaaagaggattttcaaagccccgatgcctaactttcgtcaagtcgctaaggccttcttggagaatgtgctgatatcccacaaagcaaagaacaaagttgtgactaagaataagaacaaaatcagtggaaataacaaggtccaggaagtgttaacccccagaggtcagctccataaagagacgatttacggcaagtatcagtactatgtacaaaaagaggaaaagatcgggggaaagtttgacctggagaccattgaaaaagtggcgaatccactttaccagagcctgttgaagaaacggctcgaggagaacggcggtgatcctaagaaagccttcacagggaaaaattctctggctaaaaaccccatctatctagacgaagcccagactgagcaactgccagaaaaggttaaacttgtctggctcgaaaattccttttcaataagaaaagatatcacccccgaaaacttcaaggacgagaaactgattgataagatcttggacgagggcgtgaaaaggattttaaaggaacgactgcagagttttggaaacgatgcaaagaaggctttcagcgacctcgagaagaatcctatctggctgaacaaagaaaagggcatagccattaaacgggtgacaatctcgggggtcgcaaatgccgagccacttcacactaagaaggatcatctgggaaaagaaatcttggacaaggagggcaaaccgattcccgttgatttcatatccaccggttctaaccaccacgtggctgtgtaccgcgacgagaaggggaatctacaggaaaaagtagtcagcgtgtttgaggcggttgtgagagccaaccagggactgcctatcattgacaagacgtataatcaatacctcggctgggagttcctgttttcaatgaagcagaacgaaatgttcgtctttccaaatgaaagtacaggtttcaaccccaatgatatcgaccttttagatcctaaaaacaagaaaattatctccccaaatctgtttagggtgcagaagctcgcaaccggcgactactggttccggcatcacttggagactacagttgagaccaaatctgctactaaggatatgacctataaacgactgagcctcaaccatataaagaatatcattaaggtgagaatcaaccacctgggggacattgtatccgtcggagaatactga

SEQ ID NO: 3377 - RNA, 4353 nt, synthetic construct
  misc_feature 1..4353: note = Cas9 variant
  source 1..4353: mol_type = other RNA
atgaagcacatcctgggcctcgaccttgggagcaactccattggatgggccttcgtgcagcaagattttgagaataaacagggtaagataatcgctaccggctctagaattatccccatggaccaggggattctgggagatttcgaaaggggcaacacagtctcacagactgcagagcggacgacctaccgcaatacacgacgtttgagagaaaggcatttactgcggcgcgagagactacacagggttctccatatcctgggttttcttcctccacactatgacagtcaaatagatttcactaaacggtacgggaagtttatcgacaacgccgaaccgaaaattgcgtataataacggaaatttcatctttatgaacagcttcaatgagatgattgaggattttaagaagtaccagccccagctgttctataaaaagtccaacggcgaagagtctaaaatcccttacgactggaccatatattacttgcgcaagaaagctctctcgcagaagattacacaacaggaactggcctggctgatcctccattttaatcagaagcgaggctactatcagttaagaggggaggaggaaaccgagaacccaaataaagaagtggcattccactcactggaggtagtggatgtcgaagccgaggctcccaacaagaaaggagagatttggtacactatcaggcttgaaaatggttggatctatcggcgtacaagcaagattcctttggacgattggaaaggcaagacccgcgactttatagtgacgactgatctgaacgacgacgggaccatcaaactagataaggagggaaaggagaaaagaagtttcagggcaccagacgagaacgattggaatctcctgaagaaaaagacagaacacgacattgatttctccggcaaaactgttggtgcctacatctatgaccatcttctgcaaaaccccaatcagaagataaaggggaaattggtgcggaccattgagcgaaagtactataaagatgagctcaaggctatcctggccaaacagatcgcgttacaacctgaactgtttacagagaccctccttgcagactgcattcgcgaactgtacagaaagaacgagacgcagcagcagaatttgctatctaaggatttcctgcacctctttgtcgaagacatcattttctaccaaaggccactgcggagcaaaaagtccactatagccaactgtacacttgagaaacgctcatatatcgataaggagaccaatgaaagaaaagacactccgattaaggtgtgcgctaagagtaacccctactatcaggagtttagggtactgcagtggttgcagaatctccgtatctacgaaatcgagacagaccgggaggttaccgccgagttcattgaaacggcacaagataacgaagctctgtttaatttcttaatgagccagaaagagatagacaacgaatctctgctaaagtattttctcttcgccaaaaatcctcagatcaaggataaagtggcgaagtccgagctgaaaaagtggcttaccacataccgatggaactatgtctacgacgccgcagataattcaagcaagaaatacccaatgaacgagactggatatgaattgcagcaatacctgcagaaggtggagggcctccccgctaactttctgaccttcgacattacatatagactttggcatctgttgtacagtgtgaaagataaggtcgaatttgagaaagccctcaagaagttcgctcaggaatatcagctggacgaggcctctttcgttgattcctttaaaaatttcaagccttacccaaacgagtatggcagcttttcggaaaaagcaatcaagaaattactgcccctaatgaggttcgggaatcactgggactttaaccgcattgatgtgtctactcaaaagcggatcgacgatctcataaatggagtagccaacgacgagatcagaaccattatcagggaaaaggctgagaaataccagcttaattccgaaacatgtttccagggtctgccgttgtggctggcgcaatacgtggtctataaccgccacgcagaggccgctgacattgagaagtggacctcagtgaatgatctcgaagcctacctggaggactttaaacagcatagtttacgaaaccctatcgttgaacaggtgataactgagacgctgcgggtcgtgcgtgatatttggcagagatatggcgggggacaagcaaatttctttgacgagatccacattgaacttggcagggagttgaagaaaacagccgaagaacgcaagcagctcagcaaccggaatcaggaaaacgagaataccaacctgagaatcaagaaactactggctgagctcaaggaagatgcctccatacagaacgtaaggccctactctccagttcaacaggagctgcttaaaatctatgaagagggtgtgttcagcgcaactgacgaagtcgaggaggatattcagaagatccgcaaaaaggcggaacctaccacacccgagattcagcgatacaaattgtggctggaacaaaagtataagtcaccatacaccggggaggtgatcagtttaactaaactctttacagaagagtacgagatagaacatattatcccccagtcccggtattacgacgatagcctgtctaataaggtcatctgcgagtcagctgtgaacaaacttaagacgaatcagctgggcttggagttcattcaaaaccaccatggagaaaaagttagaatcaccgccaataaggaggtgactatttttacagaggaacagtataaggagttcgtcaaaaagcactacgcaaacaatagtgccaaacagcagaagctcctgctaaacgaaatacctgagaaaatggtagctaggcaactgaatgacacccgttatatcagcaagtacatttccgaaatcctctctaagattgtgcgctcggatgagaaagacgaaggcgttaacagcaagaatatcataccatgtacagggaaaatcactaccgccctgaagcaggattggggacttaacgacgtgtggaatgagttgattctgccgcggttcgaaagaatgaaccagttaacgcagacccaactctttacatcctataatgacaggttccagaaaaacctgcccactgtccctatcgagtactcacagggttttcagaagaagcgaattgatcaccggcatcacgcaatggacgctcttgtgatcgcctgcgcgacccgcgaacatataaactacatgaataaccaacacgccctggataaaagtaaggacaaaaaggagaaacagcagtctagaattgatctaaggacaatcctctgtgagaagaagaataacaattggcagttcaaaaagccatggagcacttttacccaagaagctcaggaggcactggaacacatcgtagtgtccttcaaacagaacttgcgggttattaataaggccacgaactattacgagaaatgggaagagaagaatggcgtcctggtgaaaaagaaggtgaaacaagaggggacaaactgggctatacgaaagcccttacataaagaaaccgtctcaggaaagatcgttctcgacagaaaaattggcaaggataagatcctgactgccacacgcaaaagcgtggacattacctttactgagaagatcatatcttccatcaccgatacaggtattcagaaaatccttctgaattatttgaagtacaaagggagtcctgaagtggcattcagcgcggagggcctcgaggaactgaacaagaatattgcccagtataacgacggaaagaaacaccagccaatctacaaggtaaggatatttgaggaaggctctaaattccccctaggggagacgggagctaaggccaccaaatatgtcgaagcagctaagggtactaatctgtttttcggcgtgtaccaagggaagggaaaacgtacatacgccaccattccgcttaacgaggttatcgagcggcagaagcagggcctcccttccgtgccagaaagaaatgagaaaggtgaacccctgttgttctcactgagtcctaacgatttagtctatgtgcccatggagggggaaatcgcagagacaattgactttaacaatctcagcaaggagcagaaagaaaggatctacaagactgtttcgttcaccggcaaccaatgctttttcgtgcaggaggccgtagctacgccaatagtcaataaaattgaatattcccctctgaacaagatggagcgcgacatccttggaacaatgattaaggaagtgtgtatcaaactgaaggtggatcgattgggcaatataaccaaagcgtga

SEQ ID NO: 3378 - RNA, 4353 nt, synthetic construct
  misc_feature 1..4353: note = Cas9 variant
  source 1..4353: mol_type = other RNA
atgaagagaatcctgggcctcgaccttgggagcaactccattggatgggccttcgtggagcaggattttgaaaataaacaaggtaagataatcgctaccggctctaggattatccccatggaccaggggattctgggagatttcgagaaaggcaacacagtctcacagactgcagaacggacgacctaccgcagtatgcgacgtttgagagagaggcacttactgcggcgcgaaagactacatagggttctccacatcctgggttttcttcctccacattatgacgcccagatagatttcacaaagcggtacgggaaatttatcgacaatgcggagccgaagattgcttataacaatggaaacttcatctttatgaatagcttcaacgagatgattgaagattttaagaaataccaaccccagctgttctataagaaatccaatggcgaggaatctaagatcccttacgactggactatatattacttgcgcaaaaaggtgctctcgcagaagattacccagcaagagctggcctggctgatcctccactttaaccagaaacgaggctactatcagttaagaggggaggaagagacagaaaatccaaacaaggaggtagcattccattcactgaaagtggtcgatgtggaagccgaggctcccaataagaaaggagagatttggtacaccatcaggcttgaaaacggttggatctatcggcgtactagcaagattcctttggacgattggaaaggcaagacacgcgactttatagttaccacggatctgaatgacgacgggactatcaaggtggataaagagggaaaggagaaaagaagtttcagggcaccagacgagaacgattggaacctactcaagaaaaagaccgaacacgacattgatttctccggcaagacagtcggtgcctacatctatgaccatctgcttcagaatcccaaccagaaaataaaggggaaactggtgcggactattgagcgaaagtactataaagatgagttgaaggctatcctcgccaagcaaatcgcgctgcagcctgaattatttaccgagacactgctcgcagactgcattcgcgaactttacagaaagaatgagacccaacagcagaacctgttgtctaaggatttcctacacctgtttgtagaagacatcattttctaccagaggccactccggagcaaaaagtccacgatagccaattgtactctggagaaacgctcatatatcgataaggagacaaacgaaagaaaggacacctttattaaagtttgcgctaagagtaatccgtactatcaagagttcagggtgcttcagtggctgcagaacttgcgtatctacgaaatcgagactgaccgggaggtcacagccgaatttattgagaccgcagaagattatgaggctctcttcaattttctgatgagccagaaagaaatagacaacgagggattactgaagtacttcctatttgccaaaaatccccaaatcaaggataaagtggcgaagtctgagctcaagaaatggctgacgacctatcgatggaactacgtgtacgacgccgcagataattcctcaaagaaatatcctatgaacgaaacaggctacgaccttcagagatatttgcagaaggtcgagggcctgccagctaatttcctcacttttgatattacctacaggctgtggcaccttctgtatagcgttaaagacaaggtggagttcgaaaaggccttgaaaaagttcgctcaggaataccaactcgatgaggccagttttgtagactctttcaaaaactttaagccctatcctaacgagtacgggtccttcagcgaaaaagcaatcaagaagctgttaccactgatgcgctttggaaatcattgggatttcaaccggattgacgtgtcgacacagaaaagaatcgatgacctaataaatggtgtcgccaacgacgagatcaggactattatccgcgaaaaggctgagaaataccagctcaattctgaatcctgttttcagggcctgcccctttggttggcgcaatatgtggtttacaaccgacacgcagaggccaccgatattgagaagtggacatcagtgagtgacctggaaacctatctcgaggatttcaaacagcacagcctgcggaatccgatcgtcgaacaggtggtaactgagacgttacgtgttgtgagagacatatggcaacagtacgggggaggccaggctaactttttcgatgagattcatatcgaactgggtagggagcttaagaagacagccgaagaacgcaaacagttgtccaatcggaaccaagaaaatgagaacaccaatctcagaattaagaaactgctagcagagctgaaggaagacgcctctatccagaacgtcaggccttatagccccgtgcagcaggagctcctgaaaatatacgaagagggggtcttttcaagtactgatcaagtggaagaggacatccagaagattcgcaaaaaggctgagccaaccacacctgaaatccagcgatataaactttggttggagcagaaatacaagtccccctacaccggcgaagttattagcctgactaaattattcacagaggaatatgagatcgagcacataattccacaatctcggtactatgatgactcactcagtaataaggtgatctgcgaaagcgccgtaaacaaactgaagacgaaccagcttggactggagtttatccagaatcatcacggcgaaaaggtcagaattaccgggaacaaagaggtgactatcttcacagaggaacaatacaaggagttcgttaaaaagcattatgcaaataactccgcgaaacagcagaagttgctcctgaatgaaattcccgagaagatggtggctaggcagctaaacgatacccgttacatatctaaatatatctcggaaattctgagcaagatcgtccgctccgacgagaaagatgagggagtaaattcaaagaacgtgattccttgtacaggtaaaatcactaccgccctcaagcaagactggggcctgaatgacgtgtggaacgaacttatattgccacggtttgagagaatgaatcagctgacgcagacccagttattcacaagttacaacgataggtttcaaaagaatctcccgactgttcccatcgaatactctcaggggttccagaaaaagcgaattgaccaccggcaccatgcaatggatgccctggtcatcgcttgcgccacccgcgagcacattaactatatgaataaccagcatgcacttgacaaaaacaaggataaaaaggaaaagcaacagagcagaatcgacctgaggacaatactatgtgagaaaaagaataacaattggcagtttaaaaagccttggtccactttcacccaggagacgaaagaagctctcgagcacattgtggtgtcatttaagcaaaacctgcgggtcatcaataaagccacaaactactatgaaaagtgggaggaaaagaatggagttttggtgaaaaagaaagtgaagcaggagggcaccaactgggcgatccgaaaaccactgcacaaggagactgtaagcggtaagattgtcttagatagaaaaatagggaaggacaaaatcctcacagccacccgcaaggaagtggatattactttcaccgagaaaatcatttcttccatcacagacacgggcatacagaagatcctgcttaattacctgaactataagggaagtcccgaagttgcttttagcgcagagggcttggaggaactcaataaaaacattgcccaatacaatgatgggaagaaacatcagcctatctataaggtgaggattttcgaggaaggatctaaatttccactgggtgagaccggcgctaaggccactaagttcgtcgaagcagcgaaagggacaaacctattctttggagtgtaccagggcaaggagaaacgttcctacgccaccatccccctgaatgaggttatagaacggcagaagcaaggtcttccgtcagtgcctgagagaaacgaaaaaggggagccactcctgttcagtttgagccccaatgacctggtatatgtccctatggaaggcgagattgctgagacaatcgactttaacaacttatcgaaggaacagaaagagaggatctacaagactgtgtccttcaccggaaatcagtgctttttcgtgcaggaagccgtcgcaacgcccattgttaacaagatggagtattctccactcaataaaatggaacgcgatatcctgggcacaatgataaaggaggtgtgtattaaacttaaggtagaccgactggggaacatcaccaaagcttga

SEQ ID NO: 3379 - RNA, 4353 nt, synthetic construct
  misc_feature 1..4353: note = Cas9 variant
  source 1..4353: mol_type = other RNA
atgaagcacatcctgggcctcgaccttgggagcaactccattggatgggccttcgtgcagcaagattttgagaataaacagggtaagataatcgctgcaggctctagaattatccccatggaccagaaaatgctgtcaaacttcgaagaggggaccacagtcagtcagactgccgaaaggacgacctaccggagcatgcgccgattgcgtgagagacatttactgaggcgggaacgcctacacagagttctccatattctgggatttcttcctccacactatgatgcgcaaatcgacttcacaaagaggtacggcaaatttatagataatgctgagccgaagatcgcctataacaatggtaacttcatttttatgaactccttcaatgagatgatcgaagactttaaggagcatcagccccagctgttctacaaaaagtctaatggggaagagtcgaaaattccttatgattggactatctactatttgcggaagaaagcactctcacagaagataacccaacaggagctggcctggctgattctccactttaaccagaagcgcggatactaccagttacgaggcgaagaggaaacagagaatccaaacaaagaagtggctttccacagcctgaaggtagtggacgtcgaggcagaggcccccaataaaaagggcgaaatctggtataccattagacttgagaacgggtggatctacaggcggactagcaaaatccctttggatgactggaagggaaaaacacgtgattttattgtgaccacggacctgaatgatgacggtactataaagctagacaaggaaggcaaagagaagcgctccttcagagctccagatgaaaacgactggaacctcctgaaaaagaaaaccgagcatgatatcgacttctctgggaagcccgttggaacatatatttacgatcaccttctgcaaaatcctaaccagaagatcaaaggcaagttggtgaggactatagagcggaaatattacaaggacgaactcaaagccattctggcgaagcagatcgcattacaaccagagctgtttaccgaaacactccttgccgattgcatccgagagctgtatcgcaagaatgaaacccagcagcagaacttgctaagcaaagacttcctgcatctctttgtcgaggatattatcttctaccaaagaccgctgaggtccaagaaatcaacgattgctaattgtactcttgagaagcggagttacatagacaaagaaacaaacgagcgcaaggatacccccatcaaggtgtgcagcaaatctaatccttattaccaggaatttagagtactgcagtggttgcagaacctcaggatttatgagatcgagactgaccgtgaagttacagccgagttcatcgaaaccgcacaagactacgaggctctgtttaatttcttaatgtcccagaaggaaattgataacgagtcactgctaaaatattttctcttcgccaagaatccacagataaaagacaagacggcgaaaatcgagctgaagaagtggattaccacataccggtggaactatgtgtacgatgtcgccgacaatagcagtaaaaagtaccccatgaacgaaactggttatgatcttcagcgatacatgcaaaaagtggaggggttgcctaccaattttctgacattcgacactacctatagactctggcatctgctttactctgtgaaggataaagtcgaatttgagaaggcactgaagaaattcgctaagaaaaagcagttggacaaaacatccttcgttgatagctttaagaacttcaagccatatcccaacgaatacggatcgttttctgagaaagccatcaagaaactcctgccgttaatgaggttcggcaatcactgggactttaaccgcattgatgtgtccacccagaagcggatcgacgatctgataaatggcgtagctaacgaggacatcagaactattatcagggaaaaagccgagaagtatcagctaaattcagaaacgtgtttccaagacctccctctgtggcttgcacagtacgtggtctacaaccgccacgccgaggctacagatattgaaaagtggaccagtgtgagcgacttggaggcgtatctggaggattttaaacagcactccctccgaaatcccatcgttgaacaagtggtcactgagaccctgcgggtggtacgtgacatatggcagcagtacgggggaggtcaggcaaacttctttgatgaaattcatatcgagttaggcagagagctgaagaaaacagccgaagagaggaagcaactttctgacaaaaatcaggaaaacgagaataccaacttgcgcattaagaaactcctggctgaactaaaggaggatgccagcatccagaatgttcggccatattcactggtgcagcaagagctcctgaagatatacgaagagggggtcttcagttccactgacgaaatcgaggaagatattcagaaaatcagaaagaaagtggagcctacaacgcccgagattcagaggtataaactttggttggaacagaaatacaagagcccatataccggagaggtcatctctctgactaagttatttacagaagagtacgaaatagagcacattatcccccaatcacgatactatgacgatagtctcagcaacaaagtgatctgcgagtccgcagttaataagctgaaaaccaaccagcttggcctggagttcattcagaaccatcacggtgaaaaggtgcgcatcacagccaataaagaagtaactatttttaccgaggagcaatacaaggagttcgtcaagaaacactatgctaacaattctgccaagcagcagaaattgctcctgaacgaaatacctgaaaagatggtggcacggcagctaaatgacacgagatacatctcgaaatatattagcgagatcctgtccaagattgttaggtcagatgaaaaggacgagggggtgaacagtaaaaatatcataccatgtaccggcaagatcacaactgcgctcaaacaagactggggactgaacgatgtctggaatgagcttattttgccgcgtttcgaacgcatgaaccagctgacccagacacagttatttacttcttacaatgaccggctccaaaagaacctgcccaccgtgcctatcgagtatagccagggcttccagaaaaagagaattgatcataggcaccatgctatggacgcccttgtaatcgcatgcgccacgcgagaacacataaattacatgaacaatcagcacgctctggataagtccaaagacaagaaagagaagcaacagtcacggattgatctacgcacaatcctctgtgaaaagaagaacaacaattggcagtttaaaaagccatggagaaccttcactcaggaggccaaggaggcactggaacatatcgtggttagctttaaacaaaacttgagggtcattaataaggctacaaactactatgagaaatgggaagagaagaatggggtgctggtgaaaaagaaggtcaaacaggaaggaaccaactgggccatacggaagcccttacacgaggagactttctctggtaaaatctccctcaatcgagaaaaggttggcaaagggaacattctgaccgcgacaagaaaggccgtggacagtagctttgatgtgaagaaaatctctaagattacggacaccggaatccagaaaatacttctgaattacttgaagtataaaggctcccctgaggtagctttctcagcagaaggtctcgaggagctgaacaagaatatcgcccaatacaacaatgggaagaaacatcagccaatttataaggtccgcatctacgaaaaaggcagtggaaggtttgtgctaggcgagaaggggactaaaagcaagaaatatgttcagggagctcccaacctgtacttcggtgtgtaccagggcaaggaaaagcgtacatatgccaccattccgcttaatgaggtcatcgaacggcaaaaacaggggctcccttcggtgccagagagaaacgagaagggagaacccctgttgttttccctgtctcctaatgatttagtttacgtgcccatggagggcgaagcaacagagactataaacttcaacaatctcaacaaagaacagaaggagaggatttataaaaccgtaagtttcacgggtaatcagtgctttttcgtccaagaggcggtggcctcaccaatcgtgaacaagatggaatacagtcctctgaataagatggagcgctccatcgtcgggattatgatcaaagaagtttgtataaaacttaaggtggaccgactgggcaacattacaaaggcttga

SEQ ID NO: 3380 - RNA, 4362 nt, synthetic construct
  misc_feature 1..4362: note = Cas9 variant
  source 1..4362: mol_type = other RNA
atgaagaccgtgctgggcctcgaccttgggacaaacagcatcggatgggccctgattcagcacgatttcgactccaaaaagggtgagatattgggcatggggtctagaatcattcccatgtcacaagatatcttaggagaatttggcaaaggtaatagtgtcagccagactgctgacaggacgaagttccggtccgcacgccgactgcgtgagagacatctactcaggcgggaacgcctgcacagagttcttaacattctggggtttttgcctaggcattacgccgcggatatcgacttcgagaaacggctcggacagtttttcgaaggcaaggagccaaagctggcttatgataataaccagtttatattcaccaaatcttttggcaagatgctggccgacttccgccaacaccagccggattttctcaaagacgagaagtcgaatgatttactgatcccctacgactggtcaatttattaccttcgaaaagaagcattgacaaagaagatcgagaaagaagaactggcctggattatcctaaacttcaatcagaagagagggtattaccagctcaggggagaggaagaggaagagaacctgaataaacttgtggaatttcatagcctgaagataattgatgtagtggctgacgagaaattgaacaataagggtgagacttggtatagtctcctgttagaaaacggctggacctaccggcgttcctctaaagtccctctgttcgactggaaggagaaggtgcgcgatttcatcgttacaaccgacattaatgatgacgggagcgtgaaaactgataaggaaggaaacgagaaaagatcctttagggcaccatcagacgatgactggacactccttaagaaaaagaccgaacaagatatcgacaagagtcggaaacccatcggcgcctacatttatgatgctatactgaagaatcctaaacagaagatcaacggtaaattggtccgaacggtggagcgcaagttctacaaggaggaactaaaactgattctccagaagcagaaagagtttcacccagaactgcaaagcactgacctttataacgagtgcatcagagaactgtacaagaataacgacgcccaccagttgcagctcaataaaaaggatttcgtacatctgtttttagaggacataattttctatcaaaggcccctgcggtctcagaagtcctcagttgggaactgtcctctagagtttcgcaaattcaaggatagcgaaggaatcgagaaagtggaatacctcaagaccatcccaaaaagtaatccgtattttcaggagttcagaatttggcagtggatgtacaacctgtctatctacaagaaagacgatgacgagaatgtcacaagggattttcttaagactattgaagactgggaggatttgttcgaatttctgaaccaccgtaaggacatagagcaagaaaccctcctgaaattccttctgggcaagaatggcgtgaaagggaaggcgttgaaagtggaggcaggaaagttccggtggaactatgtctccgataagatctacccctgcaatgagacaaaagccctcattatcagcaagctggaaaaagttaagggtgtggaggaaaaatttttaaccgaggaaatcgagtataagctgtggcatctaatttactcggtaacggacaaggtggagtatgaaaaagctctcaaggccttcgcaggcaaacagaagctggatcttgtctcttttgtggactccttcaaacgatttcctccattcaagaacgagtacggggcttattcagaaaaggccatcaaaaagatattgcccctgctcagaactggaaaaagttggaattggatggcgattgacagcaaggttagggatcgcatcaacaaaattatcacaggcgagtttgacgaagagataaagaataaagtgcgggagaaggccgaaaagcactccctgaaaaaggagaacgatttccagggtttacctctgtggcttgcacagtacgtcgtgtacgggagacactctgaagctagcttttcaggcaaatggaacagtgtagacgatttgaagaaatatctcgaggagttcaagcaacattccctgaggaatccaatcgttgaacaggtgctaaccgagactctgcgcgtcgtggccgacatttggcagttttacggaaagggcgaaaaagatttctttagcgagatccacattgaactcgggcgagagatgaagaacacagctgaggaccggaaagaaatgtctgccatcatacaggcaaatgagaccacgaacctgcgtattaaggcccttttgaatgaactgttacaagataaaaaggtcgagaacgtgagaccctattcaccgagtcagcaggaaatcctcaagatttacgaggacggagttctgagctccgatatcgagatacctgacgatatccagaaaatttctaaggctgcgcaacccaccaaatcggaacttcagaggtataagctgtggttggagcagaaataccgcagcccatatacaggtgcaatgatccctctcggcaagctgttcacttccgaatacgagattgaacatatcataccccaatcactatacttcgacgacagtttttctaataaggtgatttgtgagagcgccgtaaacaaactgaaggattcccggctcgggatggagttcatcaaagaatgccacggaatggtcgtggagaccggctttggtaagtcagttacagtgttcgaagaggagacttatagagactttgtcgtgcagaattacagcaaaaaccattctaagaagtccaaactgcttttggaagagatcccagaaaagatgattgagaggcagatgaatgatacccgatatatcagtaaattcattagctctgtactgtccaacatagtgcgcgaagaggttaatgacgatggggtcaactcaaagaatatcgtgcccggcaacggaaaaattacaacccagttaaagcaagactggggcctcaacgatatctggaatgagctgattcttcctcggtttgaaagactgaacgtgctaactgacagtaaacacttcacggcttggagcgagaatcaccagaggctcctgccaacagtcccgatcgggttgtcgaagggattttccaagaaacgtatagatcatcgccaccatgccctggacgcattagttatcgcctgtgcttctcggaaccacattaatttcctcaacaatgcccacgcaatcgataagaaaaagaacagcgaagagaaacagaagtttagacatgacctgaaggcgattctttgcgacaaaaagtactcagataaaagtgaaaagaattataggtggatcttcaaaaagccctgggacaacttcaccatagattccaagaatgctctggacaaaattatcgtgtcttttaagcagaacttgcgaatcattaataaagccactaaccggtacgagaagtgggtggatcgcgacggtataaaagtaaaggagtggcacaagcaagaaggcatcaattgggcaaccagaaaacctctccataaggatacagtcagcgggaaagtggacctgaagagggttaccgtgccagagggaaaaattctaactgccacacggaagtccctggatacgtcattcgaccttaaagtcatcgaaagcattaccgatactggcatccagaagatactcaagaactatctgacaagtaaatctaacaatcccgagttggctttttccagcgaaggtgtggaggacatgaacaagaatatccgaaaatacaacgatgggaagctgcaccagcctatttacaaagttagaatcttcgagttaggctcgaagtttccactcggacagttcggcaataagaaatttaagtatgtggaaaccgccaaagggacaaacctgttctttgcagtatacgaggacgaaaataagaaccgcaattatgagactattccccttaacgtcgtgatcgagaggcaaaaacagggactgtcatctgtgccgataaagagtgaaaagggccataaactcttgttctacctgtcccctaatgacattgtctatgttccaggtagcaacgaggaattttctatcgatcgtctataccggttcaccgacagctccgataagacggctaattttatccccctgtcagtgagtagccttattttctcttccaacaaaaatgagcagaagaaaatcgggatatcatatcctattcaagacgagttcggactcggcagtccccagagcaagaaccagaagtccatcgatggtattatgatcaaagagaagtgtgtaaaagtgaatatagacagactgggcagggtctctttttga

SEQ ID NO: 3381 - RNA, 4368 nt, synthetic construct
  misc_feature 1..4368: note = Cas9 variant
  source 1..4368: mol_type = other RNA
atggccaagatcctgggcctcgaccttgggaccaacagcattggatgggctgtggtcgaggatcagaataacaaaacaactctgatagacaagggtgttagaatcttctccgaaggcgtgaaaattgagaaggggatcgaaaaatctaaggcagccgagaggacggattttcggtcagcgcgcaagattaaattccgacgtagattgaggaagcaagaaaccttaaaagtactgatcgagaataacatgtgccccctaacaatagaggaatggactaagtggaaaaaggacaagaaagagtaccctaagaatccagattttatcaactggctcaaaaccgacgaactgaagaatattaacccgtatttctttcgggataaagctagtcgcacagagcttcccctgatgcagaccggcagagccttgtaccacctcgcacagaggcggggattcctgagcaatcgcctggaccagggttccgatgggtttactgagcaaatccgactcgacttaattaagaaaatcgaatgtgagacagataagaccgaactgcttacgtctgtgcagtcgataattgacacttattcagaggaagaggataaggacgccaaaaagttgctgaaaggagtcgagaagctatgcaaaatcaacaatgaactccctattaccgagttcaaggaaaagctgatcaactaccttaataaagctgacaacctgggcgcagtgaagaaaggcatcgccgatgttagcaagaaaattacagagactgggtgtgaaaccttgggacagtatttttacaagctctatcagaatcaaagtaagataagaaaagtgtacacagctaggaccgagcattactatcacgagttcctgaagatctgcgaaacgcagaacatttgtgaccagttaaaacataagctggataaagccatcttttaccagcggccactcaagtcccaaaagggtcttataggcaaatgcgtcttcgagaagaacaaaactcgttgtgcggtgtctcaccccgcatatgaagagtaccgcgccctgcagtttattaatagcatcaaggtatccgaaacaaaagacgggaagaaagatttcttgtcattcgacgagagaaagaagatctggcctaaatttattaggaagagtaaaccaaacttcgattttaaggagatcgctgaaaccctagacaaaaagggactgagccggtattacaattatactggccatacatctgtttccggttgccccaccattgcccagctcacgaacatattcggggagaattggcaagaaaccctgtttgagaagtacacaaacaaacagaatactaagggacttaaaaccatcgatgaggtggtcacagacatttggcacgtgctgttcacttttgataaggacgaaaagatcatcgagttcggcaaacagaagttgggcctcaacgaagtgctggctaaaaagtttggggcaattaatctgaaaaaggactacgcctcactgagcctaaaagcgataaacaagatcctcccttatctgcgagagggacttatttacagttatgccgtcttcttggcaaatatcgaaaacgttgtgggtgaggagatttggaagaatgatgaaaacaaaaatctgatcaagaaagagctccacttacttatagacaactttaacgaaatcaagggcctggaggctgtagtgaatgatttcattgccgactttaaaaaggaatacaacaatgctcataaagattatgtcttggacgagcaggataagaagatcctcctggagaaaattgaatctaactacgggaagaataaattcgagtccttagaaccagacaagaaaaccgagatcataaacagcacagaaaagatggtggccgagcaactgcgcaagcagagaggagagttcattaaaccgaagaggctagatgagaaaatctcggaatttctcattaataacttcaatgttaccaagaaatctatcgcacggctgtatcacccctccgacgtggaaatatttaagactgcctcacgcaacagtgagggccttttgctgctcggtagccctatcgtctcctctattaagaatccaatggctatgagagcgatgcatcagctgaggaaattagtgaacacgctgatcaaggagaatattatcgatgaagagacaaaaataaacattgaacttgcacgtgagttgaatgacgccaacaagcgggctgccatcaaaaagtggcaggatgaacgacaaaaggcaagagaggagtacaaaaagagcatcaaagaactcttcaaggccgagtgtgggaaagacattgaaccctcagacagtgagatcctgaagtacgaactatgggaggagcagcagcacatttgcatatataccggcaagactatcaacatttgtgattttatcggagctaatcctaacttcgacattgaacacaccatcccaaaatccctgtgctttgataatagcaacgagaatctcacactgtgcgacatacagtacaacagggatgtaaagcgcaataaaatccccaccgaactttctgactataactcaattaagccgcggttggataaatggctggttttcatcgacgattacgagaagttatataatactaggaaaaaggccaagggcattgaaacaaaagagcaaaaggacaaaagaatcaaggagaaacattactataagctccacctggattactggaaggggaaatacaagcgctttataatggtggacgtccctagtggattcaaaaacagccagattgtggatacgggtatcatcaccaagtatgcaatttcctacatgaaatctatatttcccaaggtctattcggtgaagggcaatatcgttgcggagttccgaaaaatttgggggcttcagaacgactacgaaaagaaagaacgggtgaatcatgtacaccattgtatcgacgctattactatcgcctgcatgagcaagcagaaatatgatacactggcaaagatataccacgaggacgaggccggatttcacaagatcaaaaaggaaacccaattggtctccaaaccatggacatcattcactatggatgtgctcaacattgagaaggaaatcttcgttagtcatcacacccctgacaatatgaaaaagcagtctaaaaaggtggtccgtgagagaggcattatcgctcccaaggtgatatatgaaacggatgccaacaacaataccctgagggacaaatacggtaagaaaattgtaaaggagtacatcctactgaaagatgtgaacgggaatctcatcccaattaagggcaagcgcctgacacccagcgacatcataaacaaagttgatggaattgactatttttcccttatcattaatgataagatccagtactatgagttcgcaaaatcaaagaaaactggcaagataatttacaagaaagaacctatctatttgcaaggggacaccgtccggggaagcctgcatttagacacattttacggtgctatcgccaaggatattaacggcaatatcattactaacaccaatgggaaaatagcgccaaactatgtgatcagaaaggagctctctaaactgaaggaaacggacattgagaatatcgtggatccggtcgttaggggaaagatcattgaagccaaaaagaacaaacttataacattcaataagtccggcgctgtgatcaaaaccactatttggatgaaggagaaccagatccccattaataaagtgcgagtatacagtagcctgaagaaccctctaccagactttaagaaacaccgcgatctctctcacctgacatacaagcagcagtataatgtctccaacgaggaaaactactgtttggcaatctatgagggtaaaaataagaaagggaacgtgtgccggacctgtgaactggttaatatgatagacgccggcaactactatagattatcaaataagaactggaagcaacagtaccccatcgtgcctgagaaagatagtgtcactaattatagcctcaagaccattatcacaaaaggactgatggtgcttctgtacgaaaagtcgccagaggagatttgggaattgacgtacaaccagcagatggagaggctctatgaaatcacccaactggacactgagaaatccgctgagataaagctactgttccatcaggaagcccgtgagaagaaagttattacagaatacatgggccttaagaccgggatgaaaggaggcaagaatatcggtaaacacaaggagtttccctggattaaggtggggccgaactctttcgatgcactcatcgaaggaatagactttaaactgacacctactggcaagatcattaaattgtga

SEQ ID NO: 3382 - RNA, 4374 nt, synthetic construct
  misc_feature 1..4374: note = Cas9 variant
  source 1..4374: mol_type = other RNA
atgaagaccatcctgggcctcgaccttgggacaaacagcattggatgggccaaagtgtccgtcgatgactacggtaattatctgcacgatataaagttgggctctagaatcattcccatgtcacaggacgttttagggaacttcgatagtggagtgactgtaagccaaacggctcagaggaccgagtttcggtccaaacgccgactggtgcagcgtaatctacagagaagggaacggctccatcgcgtcctgcacgtgcttgacttcctgcctgcacattacgatgccgcgatcggctgggacagaacagaggctgttacttatggtaagtttttgaaccacgccgaaccaaaactcgcatgggaggaactggggaatggaaagaggcggttcctgtttatggattctttccatgagatggtggccgactttgctcgctgccaaccggcactcgtcgccgatggcaagaaaattcccttagactggaccatctactatctgcgaaagaaagctcttacacaggccataaccaaggaggaattggcgtggatcctgctaaacttcaatcagaaaagaggctactatcagctcaggggagaggaagaggaggaaaaccctactaagcaagaggaatactacgagctgaaggtggtatcggttgaagcaacagattcacggaaagggaatgacacctggtataacgtgcaccttgagaatggttggatttaccgtcgcagcagtaagatctccctggacgattgggtcggcaaagtgaagcagtttattgtgacgactgagtatgaaaaagacggggccaccttgaagacagataaagagggatacgtcaagagatctttcagggctccaaacgaaaatgactggggcctccggaagaaacgaactgagaccctgttagaaatgagcggtaagacagttggggcctttatctatgatcatctgctccaggagcccgcagacaaaatacgcggaaacttcattagaaccatcgagaggcactactataaggctgaacttgaggccattctggcggaacagtgtaaataccacatcgagttgcgggataaggaaatgctagaggcctgcgcacgcgagctgtacctcaataacctgcctcatcaaagatcccttatgaagaaagacatgacgtatctgttgctctacgatctgatcttttatcagaggccattaaagagtaaaaaggctctgattgccaactgtccctacgaatattacgagtatgtggacaaagaaactggcgagataaagcgtcagaatatcaagtgcattgctaaatcaaacccttacttccaagagttccggctatggcagtttgtactcaatctgcgacttttcgatagagtggaagacaaggaggtcacagccaactacttgccaaccgcagacgatcacgccaggctgtttacttatctcaatgaccgcaaagaaatcaaccaggagacactgcttaaggattacttcaaactgaagaaggtgaaaataggcaatgaaaaggagtatccgattcggtggaactacatcgaggacaaagaaaagaaatatccctgtaatgagaccagatacgaattgctcatggctctggatagggcggggatcgagcacaagtggttagacgataacaatctggaatatcgcctatggcatctcctgtacagcgttgaggtgaaatctgagtccgaaacggcacttcgaaagttgaagaacgacgatgcctttgtcaattcattcctgaaagtgaagccttttaaaaaggagtacggagcttatagcgaaaaagccattaagcggctcctggcagtaatgcgtaagggtttcttatggaacgagcaggacatctgcgatgaaaccagaaaaaggattgagataatcattaagggcgacgttgatgagaaagtgaaggaacgcatggggcacgccgcttacagttttgaccgggtctctgacttccaaggactgccagagtggcttgcctgttatgtggtctacggcagacattccgaagcaatggatatccagcactgggacagccccgagaggttgatggcgtatatcaataactttaaacagtactcgctccgaaaccctattgtggagcagtgcatactggaaacactacgcactgttcatgatatctggaaggagaccggtcaaattgacgaaatccacgtggagctggggcgggaaatgaagtctacatccgaggagagagctaggcgtactcagaatgtactccgcaacgaaaataccaacctgcggattaaatcacttttgatcgagctgaagaatgatacagacatatgtaacgtccacccatatagtcccatgcagcaggaaatcttaagaatttacgaggaaggcgccctccaagagctgaatagggaggatgaagacttcgaggaaatcagcaaaatttcccagatgtctcagccgagcggaaaggagcttaaccgatacaaactgtggttggaacagaagtatcggtcaccttacaccggcaaggcaatcagtctcgccaaactgtttactcccgcttatcaaatagagcatgtgattccacagtcccgctacttcgatgacagcttcacgaataaggttatctgcgaggccgaagtgaacacactaaaatctaatctgctcgggtatgagtttattaagaaacacggaggtgaaatcatacattgtaccactctgggcgatgtcagaatcttctcagagagtgagtacaaggcatttgtgatggaccactatgctaacaataaaagcaagaaggataaacttttgatggaagacattcctcaggagttcctgtccaggcaaatgaacgactctcggtacatctcgaaggtagtgaaaaccttactcagcaatattgttcgaatggccgatgaatccgaggcgacatcaaagagtgtcatcgtgtgcaccgggggagtgactgacagactgaaaaaggattggggccttaacgacgtctggaactctatagtttacagccgctttgaaaggctgaatcgtctaacaggtacggaggccttcgggcactgggagaacaaggatggcaaacgggtgtttcagacctccatgcccctcgaactgcagagaggattcaggaagaaacgcattgaccatcgacaccatgctatggatgcattggtgatcgcctgcgcttcaagaaatatcgtaaactatctgaataacgagagcgccaataacccaaagaaacgggaagacttaaggcgccagctctgtgataagaatcgtgtcattagaaagccctgggagacttttacacaagacgcatacaacgcgctggaaaatgtggttgtgtctttcaaaaactatgtccgggtgatcaataaggccaccaacaggtacgagcactatgatgagaatggcaaaaagcgctttgttcagcagaaagggtccgaactttgggctattcgaaagcctatgcataaggagacatactatggacacgtgaacctgagacggaaagaattggtaactctccagaaggccctggacgacataccaagtatctgcgataaaaagctaagggactacattagcgcactggtcgagaaacacttcaacaagcgccaacttctcgctcattttaagtctaccgattactattggcagaaacagtacgtgaataaggtgtatgtctggacgttctccgacgatatcaaaccgctggttgccaccagaaagttgctggacacatcattcgatgcaaaaaggattggtactatcaccgacacaggcatacagaagatcttacggaactacctcgaagccaaagggggaaatgctactctggcgtttacccccgagggcattgccgagatgaaccaaaatatcagtaagtataacgatggtaagcctcaccagccaattcttaaagtgcgtatcacggaacccatgggggcaaagtaccgcgtaggccagacaggaaataaaatggctaagtatgtggaggcccaaagcggcaccaacctgtacttcgccatatacgaagactcggaggggaaacgatcctatactacagtccctttggatgaggtggctgaaagactcaagcagaggctgtctccagttcccgagaaggacgaaaatgatgtgccgctaaaattttacctgagccctaacgaccttgtctatgtgccaaccgaggaggaactccagctgcgggagtgtaagttgaataaagaccgcatttacaagatggtttcaagtactggaaacgaatgccatttcatcccctattacgtggcaaatgtcatctataacaaaggcggttttaatatgcagatgcacagacctcaatcctga

SEQ ID NO: 3383 - RNA, 4374 nt, synthetic construct
  misc_feature 1..4374: note = Cas9 variant
  source 1..4374: mol_type = other RNA
atggccaagatcctgggcctcgaccttgggaccaacagcattggatgggctatagtggagaaaaataactccgatttcacactgatcgacaagggtgtcagaatattttctgaaggcgttaaaactgagaaggggatcgaaaggtcacgggcagccgagcgcacgggataccgaagtgcgcgtaaaattaagtatagaaggaagttgcggaaatacgaaaccttaaaggtgctgagcaaaaatcgcatgtgccccctacagatcgaggatgtagaggcttggaagaaatccggcttcaaggactatcctctcataccagaatttctgcaatggcttagaacaaacgatcacgagaatgtgaacccgtacttctttagggacaaggcctctcgggcaaaagtctcgctgtgggaattgggtcgcgccttctatcatatcgctcagcgaagagggtttctctcaaataggctggatcagagcagtgagggagtgctggaggaacacaacccccagattcaatccctcatcgaggacttagaagagacttctaccattctgaatgaagttcgggattactatatcaaccttggcttgctggacggcgtgaagggggatttcaaaaaggagctagacgagggagagaaaaagctcaaaagcctgtacaatacacttatagcaattatcaagaagaacgaaaatgatgtccagaaatgtaaggacgaaattatcaaacgtctgaacaagaaagaggacttgggtaaggtgaagggcaaaatcaaggatatttcccaggccatgctcgacgggaattttaaaaccctgggacagtacttctattcattatacaacaagggcaaaatacgcaaccaatataccagtagagaggaacattacctgcaggagtttatcacaatttgcaaggtacagggtatcaatgggataaacgatgaagagattctccctgaaaagaaattcaccggacttgctaaggacctgtataaagccatctttttccagaggccattaaagagccaaaaaggcctaatcggcaagtgttctttcgagaagaataaatcccggtgcgcgatttcacaccccgattttgaagagtaccgaatgtggaactatctgaatacgatcaagttcgggactcagagcgacaaaaagctccgctttctgacccaggaggaaaaacttaagctgattcctaaattctacagaaagaacgattttaatttcgaggttttggcaaaggaactcatagacaaaggagccacatttggtttctacaagagttctaggaaaaacgagtttctgtattggttcaattacaagccaactgataccgtgtccgcttgtcaatttagcgcctcgttgaaaaacgcaatcggcgaggactggcagacaaaggtcttcacctataagacgctgaactctgagaaaaaggaagtgattcggactgtggattaccgcgacctatggcatctcctgtccgcttcaacaagtgacatctatctttacgaatatgccaaagagaagttggggctggaagataaaagcgcgaagaccttttccaagatcaaactcaagaaagacttcgcctctctgagcctttcagcaattaataagatactgccctacatcaaagagggattgctctacagtcacgctgtcttcatggccaatattgagaaggttgtggatgaacacatctggaaggacgtaaaagagagaactattatccagaacgaaatatccaagatcattaaaagcgatgtgtttgagagggaagtcatcaatattatcaacggcctgataaagaactctaaaacagagggtgagaattatgctgaagagtcaaagaacattttcaaaaccgaatttgacaatgccatcgcaaagattttcgagaagaacaatgatatcgaatttaaccagcctttcttagacgatacgtacctgaaatatgtggaggagctaaagaaatttgacaaggcccgtagtttcctcccagttccgcggctggatgaaaaagtgatacaatttcttttggggaataacaaggacggcatggtctactgcagcgataagaataaaaccaagaaactgtatcatccctccgacatcgagattttcaagaaaaagatcattaaggacgaatttggaaacgagaaaatggtgctcggctctcctctgacaacttcgatcaagaatccaatggctatgcgagcgttacaccagctgagaaaagtacttaacaccttgatactcgaggaacagattgatgagaatacaaggatccatatcgaaatggcacgcgagctgaacgacgccaataagcggaaagggattcaggattaccaaaacgaaaacaagaagttcagagaggacgctatcaaagagattaagaaactatattttgaagagtgtaagaaagaagttgagcccactgaagaggatgtgctgaggtaccagctctggatagagcaggacaagaaggaaatctacgagcagggaaaaagcattcgcatctccgatattatcggttcaaatcctgcctatgacatagaacacaccgtcccacgaagtatctctcaaaacaatagcctgatgaacaagacactttgcactccccggttcaatcgtgagattaaaaagcagaaaatgccgatcgaattgtccaactacgaggagattctgcctagaatcgaacactggaagaaagaggcagaagatttaactaggcagatagagtcaattagcaagtctatcaagtccgccagtacgaaagaggctaaggacaaaaatatccgccggagacattatctcacactgaagagggattaccttaaaggcaagtatgaccgattcatttgggaggaacccaaggtggggtttaaaaacagccagataccagataccggaatcattactaagtacgcccaagcatatctgaaatcttacttcaagcgcgtcgaatccgtgaaaggcggtatggttgcggagtttcggaagcagtgggggatccaggaatcatacattgacgagaatggcttcaagcactataaagagaaggacagaagtaaacatacccaccatacaatcgatgctataaccatcgcctgtatgactaaggacaaatacgatgtgttggcacaagcctggacaagcgaagacgagcaggataagcagaaggctaaaacgctcatgtcggaagccaagccttggaaaacctttaaggaggacattgagaaaatcgaagaggaaattctggtatcccacttcactctagataacgtcaagaaacagtctaagaagatcgtgagggttcgtggcaaaaagcaatatgtggcagagatagaacgcgacgtcaatggaaaagctatggccaagaaagatgcgaacgggaagattatctacaagctgaatgagaaaggagaaaagatcccccggctccagcagggtgacacaattagaggcagcctgcaccaggattcaatctatggggccattaaaaacccacttaatcaagaggagattaagtacgtgatcaggaaagacttggaaagtctgaaggctaacgacgtagataacattgtggacgagaccgttaagcagaaagtcaaggaagcaatcgagaataaaatattactcctgtcctctaacgcccagcagaagaataaacttgtggatgacgtgtggctgaacaaggagaagcaagtccccattaaaaaggttcgaatctatgctaatagcgtgaaaaaccctctagaaatcaaggagcagtccctcctgtcaaaaagccggaaggaacataaacagaaggtgtacggacaaaatgatgagaactacgccatggcaatttatgaattggacggcaagcgcgagtttgagctgatcaataacttcaatttagcgaaactcattaagcagaaagaaggtttttacccactgaacaaggagaaagaagtaaaggggaagaaagtcctttatccgatagccaagagtaattacagagatgtggttctgaaaaggggccaacaggtggtcttctatgacaaggaggtggaaaaccccaaagatatctctgaggttattgactttaagggacggatctacatcattgagggcttgtccatacagcgaatcgtgagacctagcgggaagattgatgaatatggagtaatcatgctcaaatacttcaaggaggctcgcaaagccgacgaaattaagaaagataattacaagccagacggcgtcttcaagctgggtgagaacaggcccacacgtaaaatgaatcactcgcagtttactgcattcgtggaagggatcgactttaaggtgctacctaccggaaaattcgataagatatga

SEQ ID NO: 3384 - RNA, 4377 nt, synthetic construct
  misc_feature 1..4377: note = Cas9 variant
  source 1..4377: mol_type = other RNA
atgaccaagacaatcctgggcctcgaccttgggactaacagcattggatgggccctgataaatcaggatttcgacaacaaaaagggtgagatcttgggcatggggtccagaattatccccatgacgcaagatattaaagacgaatttggaaagggcaattctatctcacagaccgctgagaggacacggttacgcggtgtgcgacgtctgatacacagaactctactcaggcgggaacgcctgcatagagtccttaacatcattgggttcctgcctgagcactacgcaaatcagatcgattttgaaaagaggttcggaaagtttaagccagagagtgagccgaaaattagcttcgacggcaacgatgtgtttttgttcgaaaagtcctatcaggagatgctcgttgactttaaaatccatcaaccccagctggtatctaatggcaagaaaatacctcacgattggaccatttactatctgcggaagaaggccctctcgaaaaagatcgaaaaagaggagttagcgtggattctgcttaacttcaatcagaagcgcgggtactatcagttgcgaggagaagaggaagaggaaacaccaaacaaactggtggagtttcattcactaaagatcgtcgaggtgaatgctgacgaaccccaaaaaggtaagcctgagatctggtacagcctcgttctggaaaacggctgggtgtatagaagggccagtaagaccccacttttcgattggaaagacaagattcgggagtttatagtcactacagaaatcaataacgatgggaccgtgaaaacggacaaggagggaactgagaaacgttccttccgcgcacccaagcctgaagactggaccctgcagaagaaaaagacagagttcgaattgtctaaaagcggcaatgaggtaggtgcctttatttacgaatccatcctccagaagccaaaccagaaaataagagggaagctgatttcaactatcgagaggaagttctacaaagaggaattaaagaccatcctgaaaacacaactctttttccacaaggagcttaaagatgaaaagctgtataacgcttgcattgaggagttgtacaagaataacgaagcacaccggagtctactgagcaataaaggatttgagcatctcttcatcaacgacattctgttttatcagcgaccgcttcgctctaagaaatcccagatatcaaattgtcccctggaaaagagaacctacaaaaaggagggcatcgaaattacggagggcatcaaagttatcagcaagagtaaccctatttatcaagagttcaggttgtggcagtggatatctaatctctccctgtactgcatcgaaccaactgagacaaacgtgaccagcacatttttaaattcgattgaagattatgagaacctgttcgaatttctaaataaccggaaggagatcgagcagaaacacctcctgaagtaccttttggaaaatcaggggttcaaaggaaagctgctcactaacgagctggaaaaatttcgctggaatttcgtcgccgacaagaagtacccctgtaacgagaccggttctcttctgcatacgagattgtccaaagtgaagaacatttcacctgatttcctcaccaaagaaatcgagcaccaactgtggcacataatctatagtgtgacagacaagattgagtacgaacaggctttaaaaacttttgccaggaagaataacctggatgtcgacagcttctttgagcatttcaagaaaatcccaccctttgaatccacctatggcgcgtactctgagaaggcaattaaaaagctactcccgctgatccgtcttgggaaatattggaattgggaggccatagatagcatttcaaaggaccggatcagtaagattttgtccggagaatacgatgagaacatcaaaaatcgagttagagaaaaggctgtgcacctgacaagcgagaacaatttccagggcctccaggaatggctggccaaatatatagtatacgacaggcattctgagggtaacgacttagggaagtggacttcagtgagtgatctggagacctaccttaaagaatttaagcaacacagcttgcgcaatcctatcgtcgaacaggtgattacagaaaccctccgggttgtgaaagacatctggattaagcatggcaagggaactgagaacttctttgatgaaatccacgtcgagctgggcagagagatgaaaaataactccgaagacaggaagcgcctaacgaatacaataaccgagaacgaaaatactaacctgcgaattaaagcactcctgatggagatgatgaacgataatgacgtggaaaacgtacggccctattctccatcgcagcaggagatccttaagatctacgaggatggggctttgaatagcaacattgaactggacgatgagatcgttaaaatttccaagaaggccgaacctaccaaatcagagttacaacgttataagctctggctggagcagaaatacagaagtccctatacaggacaggtgataccacttaataagctgttcacctctgaatacgagatcgaacacgtcgtgccccagagcaggtttttcgacgattccttttcaaacaaagtcatttgcgagagcgcggtgaataagcgcaaggacaaccaattgggtctccagttcatcaaaaatcattctggcgaaaaggttgagctggggttcggaaaagtggtacaggtctttactgaggaacaatatctagatttcgtgaaggagcactactccaaaaaccggagtaagcataataagctgctcctggaagagattcctgagaaaatgatcgagagacagcttaacgacacaaggtacataagcaagtttgtttcttccatcttgtcaaatattgtgcgaagtgagaaagacgatgacggcctgaacagcaagaatatcttaccaggtaacgggaaaattacgaccgaactcaagcgcgattggggcctgaacgacgtctggaatgatcttatcctgccgcggttcgagagaatgaacactataacaaattcggacctatttaccacatataacgataagtaccagaaacacctccccactgtgcctttcgaatattccaagggatttcagaaaaagaggattgaccaccgtcatcacgccatggatgcactggtaatcgcttgtgccacccgcgaccatttgaatctgatgaacaatcaatctgctaaaagcgagttaaagcggtacgatctccagaacaaactgagaaagaaggaaccatatttcaatcagaaagagaacaagcagaaagaggcctttaaggacttcatcaaaccctggggcacgtttaccgaagattcaaagaatgcacttgagaagattataatcagtttcaaacaaaacctgagggtgattaataaggccacaaactcctacgaatcttataaagacgaggacgggaatttgcgaatcggaaaggatggtaaacctgagaagggcctcattaagcagaaagggctgaactgggctatccggaagccactacacaaagacactgttagcggacagataaatctgtcccgcatcaaacttcccaacggcaaaattctcaccgcgacaagaaagaacctggatacttcattcgacttgaagaccatcgaaaatagcattacggatacaggtatccagaaaatactgaagaactacttactcagtaaagagtctccggaactggcattttcccctgaggggcttgaagagatgaataacgagattgaaaagtacaataacggcaaattccatcacccaatcaataaggccaggatctatgagctgggaagcaaatttaacgtcggccaaaccgggaatcggcgagacaagttcgtggaagctgccaagggaactaacttgtttttcgcaatttaccaggatgagaataaaaacagatcgtatgaaacaatccccctcaatgaggtgatagagcaccagaagtggcgcgcctcactgcctaaagaggagcaagaaaagattcccctagtcccagttaacaaactgaagggcacctttatcttctctcttagtcctaatgacctcgtgtacgtgccctccaacgatgagctggaaaggagcgcttctattgactttagcaagttgaaaaaggagcagatcaaccgtttatataaaatggtatcctcaagtggtagccagtgcttctttgtcaagtctgaggtggccacttccgttgtgaataaaatggaatactcaagtctgaacaagatggaaaagagcatagataatctcatggtcaaagaaatttgtatcaagctgaaaatcgaccggcttgggaacatttccaaggcatga

SEQ ID NO: 3385 - RNA, 4377 nt, synthetic construct
  misc_feature 1..4377: note = Cas9 variant
  source 1..4377: mol_type = other RNA
atgaagaaaatcctgggcctcgaccttgggaccaacagcattggatgggccctgatagagcaggatttcgaatccaaggctggtaaaatctctggcgcagggtcaagaattatccccatgagtcaagacattttgggaacatttgagactggccagagctactcccagacggccgataggacccactatcggtctatccgccgattataccagcgtacaaagctgagaagggaacggctacatcgctcgctcaatgtgctgggtttccttcctgagcactataaaaacgaaatagactttgagcaaagaaaggggcagttctacccaaataaggagccgaaaatcgcgtattaccccgaacaggtcgcttcaaaggttaaatatcagtttctgttcaagagcagctttttggagatggtggaagatttcaaaaggcggggatacaacggcgccattccttacgactggactatctattacctccgcaagaaggcactggagaaaaagattgagaaagaggaactggcctggctcttactgaattttaaccaaaagcgaggctattaccagcttagaggggaagaggaagataccaattccaacaaaaaggaggagttctatgaattgaaagtatctagcgtggagcagacacatgacacctccccatcaggaacttggtacaatgtccatctgcagaacggttgggtgtataggcggaagagtaaggatagcctaaaagactgggaaggcctcaataagaaatttatcgttacaacccacctgaacgctgatgggtctgagaaacttgacaaagatggaaatgtgtcccgttcattccgcgcacccaaggaagacgactggggcctggtcaagaaaagaacggagagcgtgttggagaagagtggtctccacgtaggggaatttatatacgagtctctgttagaaaaccctgagcaaaagattaggggatccctgatcaagactattgaacggaaatactataagaaggagctcgaggccatccttgataaacagaccagcttccaccgagaactgcgcaatgacgctttgtacaaggaggccacactagaactgtatcccaaaaactcggcgcatagatctaacatcaagcagaggggcttcaaatacctctttattgaggatataatcttctatcaacggccactgaagtcccagaagcaccttattgcacattgccagtacgagaaacgcacttataagaataacggcggggaaaccatcgaggtttcactgcagggagcccctaaaagtcacccaagttttcaagagttcagaatatggcagtttatttccaatttgaggttctacgacaaggaagaaatcgtggagggtcaggaggtctctatcacagaaaaactcttaaagagcgattcagactttgctgagctgtaccactggctgagtcatcagcgtgaagtggatcaaaacaaaaccctaaagtatttcacgcagaagaaactcattccgaagcagaaaaaggacaatcccactatccggtggaactttcctgaggataaaaagtacgaaatgggcgagttcaaggcccagctgctttcccgattggagaaagtgagaaattgtcaaccagacaagtttctgacacagaaaaacgaactcgatctgtggcacattatatatagcgtcaccgacaagactgagttcgaaaaagcacttgttacatttgctgagaagagggaactggactctgagtcattcgtggagaatttcaagaaatttccccctttcaagaacgattacgccagttatagcttgaaagcgatcaagaaaattctcccactgatgcgccgggggaagtactggaaggccgaaaatttaggaccccagaccctgcagagaatcgagaaaatcgtaaacggcgaagcagacgataagatttccataagggctcgcaaactagccctccatctgaatgacacgaagtcttttcaaggtcttccgacctcgttggcttgctatgtggcctacaaccgacacagcgagaatgaggaaaaccagaaatggcagacaccttccgatatcgacaagtacctgaaagatttcaagcaacattcactccggaaccccattgtcgagcagctgatcactgaagcattacgtgtggttagagacatttggaagcactatgggcagggccagaaagactttttcgatgagatccacgtggaactgggaagggagatgaagaatccagccataaaacgcaagaaacttagtcaaaagatccaggagaacgaaaataccaactaccggattaaggaggtcttgagaaatctcaaagaaaacaatatcgatgctaagccttattctcccagccatcaggagattctgaaaatctacgaagagggcgtgtatcagtccatagagaacgtagaagacgagattgaaaagatcaggaaaaataacacaccatcaagcaaggatattaatcgataccgcctatggctggagcaagggtatatctctccctacactggagaagttatacctctctcccagctgtttagtaaccagtacgagatcgagcacattatcccacggagcagattctttgacgactctcttgcgaataaggtgatttgtgaatcctcagtcaacgcattgaaagataataagaccgccctggagttcatcacaaaccatggtaacgaaaaagtggagtttgctggcaagaccgtcgagatattaagtagcgacaaatatactgaacactgcaagaggtacttcaagcgtaatcgcacgaaactcaagaacctgctttcgtatgatgtgccggaggggtttattaatcggcagctgaacgactccagattcatctctaaatacgttaggaatttgctcagcaacatcgtgcgagaagaggaggaacgggaggccatttcaaagcacatcctgacaattcccggaagtataacctcccaactaaaacaggattggggcctgaatgaaaagtggaacgaggtagtcactcatcgcttcgaaagactcaataacctgaccggtacaaccgactttgggttctgggataataagatcaacgcatttaggattactgtgcctaaagagctttctaagggcttcaataaaaagcggatcgaccaccgacatcacacattggatgccctggttattgctgcctgtacgaaagaccatgtgaactatatcaccagcttaaatactgaaagaaacaaccactccctcgtctcaaagctgcgcaataccaaaaaggtgcttataaacggaaaggagaggcgtatcgcaaaagcgtacaagctgccatggagcagttttcccctagatgctaaacaccagctcgagacaacagtaatttctttcaagcaaaatctgcgggtgatcaacaaatccagcaataagacttggcagtggagaaacgttaatggcgaacagaagaaaaagttgattcctcagaccaaaggggactcgtgggccatcaggaagtcaatgcataaagcaacggtctctgccaaggtggagagtgtgggaaagggtaaaataaagaccacaaaccgcactccactgggcgaaattaaaggggagaagcacgtcgagaaaatctatgatgctcgaatcagagaagttattatacccaatcatttaaacaagtacctcgacgagaagggaaaaccgaattacgaagccgcattttcccaaagcggcatcaagcagctgaacgagaatattgaagtgcttaacgagggtaaacctcacgctccaatctataaggtgcccctgttcgaggtagggtctaaatttcctgtcagcgaagacgccaagtcccccaaaaatcagaagtacgtggaggcggataagggcaccaacttgttctttgccgtttattggaatgaagagaaacagaagcggaacttcgaaacagtgccactccatcaagtcattgtgcaccagaaacaggttgcttcactgcctactgagcagaggaccagtgtgcccatcaagccagagctaggactgttcctttttagcctctctccgaacgacctggtatacgtccctacggaagaggaaatagagaatccccacttggtggatctgaaaaacttatccaaggaccaaacaaatcgcatctataagatggtgtcaagtaccggcaacgaatgccatttcattccacaccatatcagccgtctcattatgaaatacaatgcaaagcagaaagtcggggagtttggatccctgaacaaggccgagaaagctatcactggcgaaacaataaaggagaagtgtcttaaaattcagatcaattctctgggtaagttgaaaaccgaaagaatcgcctga

SEQ ID NO: 3386 - RNA, 4380 nt, synthetic construct
  misc_feature 1..4380: note = Cas9 variant
  source 1..4380: mol_type = other RNA
atgaagttcaacctgggcctcgacatcgggaccaatagcattggatgggcccttgtgaacgaggattacgaaaataaaaagggtaaaataatcgctgcaggctccagaattatccccatgacacaggacattctggataagtttgggtctggagccatcactgagacgcaaaccgcgttgaggacagactatcggtcaaaacgcaagttaatacagcgattcctgctacgtagagaaaggctccaccgggtcctgaacgttcttgattttctgcctaagcattacgctgagagtatcgacttcgaaaaatattttggcaagttcttgccaaatactgagccgaaactcgcctacaaccagaatcagtttattttccaaaacagctttctggagatgctgaaggaatttcaggagaaacaccccgaactcttaaccaataacaagaagatcccttatgattggacaatttactatctgcgcaaaaaggcacttaatcagagaatcgagaaagaggaattggcctggctgctactccagtttaaccaaaagaggggttacaatcagctgcgggacgaggaagaggaatccgtgccaaacaaacaggtagagttctactctcttaagataattgatgtggtcgctgaccagcccaaagaggggcgcgataagcgatggtattcgatcaatctggaaaacggatggacctacagaagggagtcaaagactcctttgtttaactgggaaggcaaaacaaaggacttcattgtgaccacggatctcaatcaagacggcagcatcaaaaaggacaaagaggggaaggaaaagcggagtttccgtgcaccatccgagggagattggactctgctgaaaaagaaaaccgagaaggaaatctatgagtctggtaaaacattaggcacttacatttatgacgccctccttaacacccccgatctgaagataaagggggactttatccgcacaattgatagaagcatctacaaagaagagttgcagcagataattaataagcaaaaagaatatcatctagagctgaactcctcaaagctctacaaggcttgcctggaggaactttaccctaaaaatgagatctataagagtgccctgaaaaacaaggacatcgcgtacttgttcattaatgatatcctctattaccagaggccactgaaagcaccgaagtataacattggaaaatgtacctacgaaagccggacgtttaagaaagaggacaagaagatacgagagtatatccccgccgttgctaaatctcaccctttattccaggaatttcgcctgtggcagtggattaagaatctaaaaatctacgagaagctctcctcagataactgcactgacttctttctgacaaatgaacaagatttcgagaacctttttgagttcttgtggaataaaaaggaaatcgaccataagggcattctggagtacctcgtgaaaaccaagtttccagacctgaaacccaagcaggtcaaaactaaggtgaaggaatatagatggaactacgtatatgatcacgagaaagacgaaagcaagacatacccttgtggtgagacctatttccttctgaaaaataagttggataaaatatacaacgcccaggacgattttctcgacaaggaaaggctgtataacttatggcacatcatttacagtgttacggataagaaacagtacgagaaggcactggctaaattcgccctaaagaatcatctcgacaccaaatctttcgtgaacacatttaagcggatcccacccttcaaaaatgattatgcgatttactccctgaaggccatcaagaaacttttgccgctgatgcgcgtcgggaagtattggaactacgacgatatagaccctatcactaaacaaaagattcagtgcatcattaccggagaggaaaatgatacaatcagcactctcgtgagagagaaaaccaaccacttttcgaatgaaaacgacttcaagaatctgcccttatggctggcaggctatatagtgtacaactctcataatgagtcctcagaaattgagaagtggaaaagtccacaggacatcgatacatttcttaagaaattcaagcagcacgctttgaggaaccctattgtcgagcaagttgtgaccgaaactctccgtgtagtgcgggacatctggagcaaaaagggccaggggaagaaagatttcttcaatgagatacacatcgaactgggaaaggacctaaagaaccccgtcgataaacgaagaaaactgtcctctacgaatacaaagaacgagagcaccaacactaggattaaggccctcctgatcgagctttttacccagggtgtggaaaatgttaaaccaaactcacccaagcatcaggagattttgaaaatcttcgaagagggcgctctgaatagtgggatagaaattgaggaggacatcatcaagatttccaacacagatcaacctaccaaaaagcagttagaactctatatcctgtggcttgagcacaagtacaaaagcccatacactggacagtctattccgctgtcaaagttgtttacacccaattatgaaatagagcatatcattcctcgcagtaaatactatgacgataacctcagcaataaggtgatctgtgaaacggagattaaccggctgaaaaataaccaactaggctacgagttcatcaataaccacgaaataagagaggtcaccctggaagagggtaagactatcaggctcctgtccccagaacagtattggaattttgtgacaacctactatgccaaaaacaaggcaaagcgcgagaatcttttgctgaaagagttacccgtacagatggttgaaaagcagctcaacgacacacgatacgtgtctaaatacgtcatgcaactgctttcgaagattgtgcggaaagaggatgggactgacaacggcatcaatagcaccaacattctgtccatctcaggaaagatgacgcgtgccctaaagaatgattgggacctcaacgacgtctggaatgatctgttgctgtatagattcgaaaggttaaacaccataacaaaaactaatctcttcaccacatacagtgagcagaagcagaaacgcatgcctattgtgccagaccagtatgctaagggctttcataaaaagcggctggatcacagacaccatgcgcttgacgcaatcgttatcgcctgcattactaggaaccacataaattacatgaacaatcaaaacatccagggggagaagctgaaaaagaatgctattgaaaaagagaactatcgagaaatcttgcagaagtctcgcctcgatattcgggcccagctgtgtgagaaaaagtacaatgacaacgatcccaccaagtataattgggtgttcatcaaaccgtgggcagactttacggaaaacacaaaggatatactagagagcatcattccttccttcaaacaaaacctgagaatcattaataagaccgtaaactactacgagaaatataatgaaaacggaaagaaagtcaaggtgaggcagatcaagggtgacaattgggccatacgtaaaccacttcataaggagactatttcaggcaaagttcacctcagctacaagacacccgctaaagggaagatcctgaccgccactcgcaaggtgttggattcttccatggactttaaaagtatcgaaaagattaccgacacaggaatccagaaaatactgaagaactatttagagtacaaaaagagccctgaactcgcattctctcccgagggcattgaggaactgaatgcgacgatcaccaagtataacaatggttttcaccataaaccaatttacaaggtccggatctatgaggaaggggtgaaattccctcttggcaacaagggaaataaaaagtccaagtacgtagaggctgaaaaaggcactaacctgtttttcgccatatacaaggatcaagagaataacagatattttgagacaattcccttcaatgacgtgttggaaaccctcaaaaaggggatgtcagcagttccagagaaaaaccaggaagagaacacactggtcttcgccctaagtccgcaggatctggtgtttgtgcctactcttgacgagatcgaaaatcccgatatcgtcgacttcaagaacctcaccaaagatcagacgaataggatttacaagatggttagctcgtccggaaagcaatgctttttcatcaaagctgaggtggccacatctattgtgaacaagatggaatttagcacctcaaataaaatggagaacagtatagaaggtatccagattaagtccaattgttggaaactgaagttggaccgattaggcactatcacccgggtaatcaagtga

SEQ ID NO: 3387 - RNA, 4383 nt, synthetic construct
  misc_feature 1..4383: note = Cas9 variant
  source 1..4383: mol_type = other RNA
atgaccaagttcaacctgggcctcgacatcgggacaaatagcattggatgggcccttgtgaacgaggattgcgaaaataaaaagggtaaaatactggctgcaggctccagaatcattcccatgactcaggacatcttggataagtttgggtctggagccgcgacggagacccaaacagctttaaggactgactaccggtcaaaacgcaagctgattcagcgattcctactccgtagagaaaggctgcaccgggtccttaacgttctggactttttgcctaagcattatgccgagagtatcgatttcgaaaaatacctcggcaagtttctgccaaataccgagccgaaactggtgtataaccagaatcagttcatatttcaaaacagcttctttgagatgctcaaggagttccaggaaaaacaccccgaattatttctgaataaccagaagatcccttacgattggacaatttattaccttcgcaagaaagcattgtcccagaagatcgagaaagaggaactggcctggctactcctgcaattcaatcagaagagaggttataaccagcttagggacgaggaagaggaaaataccccagataaactggtagagttttactctttgaagattatcaaagtgactgctgacgaggcaaaggaagggataaacaagcggtggtactcgattaatctcgagaacggatggatctatcgccgagaatcaaaaacacccctgttcaactgggagggcaagaccaaaaatttcattgtcacgactgatttaaaccaggacggcagcatcaagaaagataaggaagggaaggagaaaagaagttttagggccccttccgagggagactggaccctgctcaagaaaaagacagaaaaagagatctacgaatctggtaagactcttggcacctatatttacgacgctctgttgaataacccagatctaaagataaaaggggccctgatcaagacaattgaccggagcatctataaagaggaactccaacagataattaataagcagaaagagtaccattccgagctgaacaattcaaaactttataaggcgtgtctggaagagttgtaccccaaaaacgaaatctacaagaatgagctcaaaaacaaggatatcgcatatctgttcattaatgacatcttatactatcaacgtcctctgaaagccccaaagtacaacattggaaaatgcagttatgagagccgcacctttaagaaggaagataaaaagataacggagttcatcccggctgtggccaaatctcaccccctatttcaggagttcagactctggcagtggattaagaatctgaaaatctacgaaaaacttactaacgacaattatacagactttttcttgaccaacgaaagggatatcgagaagctgtttgatttcctctggaacaaaaaggagattgaccataaaggcatactggaataccttatcaagactaaatttcctgatctgaagccaaagcaggttaaatccaaggtgaaagagtaccggtggaattatatttacgaccacgaaaaggacgagtcaaagaactatccctgtggtgaaacatacttcttgctcaagaataagctggataaaatcaccagcattcaagacgactttttaaacaagaaacgactggagaatctatggcacatcatatatagtgtcacggataagaaacagtacgagaaggcactcgctaaattcgccctgaagaaccagcttgataccaagtctttcgtgaatacatttaaacgcatccctgcgttcaagaacgactatgccatttactccttgaaagcaatcaagaaactgctcccactgatgagagtagggaagtactggaattatgatgacattgatcccatcactaagcagaaaatacaatgcattatcaccggagaagagaacgacacaattagcactttagttagggaaaagaccaatcatttttcgaacgagaatgatttcaaaaacctgtctctttggttggctggctacatcgtgtataattcccacaacgaatcaagtgagatagagaagtggaaaagcccgcaggacatcgatacatttctcaagaagttcaaacagcatgccctgcggaaccctattgtcgaacaggtggtgaccgagactctacgcgtcgttagagacatctggctgaagaaaggccaagggaagaaagactttttcaatgaaattcacatcgagctcggaaaggatctgaagaaccccgtggacaaaaggcgtaagatatcctctacgaatagcaaaaacgagacaaccaatattcggatcaaggctcttttgaaagaactgttaaaggagggtatcgaaaacattaagccaaattcacctaaacagcaggagatcctcaagatttttgaagagggcatactgaacagtgggatcgatattgaggaagagatcattaaaatctcccagatagcccaacccactaagaaacagcttcagtactatcgaaattggctggaacaaaagtacatcagcccatataccggacagttcattcccttgtctaaactctttacatcaaagtacgagatcgaacacattatccctagaagtaagtactatgacgatagcctgtccaacaaagtaatatgtgagaccgagattaataggctaaagaacaatcagctgggctacgagttcatcaacaatcatgaaatccgcgaaattactctcgaggaaggtaaaacaatacggctgctttctccaaagcagtatttggactttgtgacgacctactatgggaaaaacaaggcaaagagagagaacctgttactcaaagagatcccgattcaaatgatcgaaaatcagctgaacgatactaggtacgtctcgaagtatgtgatgcagcttctgagcaaaattgttcgcaaggaggacggcacagataatggaaccaactccatcaatatactatcagtgagtggcaaaatcacacgagtcctcaagactgactgggggctgaacgatgtgtggaatgacttgctgtgctaccggttcgaacgtttaaacaagattaccaatacgaacctcttcaccacatactctgagcagaaacaaaagatcattcccatcgtacctgatcagtatgccaaaggatttcacaagaaaaagctggaccatagacaccatgctcttgacgcgatactgattgcatgtatcactaggaatcacatcaactacatgaataaccagaatattcagggtgagaagttgaaaaacttcaagatcgataaacacaattatcatgaaatatttcaaaagagccgcctcgacatgcgggcccagctgtgcgagaaaaagtacaacgatcacgactccaccaaatatacatgggttttcactaagccatgggctgattttaccgaaaacattaaggacacgctagagttcatcattccctcatttaaacagaatctgagaatcataaacaagacagtgaattactatgaaaaatacaacgagaatggcaagaaagtcaaggtgaggcaaaccaagggggataactgggccattcgaaaacctcttcataaggagactatcagcggaaaagtccacctcctgtacaagacaccagcaaaaggcaagatcttgaccgccactcgcaaggtgctggactcttccatggatttcaaaagtattgaaaagatcaccgacacaggtattcagaaaatattaaagaattatctcaaatacaaggagagccccgaactggctttttctccggaggggatcgaggaacttaacattacgatcgccaagtataatgatggcttctaccacaaacctatctataaggttcggatttacgaggaaggagtgaaatttccactgggcaacagagggaataagaaaaacaagtatgtagaggcagaaaaaggaaccaatttgttcttcgcgatatacaaggaccaggagaacaataggtactttgaaactatccccttcaacgacgtcctcgagacactgaagaaaggtatgtccgctgtgcctgagaagaaccaggaaaagaataccctagtttttgccctgtcaccccaagatcttgtgttcgtcccaacactcgacgagattgaaaaccctgatatcgtggactttcgtaatctgactaaggatcagaccaaccgcatttataaaatggtaagtagctcgggcaagcagtgtttctttatcaaggcagaggtggccacgtccatagttaataaaatggagttcacaacctctaacaagatggaaaatagcatcgaggggattcagatcaaatcaaactgctggaagttgaaattagaccggctgggaactattaccagagtcatcaagtga

SEQ ID NO: 3388 - RNA, 4389 nt, synthetic construct
  misc_feature 1..4389: note = Cas9 variant
  source 1..4389: mol_type = other RNA
atgaccaagaacatcctgggcctcgaccttgggacaaatagcattggatgggccctgataaaacagaacttcgagaataagcaaggtgaaatcttgggcatggggtccagaattatccccatgtctcaggatattttaggagactttggcaaaggtaactcagtgagtcagactgctgagaggacgaagtaccggagcgtccgccgactgcgtgaaagattcctactcaggcgggagcgcctgcacagagttcttaatctgttgaactttctccctcagcattatgcatcccaaatcgatttcgagaaaaggtttgggaagttcaaggtggagaccgagccaaaactggcctggaagaatatagacggacagttttctttcctgtttcagacatcgttcaacgaaatgctcgaggattttcgggtaaatggccaggacgtgaaaatcccgtacgattggactatttattacttacgcaagaaagcgctgtcaaagaagatcgaaaaagaggagcttgcttggattttgctgaacttcaatcaaaagcgaggctattaccagctaagaggggaagaggaagaggaaaaccccaataaactcgtcgagttttatagcctgaaggtggttgacgtggtcgccgatgagcctcagaaaggaaagttcgacatctggtacagtcttatactggaaaacggttgggtgtacaggcggtcctctaaaattccattgttcgattggaaggacaagacccgtgattttatcgtaacaaccgacctcaatgacgatggcagcattaaaaaggacaaagatgggaacgagaagcgctccttcagagcaccctcagaaaacgactggactctggttaaaaagaagacagagcaggaaatcgagcaaagtaggaaaaccgtgggaacgtatatctacgaggccttactggataatcctaagcagaaaattaagggcaaactcgtccggactatagaacgaaagttttataaggaggaacttcgccagatcctggagaaacaaaaggagttccaccaggagttgcagagcgacgatctatacaacgactgcgtgagagagctgtataggaataacgaagctcatcagctcaccctgtctaaaaaggattttgtgcaccttctgatggacgatttgattttctaccaacggccactccgctcccagaaatcaagcgtcagtaattgtacactggagtttagaaagtataaggacgaaaacggtgcagagcatactcagtacttaaaagccatccccaagtctaatccttactatcaggagttcaggctgtggcaatggatatacaacctaaatatttatcgtcgggaagacgagcagaacccaatcaccggggaatttctctccacaaccaaagagttcgaaaatctgtttgagttccttaacacgcgaaaggaggttgatcagaaggctttgctgaagcactttaaactcaatgacaagactcacagatggaacttcgtggaagataagaaatacccgtgcaatgagacaaagaccatgatcagctcgaggctggaaaaagtagagaacatttctgacgatttccttactcgcgaaatcgagcagaagatttggcatataatctattccgtgaacgacaaaattgagtacgaaaaggccctgaagtcatttgcgaaaaagcaccatttggatgagagtagcttctttgaagcattccggaaatttccccctttcaagtccgagtatggatcttttagcgaaaaagccgtcaagaagctcctgccattaatgagactgggcaaatactggaattacgctgacatcgataagtcaagtaaagagaggatccaaaagattatatccggcgagtatgacgaaaacatcaaagatcgcgtgcgagaaaagagcgttcacctaacaaccgaaaatgacttccaggggctccagctgtggcttgcccagtacattgtgtatggacggcactctgaggcatcaatgatcggtaagtggaacagtgctgatgacttggaggaatttctgaaaaatttcaagcaacatagcctccgtaaccccattgtcgaacaggtgatcacggaaaccctgagagtagttaaagacatatggttaaagtacggcaatggggccaaagactttttcaacgagatccacattgaactgggaagggagatgaaacttcctgcgaaagagcgcgaagatttgacacggaagatcactgagaatgaaaacaccaatctcagaattaaggccctgctagcagagatgatgaacgattcctctgtggaaaatgtcaggccattttcgcccatgcagcaagagatcctgaaaatatatgaggacggcgtgctcaacagcggtattgaaatcgaggatgaatacctgaagatttccaaaacagctcagccgtcacctagtgaccttaagcgatataaattgtggctggagcagaagtacaagtctccctacactgggcagatcataccattaaataaactcttcacccctgaatatgagatcgagcatattatcccccaaagccgctacttcgatgactccttttcaaacaagattatctgtgaaagcgccgtcaacaaactgaaggataattatataggccttggattcattaaacagtttggcgggacaatcatcgagctgggattcggtaagtctgtgaaggtttttgaaaccgaggagtacgaagacttcgtgaaaaagcactatgctaacaatcggtccaaaagaaacaagttgctcctggaggatattccagagaaaatgatcgaaaggcagattaatgacactcgtcatataagtaagtacatcagcggcgtactatctaacattgtccgcatcgatgacgaccaggccaagaaaattatcgaagatgcagagatactggcccggaaggagatcgacaaagataaggctaatgaaattagaaggaaagcgaagtccctcgcaacggacgatgggatcaactcaaagaatattgtgcccggaaacggcaaaatcacaacccaactgaagcaggactggggtcttaatgatgtttggaacgacttgatactgcctcgatttgagcggatgaatcagttaactaacagtaaagatttcaccgtgtggaatgaaaaccaccagaagtatctcccaacagtcccgattgagtttagcaaagggttctcgaagaaacgcatcgaccacagacatcacgccctggatgctcttgtgatcgcctgcgcaaccaaggaccatgtaaacctgctaaataaccaatccgccaagtctgacactaaaaggtacgatctcaagaaaaagctgatgaaatttgaaaaggtggtttaccaccacacacagacgggcaataagattgagcgggagatacccaaacagttcttgaagccttgggaaaacttcacctttgacgctaaatataatctggagagcatcattgtctcattcaagcaaaacttacgagtgatcaataaagccactaactactatgaaaagtacgtggagaaggatggaaccaaaaataagggcagagtcgaacagacagggacaaactgggcaattcgcaaaccaatgcataaggacactgttagtggaaaagtgaatctcccctgggtgaaggtacctaagggtaaaatcctgaccgcgacgaggaagatacttgatacctcctttgacctgaaatctatcggcagcattacagatactgggatccagaagattttgcgtaactatctcgagttcaaaggatccccagagctggctttttcacccgaaggcatcgaggacctaaataagaacatagaaaaatacaatgatggtaagccgcaccagcctattaacaaggtccgggtgttcgagctggggagcaaatttcaagttggccagaccggaaataagaaagacaagtatgtggaggccgcaaaaggcacaaaccttttctttgccgtctacgaagataagaacgggaagagaagttacgagactatcccactcaatgaagtgatcgagaggcagaaacagggactgtctgttgtggacttgaagggcaccaacgatttctatctgtgtcccaatgacttagtatacattccttccgacgatgaactcgagaacatcaataacatagactttaaaaatattgctaaggagaaaaacgaacgcatctataaggtcgtgagcttctcgggttcacaaatctttttcgtgcgacaggatattgccacgtctatagtcaataaggcagagctgagtacacttaacaaaatggaaagagctatggacgggtccatgattaaggagagctgcgttaaactgaatgtggatcggttgggaaacatctctaaggcctga

SEQ ID NO: 3389 - RNA, 4401 nt, synthetic construct
  misc_feature 1..4401: note = Cas9 variant
  source 1..4401: mol_type = other RNA
atgaccaagaacatcctgggcctcgaccttgggacaaatagcattggatgggccctgataaaacaggatttcgaaaacaagcaaggtgaaatcttgggcatggggtccagaattatccccatgtctcaggacgtgttaggagagtttggcaaaggtaattcagtcagtcagactgctgcaaggacggattaccgcggggttcggcgactgcgtaagagattcctactcaggcgggaacgcctgcacagagtgcttaacgtactgaactttttgcctgtgcattatgccagccagattgacttcgagaaaaggtttggaaagttcaaggaagataccgagccaaaactcgcgtacaataaggagggctttatcttcaaaaattcctttgaagagatggtcgctgacttccggaagcaccaaccgcagctgctggaaaacgataaaaagataccctatgactggacaatctactatctccgcaagaaagccttatctaagaaaattgagaaggaggaactggcatggatccttttgaattttaaccagaaacgaggctactatcagctgagaggggaggaagaggaagagaatcctaacaagctagtggagttctactcgctcaaaattactgatgttctggccgacgaaccacaaaagggaaagtcagatatctggtacagccttatactggagaatggttggatttataggcggagttccaaaacccccttgtttgactggaaggagaaaacacgtgatttcatcgtgaccactgacctcaacgacgatggctctattaagacagacaaagatgggaatgaaaagcgcagcttcagagctccttccgaaaacgactggaccctggtcaagaaaaagacggagcaggagatcgataaatcacagaagactgtgggaacctacatctatgaaacattactgcagaacccaaaacaaaagattaagggcaaactcgtatgcactatagagaggaagttttacaaagaggaacttaagcagatcctggaaaaacagaaggagttccatcaagagttgcagaatgacgatctatatagtgactgtgttcacgaactgtaccggaccaacgaggcacatcagctcacactgagcaagaaagaaattgtgaatctttttatggaggatctgatcttctatcagcgacccttgcgctctcaaaagacctccatatcaaactgcacgctcgagtttagaaaatacaaggacgaaaatggtgtcgagcacactcagttcctgaaagccattcctaagagcaacccatactatcaggaatttaggatctggcagtggatcttcaatttaaacatttacaaacgggatgacgacagtaatgtgacaaaggagtttctgaacaccactgaagatttcgagaatctatttgagttcctcaacaatcgcaaggaagtggagcaaaaagctctgcttaagcactttaaattgaacgaaaagctgcatagatggaatttcgtcgaggacaaaaagtatccgtgtaacgaaacaaagaccatgatctctacgaggctcgataaagttgagaacatttccaaggacttctttacccgtgagatagaacagaaaatctggcacattatctacagcgtgaatgataagatcgagtatgaaaaagccctgaagtcgttcgcgattaagcataaccttgacgagaatagctttttcgaagcatttaaaaagtttccccctttcaaatccgagtacgggtcattcagtgagaaggccatcaaaaagctgttgccactcatgcggctgggaaagtattggaacgaagatgagatattaaaatacagcgacgattactttaagaatattgaatccctgctaggcgtactcaaacagcgagacgagaacatctctgatgctgacagagagaattataacaagacaattaataacaaactgagggccgaacttgagaatttccagaacgcagaaatcgagagctttcaaggcttgcgcctgcacatagctcagtacatcctctatgggaagcactcagaaggagataataaaaagttcaacagtgccgacgacctggagaagtttttaaaagagttcaagcagcattccctgcggaatcccattgtggaacaggtcatcactgagacccttagagtggttaaagatatttggacaaagtacggtaacggcgcgaaagacttctttgatgaaatccacatagagttggggagggacatgaagaagactcgcgatgaacgagccgacgcaaccaaaattatcacagagaacgagaataccaacctccggattaaggctctgctagccgaaatgatgaatgatgtggagatggaaaacgtccgtccttatagcccaatgcaacaggagatcctgaaaatatacgaagacggaatcctcaagtctgatattgagatcgaggacgatattctgaaaatctcaaagactgctcagcccagtagctccgaccttaagagatataaattgtggctggaacaaaagtacaaatctccgtacacgggccagataattcctttaaataaactcttcacacccgagtatgaaatcgagcatatcattccacagtcgaggtactttgatgacagcttctccaacaagatcatttgcgagtcagccgtgaataagctgaaggacaactatataggtcttgggtttatcaaacagttcggcggaaccattgtagaatgtggctttgggaagaatgttaaagtgttcgaggcagaagagtacgaagattttgtcaagaaacactatgccaacaatcgcggaaagcggaacaagctgttgctcgaggagatccctgagaaaatgattgaaagacaaatgaatgacactaggcatatcagtaagtacatatctggtgtgctgagcaacatcgtccgagtggaagatggctccgacgagggggttaatagcaaaaacattgtgcccggaaacggcaagatcaccacacagctaaaacaggattggggtctgaatgacgtatggaacgaactcattctgccacgcttcgagcggatgaatcagcttaccaactcaactgattttacagcttggaatgagaaccaccaaaagttcttgcccacggtccctatcgagttctctaaagggttttccaagaagagaatagaccacaggcatcacgcgctggatgcattaattatcgcctgcgctaccaaagaccatgtgaatctcctgaacaatcagagtgccaagagcgatactaaacgttatgaccttaagaaaaagctgatgaagttcgaaaaagttgtgtacaaccacccacagacaggcgaccgcatcgaacgggaggtcccgaagcagtttctaaaaccctgggataatttcacctttgaagcaaagaacaatctcgacaaaattatagtgtctttcaagcaaaacctgagagtaatcaataaggccacaaactactatgagaaatttgtggagaaggatggagttaaaactaaggaaagggtcgagcagaaaggcaccaattgggctattcgaaagtccttgcacgaagagacggtgtcagggaagatcgacctgccttgggtggagaccaacaacggagagttcattacagccactcggaaaagtttagatgcatcttttaatctcgaaaagatcaaaaagataaccgacacaggtatccagaaaattctgcgcaactaccttaaggcgaaagatgacaatgctgaactggccttctcgccagagggcatcgaagatttgaacaagaatattgagaagtataacgacgggaaatcccatcaacccatcgtcagagttagggtgtacgagaagggaaaaggccggtttgcactcggtcagactgggaataacatagataagtatgtgcagggctctcctaatctgttctttgccatttacaaagacgaaaacggcaaaaagagctatgagtcaatccgactagatatcgtaattgaaagaatgaagcagggactgcaagctgtcccagagaccaatcccaacgggatcagtctttaccagaatctctccccgctggacttggtgtacatacctacggaagacgagattgagtctccacacctgatcgatttcacaattttaaacaagacccgcctcgaaaggatctataatgttaacgacttcagcggatacactatatatttttcccagaactcattcgccaaaaatatttaccccaaggagatggatatgacatggaacgagaaaaagcagaagcctagcggcagttttgactctaaaaccgcatcctataataagaaaagcatcaaggatatcttcattaaactgaagatcgaccgtcttggtaacatttcgaaggtgtcaaatactctgtga

SEQ ID NO: 3390 - RNA, 4401 nt, synthetic construct
  misc_feature 1..4401: note = Cas9 variant
  source 1..4401: mol_type = other RNA
atgaagaacatcctgggcctcgaccttgggaccaatagcattggatgggccctggtgaaagaggatttcgaaaacaagcagggtgagatattgggcttagggtccagaatcattcccatgtctcaagacatcctgggagaatttggcaggggtaattcaattagtcagacagctgatcggactgggtaccgcggagtccgacgtctaagagagaggcacctcctgcggcgcgaaagacttcatagggttctgaacatcttgggcttcctccctaatcactatgcaaaagagatagactttacgaagcggctgggcaaattcatcaaccatgccgagccaaagctgagctttgataaggagttcatttttaaagactccttcaatgaaatgctcaaggattttcagcagaaccaaccggggttcatcattaataaacacggagaagaggcgttagtgccctacgactggaccatctattacctgcgcaagaaagctcttacacagaagatagataaggaggaattggcctggattctgctaaactttaatcagaaacgaggttattaccagctcagaggcgaggaagaggaagagaacactaataagctggtagagttctattctcttaaaatcattgacgtgatcgcagataacgaagtcaataagaaaggggaggtgtggtactcgctgcatttggaaaacggatggatctacaggcggtcaagcaagattagtctcgttgactggaaagataaggtgcgtgactttatagtcaccacagacgtgaacgatgacggctccgagaagctggataaagacggtgtagttaagcgctctttcagagcccctagcgctgatgactggaccttactgaaaaagaaaactgaacaagatatcgacaattccaacaagacagtgggggcatatatttacgagaatctccttctgaacccaaagcagaaaatcaagggaaaattggtcaggaccatagagcggaagttctataaagatgaactaaagcagattctggagaagcagaaagaatttcaccaagagctccagaatgaacagctgcttcaagactgcgtgcgagagctgtacaagtataacgagcagcaccagcagatgttggaatcaaaagatttcgtgcatctctttctgaatgacatcatcttctaccaacgccccttaagaagtcaaaagagcctgatttctaactgtacgctagagaaaagggtctcccgggacggcgttgtgtttcctatcaaggtaatttcaaagagcaatccatattaccaggagttccgcctcctgcagtggcttcaaaacttggccatatacagaaaagatgacgatgtgaatgtcactcaggaatttctgaacagtatcgagtcttgggaaaatctcctgcagttccttaacgctaagaaagagattaagcaggaacaactgatcaaatttttgctcgagcagaagggcctgaaaggaaattccttaaagaccgccatcctgacatataggtggaactacgtgactgacaaggtttatcccatgaacgaaacccgtagcctaattcaggataaactcaagaaagtggagaatgtcgcgacagacttcctgtcgtttgataacgagatggcactttggcacataatctactctgtgaatgacaagattgaatatgagaaagccttggctaagttcgcctccaagcataacctggatgaaatctcatttgtagagagtttcaaaaagttccctccatttaaaagcgactacgggtccttctctgaaaaggcaattaaaaagctcctgccgttaatgcggtttggtagcgtttggaataagaacaatatcgtgccctcagtcctggatcgaatagacaaaatccttaccggcgagtatgatgagaagattaaaatcagagtgagggaaaaggctgagcagttccaattgaaccagattgaagactttcagaatctccctctgtggctagcccaatacgtcgtgtacgaccgccacagtgaggcggaaatcgccgggaaatggaactccgttaaggatctggagaattatctcaaggagttcaaacagcacagcctgcggaacccaatagtggaacagattatcacggagactcttagagtagtcaaggacatttggcagcaatacggaaatggcgtgcagaactttttcgatgaaatccatatagagttgggtagggagatgaaaaatacagcagacgaacgcaagcgaatcaccaactctgttactgagaacgaaaatacaaacctgcggattaaggctttactcgtggagctgaaagaagataccaatatcgagaacgtccgtccccactcacctatgcagcaggagattcttaaaatctatgaagagggggtgctgaatgccgtagaaaacatagacgaggatattttgaagatcagtaagacggctcaaccaagcaaatccgaactcatcagatacaagctgtggctagagcagaaatatcagtctccctacaccggcgagatgattccgctgtcgaggctctttacaagcgactatgaaatcgagcatgtgattcctcagtcccgctacttcgatgactcactgagtaataaggttatatgcgaagccgcagtcaacaaacggaaggataatcaacttggattggagtttatcaagaaccaccattctgagaaaattgaactgggcaatgggagaactgcccaggtgttagaggtggaagcgtacgagagcttcgtcaagaaaaactatgacaagaataggggaaaacgaaacaagctcctgcttgaagatgttcccgagaagatgatcgagcgccagctgaatgacacccggtacatttccaaatttgtgacacacctactctcaaacatcgtgagaaaggacgaagtaaacagcaaagatgacggtataaattctaagaacatcattccaggcaatgggaaaatcacttcccaactgaagcaggattggggattgaacgacgtctggaatgagctgattttacctaggttcgaacgtatgaacaatctcaccaacagtacagatttcaccagcactaatacgaacggcaagatcatacccacagtgccactggagtattctaaaggtttttccaagaaacgcattgaccaccggcatcacgctcttgatgcactggttatcgccttggctaccagagaccatgtgaatctcctgaacaatgaatcagccctacccaagaaagataggactaaggaggagcagaagagtttccgatttgacctgcaggtcaaccttcggaataaagaaaagtacttcaacgtgaaagaggggcgcgaaaaggagaaatttaccacattcaagaaaccttggaataccctcactcaagatacaagagacgcactggaaaacatggttgtgagctttaagcagaacttgagggtaatcaataaggccacgaactattacgagtcgtataccgacgagaatggcaacctgcggttagataaatacggaaatccaaagaaagaactcatttcccagaagggcactaactgggctatacgaaaatctctgcacaaggagacagtcagcgggcagatccaccttgacagagtgaaggtgaccaaaggaaagattgtcacagccactcgcaaatcactggatagttccttcaatgaaaagtctatcgagagcattaccgacacgggtatccagaaaatattgaggaactacctcaaggcaaaggataataaaccggacgttgcgttttcccccgaaggcatcgaggagctgaacaagtcaattagcgtgtataatgaagggaaaaaccatcagcctatcattaaggtacgtatcttcgagcagggaagtaaatttccagtgggcgaaaccggtaataagatagctaagttcgtcgaggccgcaaaagggacaaacctattctttggcatttaccaggataagactggaaaacggtcttatgacaccatccccctgaatcttgtgatcgagagactcaagcaaggcctgtcccctgttccagaaacaaacgagaaagggcaccagttgttattccatctgagccccaacgatctcgtgtacgtcccgactattgacgataatgaacagctggactcgaacagggtgtataagtttaccgattcatctgacacgacatgtaatttcatccctagtaacatatccgccattatctttaatattaacagcaaagagcaggaaaagcgcggaatcaattacccaatacaaaacgagcttggcgttggttctccccagagcaagaatcagaaatccttcgacgggtttatgattaaggaggtgtgcatcaaactgaaggtcgatcgattgggaaacatctcaaaaacctga

SEQ ID NO: 3391 - RNA, 4416 nt, synthetic construct
  misc_feature 1..4416: note = Cas9 variant
  source 1..4416: mol_type = other RNA
atgtgcaagtacttctatatcaaaaactttattaccttcgtgctgagcaagtccataatccccatgaaacacattctcggccttgacctggggtctaattcaatcggatgggcctttgtccagcaagatttcgagaacaagcagggtaaaattatcgctacaggcagtagaataatccctatggaccaggggattttgggagattttgaaaggggcaatactgttagccagacggcagagcggaccacataccgctccactcgacgtttaagagaaaggcatctgctacggcgcgagagactccacagggtgctgcatatccttggtttcctgccaccgcactatgacgcccaaattgattttaccaagcggtacgggaagttcatcgacaacgcggaacccaaaatagcttataataacggaaattttattttcatgaactcttttaatgagatgatcgaggatttcaagaaacatcagcctcagttgttttacaagaaatcgaacggcgaagagtcaaagattccatatgactggacaatctactacctccgcaagaaagccctgagccagaagatcacccaacaggaactggcatggctcattttacacttcaatcagaaacgaggctattaccagctgagaggggaggaggaaactgagaaccccaataaggaagtagccttccacagtcttaaagtggtcgatgtggaggctgaagcacctaacaagaaaggagagatatggtatacaatcaggttggagaatggttggatttaccggcgtacctccaagatcccactggacgattggaagggcaaaacgcgcgactttatagttactaccgatctaaacgacgacgggacaattaaggtggataaagaaggaaaggagaaaagatctttcagggcccccgacgaaaacgattggaatctcctgaagaagaaaactgagcatgacatcgattttagcggcaagaccgtcggtgcttatatctacgaccaccttctgcaaaaccctaatcagaaaattaaggggaaattggtgcggacaatcgaacgaaagtattacaaggatgagctcaaagccattctggcgaagcagatagcattacaaccagagctgttcaccgaaacgctccttgccgactgtatccgcgagctgtacaggaaaaacgaaactcagcagcagaatttgctatccaaggattttctgcatctcttcgtagaggacattatcttttatcaaagaccgctgcggagcaaaaagagtacaatcgctaactgcacccttgaaaagcgcagctacattgataaagagactaatgagagaaaggacgcccccataaaagtttgtgcaaagtctaacccttattaccaggaatttagggtgctgcagtggttgcagaatctccgtatctatgagattgaaacagaccgggaggtcaccgctgagtttatcgaaacgccacaagattgcgaggccctgttcaactttttaatgtcccagaaagaaattgacaataagggactgctaaaatacttcctctttgcgaagaacccccagatcaaggataaagccgcaaagtcagagctgaaaaagtggcttaccacatatcgatggaattacgtgtacgacgctgccgataacagcagtaaaaagtatcctatgaatgaaactggctacgagttgcagagatatctgcaaaaggtggagggcctcccagctaacttcctgaccttcgacataacataccagctttggcacctgttgtattctgtcaaagataaggttgaatttgagaaagccctcaagaaattcgcaaagaagaaacagctggacaagacttcctttgtggatagcttcaaaaactttaagccctacccgaatgaatatgggtcgttctctgagaaagccatcaagaagttactgcctctaatgaggtttggaaaccactgggacttcaatcgcattgatgtatccacccagaaacggatcgacgatctcattaacggtgtggctaatgaagacatcagaacaataattagggagaaggcggagaaataccaactgaactcagaaacctgttttcaggaccttcccttgtggctggcacagtacgtcgtgtataatcgccatgccgaggctactgatatcgaaaagtggacgagtgttagcgacctcgaggcctacctggaagatttcaaacaacactccttacgaaacccaattgtggagcaggtcgtgacagagaccctgcgggtagttcgtgacatctggcagcagtatggcgggggacaagcaaatttcttcgatgaaatacatatcgagcttggcagagaattgaagaaaactgccgaggagaggaagcagctctctgacaagaaccaggaaaatgagagcaccaacctgcgcattaaaaagctactggctgaactcaaagaggatgcctcaatccagaatgtgcggccttacagtctggtccaacaggaacttttgaagatttatgaggagggtgtgttttccgcaacagacgaagtcgaggaagatatccagaaaataagaaagaaggcggagcccagcaaagctgacctgcagaggtacaagttatggctcgaacaaaaatataagtctccatacaccggggaggtgatttcactgactaaacttttcacagaggaatacgagatcgaacacatcattccccagagtcgatattacgatgacagcctgtccaacaaggttatctgcgagtctgccgtgaataagttgaaaacgaaccagctcggcctggagttcattcaaaaccatcacggagagaaggtacgcataaccgcaaataaagaggtcactatctttacagaagaacagtataaggagttcgtgaaaaagcactacgccaacaattcggctaagcagcagaaactactgctcaacgaaattcctgagaagatggttgcccggcaactgaatgataccagatatatcagcaaatacatttccgaaatcctttcaaagatagtgaggagtgacgagaaagacgaaggcgtcaactctaagaatatcattccatgtacagggaagatcactaccgcattgaaacaggattggggactgaacgacgtgtggaataagttaattctcccgcgttttgagcgcatgaaccagctgacgcagacccaacttttcacaagctataatgatcggctgcagaaaaacctacccactgtacctatcgaatactcccagggttttcagaagaaaagaatagaccataggcaccatgctatggatgccctcgtgattgcgtgcgccacccgagagcacatcaattacatgaacaatcaacacgctctggacaagtcaaaagataagaaggagaaacagcagagccggatcgacttgcgcacaattctgtgtgaaaagaaaaacaacaattggcagttcaagaaaccatggtctacttttacccaagaggcaaaggaagccttagagcatatagttgtctccttcaagcagaacctcagagtgatcaataaagctacgaactattacgaaaagtgggaggagaaaaatggcgtgctggtcaagaaaaaggttaagcaggaagggacaaactgggccattaggaaaccccttcacaaggagaccgtgagtggaaaaatcgtgctggatcggaagattggcaaagacaagatcttgactgcaacacgaaaggcggtagatataacctttactgagaaaatcattagctctatcaccgacacaggtattcaaaagatcctcctgaattatctaaaatacaaggggtcccctgaagtcgccttctcaacggaaggcctggaggagcttaacaaaaatatagctcagtataacaatggaaagaaacatcagccaatttacaaggtgagaatctttgaagagggcagtaagttccccctcggggaaaccggagccaaagcaactaagtatgttgaggctgccaaaggtacaaacctgttctttggcgtgtaccaggggaagggaaaacgcacctacgcaacaatcccgttgaatgaggtcattgaaaggcaaaagcagggcctgcctagcgtgccagagcgtaacgaaaagggtgagcccttactcttctcgctgtcccctaatgaccttgtttatgtgcccatggaaggggagatcgccgagactatagattttaacaatctgtctaaagaacagaaggagcggatttacaaaaccgtatcattcacgggcaaccagtgctttttcgtccaagaagctgtggcgacaccaatcgtgaacaagatggagtattcacctttgaataaaatggaaagagacattctcggaaccatgatcaaggaggtctgtataaagctgaaagttgataggctaggcaacattactaaggcctga

SEQ ID NO: 3392 - RNA, 4416 nt, synthetic construct
  misc_feature 1..4416: note = Cas9 variant
  source 1..4416: mol_type = other RNA
atgggctacaaggcccccagaaacgacaaaggggagatcgattatggagtgggtctggacctcggcaatgggagcgtcggatgggttgctatggataaggactaccaccttattagggcacggggccatgaactgataggtgcccgcttgttcgatcctgcgaactccgctgagaatcgacgtgaatctagaaccacaaggcggcgcttatcaagaaggcggtggcgcctgcgaatgctagacagtctctttgccagcgagctggcaaaaatcgatccaaacttccttgccagaaggaagtattcctgggtgcacccgaaagacgaacagaatcatgagaactggtacgggtctattatctttggatcgaaggagcaagataagcagttctataaagactaccccactatttatcatctgcggaagaaattgacggaagataccgagcgtcacgacatccgcgaaatatacgtagctatccaccacattgtgaagtacagaggccattttctcagggagggcgagatcaattcagaaaacctgttcgatcctgaggggtttgtcgaactgattaaagacgtgatcaagctcaataacagctatgacgagagtacaccaatattcgaagcatcccccgccgatgtttctgaggctttactgaatgagcacactagccggtccggacgaattgaagacacccttgataagttggacttttcagtgagtcgcgtcgataaacatgagctgaagggtatgagagacgccgcgaaagcagtgatcggcgccattgtagggaacacagctgatttcagcaagatctttaatctagacaacctcgataaagactctaaggataatctgaaacttaagttcgccgactccaactttgacgaaaagtacggaggcgttgtgggttcagggctgttggatgagacccagatcgaactcgtcgacaggattcacgcagtgtatgatgctgtggccctgaaaggaatattaggcgacgcgcacactatcagcgaggccaaggtcgagagttacgaaaaacatcggaagaactggaaactgattaaggaggaactccgcacaaaggagaataaagatgaagttgacctttggtatggcgatctgtctgggagacagtacaagaaccctccagaccccgagaaaggacctgatgagggttccaagaaagacagcccaatcagggattcggaccaaaagcagaatttgataaagaaagcaaacgattatttcaccgaactaattgacgactctcagctgtccgaggaacagaagaattgcctcaaaaacgatatcaataacggccaactgttcccggtgcagcgttcaagtgacaatggggtaatcccctaccagattcaccttaacgagctgcggcgaatcattgagaatcagaagcaatactatccttttctagctgaaacgttcataagaaaaactgccgagggaaagagctacgaagagaacaagatcgtggctctcctgaaatttagggtcccatattacgtgggccccttagtttccaaggaagatatggaggagcattctagcggtaattcagcctatcactggatggcacgcaaccctgggcggggcgaagccattaccccatggaatttcgacgaggtggtcgataaagacgaaagtggagctagatttatctccaggctgacaggcactgatacctacctactcggggagcccacactgccgcagcatagccttttgtatgaagagtacatggtgctgtctgagctcaacaacgtacgcctgaatgttcgacagggaaaccactggtcagacaagaatcggcaacgtcttagttacaaacagaaggagttcctgatcgaaaacttgtttaaagaacacaagaccgtgacgagaaagagggcggaggattgtctcagctccatgggttgcggcgaagtccagctgttcgggttatctgacgagaaaaagtttgcatcgagcctgtcctcatatattactttgaaaaagatactcggaaaagccttcgtggatgacagtggcaattctgctatcctggagcgcattatcgaagtccagacagtgtttgaggatcgggaacctcttacccatcaattgagcctgattgactccctcactgttgagcagagaaagcagctggccaagatccactacacaggttgggggaaattatcaaggaagctgcttaccagcaaaaagggctcttataaaatacattcccagaacgagatcatgcgaacgcaacacagtattatcgacattatgcgcggagatagcttgaatctcatcgaaataattcgggacaagaagatcggcattggggagtggatcgataacgaaaatctggacagagagaccggagaatctgatgtgtccaggctagagtcagtattcgagggtatagtcatgagtccccgtgtgaaacgcggcgttgtgcaggcagtccgggtgatcgacgatctggccaaggctattgggaacccacctcagagaatctttattgaaatggccgacgaggtacaggcaagccaaaggacagtgtcgcgactctcccggctgaaagcgctttacggatctcccagcttgcagaaggagttcaatgatctgaaagacttacgcaagtcactcaacgaaactaaggatgctgacctgcaggaagacagactttatctgtactatatccagttgggcaaagatctctacaccggtaaggagataagtattgactccctgtctagcgcctacgatatcgaccacatcgttccacaagcactaacacaggatgactccattgataatagggtcctggtgtcacggaaagagaacgcccgaaagactgacagctatctctacacccccgatctgatcaaaaatatgagacctctttgggggaagttgctggctgccggcttaatgagtcagaaaaagtatgacgcactcacacgcgtggatgacttcaaggatagggaaaaacaacgttttgtccagcggtctctggttgagaccagacagattatgaagaacgtgtccactatacttaggacgtactatggagaagacacaaacgtggtaaccctgaaaagctcgatcactcatgacatgcgcaagtacctaggcttcccatataaaaatcgagatattaacgactaccaccatgctcaggatgccctctgtatctcagcggccgggcaatttatgctgaatagacacttcgtctctggaggcgaggtgaccgacggtgctagtaacgcatacaatatgtatttggccgaatacctgcaggagtttcgggatgctaaggccaggggagagcgcaagcgttccacagcattcggatttgttgtgggcagcatgtctagcaaagacgatgaaaagagaaccgaccatcggactggtgagattgtctggtccgaaacaaacgcggagtatttaaggaaagtgatgaattacaagaaaatgctcatcacgcagaaggttggcgatgtgaagacccgcgccctgtatgacgagactcgatacgggcacaaagaatcaagtgctaagagcataaaattcgataaccttagacgggacacatctctgtatggaggcttttccggggcctcaaccgcatacatgatgttggtagagtacaagaaaaagaataagctcgtcagtatcacagctcaggaagccagcctgctagcagtggccgatcagaaaaacgacactgtgtccgtcatggacgggattctggcttctcacggcctttcgggtgcgaagatcctcctgccgaaaattgttaccgggcaattgctggattatagcgacgccttagtgacgctccagtcagcatccgagctgaataccgctaggcagatgtggcttccccgcaacgattacaatgacatcgatataattctgaagagtaaagacatcgaagatgccgcccataagttgggatatgactctgatacagtacacgtgctcagaaggatccaaaagctgttcgaggctgtctttcgggtggcagagagccagttccctctacatcagctgtccaaagaccaacaggaagagattcttcgtgatccacagaactacggctttggttcagccgttaagctcctgggcgggttgttaaaagcgctgcacgctaatgccgaaaacactaacctcgcaggactggtgaaggtccttcatggcgacaaagagtattctgacgatgggaaggccaaagagttcaagaagttcggatttagcccccgctggcgaagaataagtaatcctaccggcttcacactgtccgacagcgatacttttatctaccagtctccatcaggtattttcgaacaaagggtgaccgttaaagagttgaaggaaaaagctgacaagcagaaatga

SEQ ID NO: 3393 - RNA, 4422 nt, synthetic construct
  misc_feature 1..4422: note = Cas9 variant
  source 1..4422: mol_type = other RNA
atgaagaacatcctgggcctcgaccttgggaccaatagcattggatgggccctgatagagaaagatacagaccagaagaacggtaatatcttgggcactgggtccagaattatccccatgtctcaagatattaaagacgaatttggaaagggcaactcaatcagtcagacggctgataggaccaaatttcggagcgtgcgccgattacgtgagagacatctgctaaggcgggaacgcctccacagagtcctgaatgttcttggtttcctgcctaagcactacgcagaccagatagattttaagaaaaggttggggaagctcgtgaacgagacagaaccaaaactggtatatgacaataagaacttcatctttaaaaagtccttcgaggccatgctgtctgattttaatcagcatcaaccgctcttactggcggacggaaagaaagtgcccttcgattggactatttactatcttcggaagaaagctcttaccgagaagatcgaaaaagaggaactggcctggctaattctcaactttaatcagaagcgcggctactatcagctgcgaggcgaggaggaagaggaaaaccctaataaaatggtcgcattccactcgcttaagatcgtggaggttatagccgacgaatcacagaaggggaaagctgagacatggtacagcctgattttggagaacggatggatctatagaaggagttccaagaccccactctacgattggaaaggtaagcaacgggactttattgtgactacagacctgaatgatgacggctctatcaaaaccgataaggaagggttagagaagcgtagcttccgcgcacccgtcgaagacgattggacgctggtgaaaaagaaaactgagcaggaaatcaacagatcccataagaccgtaggaacatacatttatgagaacctccttcaggaccctaaacagaagataaagggcaaactggttaggactatcgagcgggaattttacaaggatgagttgaaaatgattctaaagaatcaacagaaattccacccagaactgaacgacgagcacctctatatcaattgcgtgcgagaactgtaccgcaacaatcaggcccatcaaaccatactttcaaagaaggatttcgtccacctgtttattgacgatatcatcttctatcagagacccttgaggagtcagaaaagctctatttccaactgtacactcgagtttcggaagtacaaaaatgagaacggtaccgaccagacggactatctgaaggctatccctaaatcacatccattattccaagaatttcgcctgtggcagtggatttacaatctagggatataccagaaggaggatgacactaacgtgacagatgaactcatcaaaaatattgacggatatcaggatctgttcgactttcttaacaataagaaggagatcagacaagatatcttgattaaattcctggtggagcagaccggcctcaagggcaaaccgctgagcagtgtcgttgccaagtacaggtggaactttgtggaagacaaaatatatccctgcaatgagactgggacacagatccgtacccggcttgcgaaggtagaaaacacgcctgaggatttcctgaccgcagaaacagagattaagttgtggcacatcatttactctgtgaacgacaaagccgattatgagaaggctctcaaaacttttgccgaaaagcacaatctggacacccattccttcgtcgagaactttaaaaagttcccacccttcaagagcgaatacggatcgttttctgagaaagcaatcaagaaattactgcctctaatacgactcggtaagtattggtcctgggaaaatatcgataaaaagacacaggagagaattgagaagatcctgactggcgagttcgacgaagctattaaatcaagggtgcgcgacaaggccatccaccttaccgaagaggatcattttcaagggttgcagctgtggctcgcgagttacgttgtgtacggacggcacagcgaagccgacaacctggataaatggcatacagtcgcagacttagaggattatctggctgagttcagacagcactcccttaggaatccaatagtggaacaggtaattaccgagactttgcgcgttgtgaaggacatctggctccaatacggccagggtgccaaagatttcttctctgaaattcacatcgagctggctcgagagatgaagaacacgggggacgaacggaaacgtctaacaagcctggtcaccgataatgagaacactaatctcagaataaaggtgctgctttcagaattgctgaacgacggcaatgtcgagaacgtgaggccctatagtccgatgcagcaagaagccttaaagatctttgaggatggagttctcaattccgacattgagatcgaagatgacattctgaaaatcagcaagatggcacagcctaccaacacagagcttaaacgctacaagctgtggttggaacagaaatatcggtctccctacaccggccagataattccactcaatagactgttcactgccgactatgagatcgaacatatcattcctcaatcaaggtttttcgatgacagttttagcaacaagatcatttgtgagtccgctgtgaaccagctaaaggataaacagctggggctcgagttcataaagaatcactctggaacaatcgtaaaactgggtatgggcaagacggcgaaaattcttgacgtcgaatcgtacaacgagtttgtgaaggggaattacaccaagaacatcagcaaacgaaataagttgatgctggaagagattcccgataaaatgatcgaacgccagttaaacgacactcggtatatatccaagttcatcatttcagcactcagtaatatcgttagatctgagagcaacgatgacggattcaattccaaaaacgtgctgccaggcaatggtaagattacatcaaggcttaagcaagattgggggatgaacgacatctggaatgagctgatactaccccgttttgaacgcatgaacaaaattaccgatagcgccgtcttcacagcttggaatgagaacaaccagaagtttctccctatcgtgccactggagttctctaaaggctttcagaagaaacggatcgaccatagacaccacgccttggacgcactggtaattgccgcttccactagggaacatataaatttactcaacaatgagcacgccaagagtgataagcgattcgacctgaaccggaaacttcgcaagtttgaaaaagtggcatacaatgatccgaagaccggaaaaagaatcgagaaggaagttcccacgattttcctgaaaccttgggagacctttacagtcgacgcgaagaacagcttggaatctatcattgtgtccttcaagcagaatctcagggtgatcaaccgggctactaattattcagagagttacaacgatgagaatggcgccctgcgactagggaaagacggaaacccactgaaggagaaaataaagcaaagcaaaggtgattcgtgggcaatcagaaagcccatgcataaggactttgtctatggcaaagttcaccttcagaatgtgaagctccctaaagataagttcattaccgccatccgcaaatccctggacgtgacattcgatttgaagaggattgaaactatcaccgacacggggatacagaagattctgaaaaactacttacattctaaggaaaataaagtagagctcgcttttagcccagaaggaatcgaggatatgaaccaacacatcgagcgttataatgacggcaagaaacaccagcccattcataaggtccgggtgttcgaaatcggttcaagatttagtctgggggagtccggcaacaagaaaacaaagttcgttgaagccgcaaaaggaaccaacttgtttttcgctgtgtaccaggacgataataagggcaaaaggaactacgagactataccgctgaatattgtcatcgaacgccagaagttggggctccactctgtgcctacagaggacgccaaaggaggcaagctgctatttcatctgagcccaaacgatatggtttatgtgcccacctccgaggaacttgaggacaatctcgcgtcagtaaacattaagcgactgaatactgcccaaagaaaacggatctacaaggtcgaaaaagctagcggtgtggagtgctatttcataaggcaggatattgcatacttgatcaagaactatgacgccaaaaccaagatcggggagttagaaagtcagaataagctgcagacaacgatgaccgatgaccgcctcaaaattactgatgtgtgtgtcaagctgaacatcgaccgtcttggatctattgctgagacatttctgggcaatcaatacggtgcctccaaaaagacctga

SEQ ID NO: 3394 - RNA, 4422 nt, synthetic construct
  misc_feature 1..4422: note = Cas9 variant
  source 1..4422: mol_type = other RNA
atggccaagatcctgggcctcgaccttgggaccaacagcattggatgggctgtggtcgagagagaaaatatagatttctccctgatcgacaaaggtgttaggatcttttctgagggcgtgaagtcagaaaaagggattgagagtagccgggcagccgaacgcacaggataccgatccgcgcgtaagattaaatatagaaggaagttgcggaagtacgagactttaaaagtactgtctctaaaccgcatgtgccccctctcgatcgaggaagtggaggaatggaagaaatcaggcttcaaggattatcctctgaatccagagtttcttaaatggctgagcacggacgaggaaagtaacgtcaatccgtacttctttagagatagggcttccaagcacaaggtgtctttgttcgagctcggtcgggccttttatcatatagcacagcgccgagggttcctgagcaacagactggaccaatccgccgaaggaatcctcgaggaacactgtcccaaaattgaggctatcgttgaggatttaatttcaatcgacgaaataagtaccaatattacagattactttttcgagactggcatcctggacagcaacgaaaagaatggctatgcaaaagatcttgacgagggggataagaaattggtgtctctgtacaagtccctactcgccattctgaaaaagaacgaatcagactttgagaattgcaagagcgagatcatcgaaaggcttaacaaaaaggacgtcctgggaaaagtgaagggtaaaattaaggatataagtcaggctatgttggacggcaattacaagaccctcgggcagtatttctactctctgtattccaaagagaagatccggaaccagtacacaagccgtgaggaacattatttatcggaatttattaccatctgtaaagtacaaggaatagatcagattaatgaggaggaaaagatcaacgagaaaaagttcgacggcctggccaaggatctctacaaagcgatcttctttcagcgccctcttaagtctcagaaaggtctgattgggaagtgctccttcgaaaaatcaaagagtagatgtgcaatcagccacccagactttgaggagtataggatgtggacttacttgaacacaattaagataggaacccaatccgataaaaagctacggttcctgacgcaggacgaaaaactcaagctggttcccaaattttaccgaaagaatgatttcaactttgacgtgcttgccaaagagctgatcgaaaagggctctagcttcggcttttataagtcaagtaaaaagaatgatttcttttactggttcaactataaacctactgacaccgtcgctgcctgccaggtggcagcttccttgaagaatgccattggggaggactggaaaacaaagagctttaagtaccagactatcaactctaataaagaacaagtgtcacgcaccgtcgattataaggacctctggcatctgttaacagttgcgaccagtgatgtgtacctgtatgagttcgccatcgacaaactaggactcgatgagaagaacgcaaaggctttcagcaagacgaagctgaaaaaggactttgcctccctttctttgtcggctattaataaaatactgccatacctcaaggaaggtctgctttacagccacgccgtattcgtggcaaacatcgagaatattgtcgatgaaaacatctggaaagacgagaagcagagagattatattaagactcagatctccgaaataatcgagaattacacactggagaaatcaaggtttgaaattatcaacggcttgctcaaggagtataaaagtgaaaatgaggacgggaagcgggtgtactattctaaagaagccgagcagagcttcgagaacgatctgaagaaaaagttagttctgttttacaagtccaacgaaattgagaataaagaacagcaggagaccatcttcaacgagctactccccatatttattcagcaactgaaggactatgagttcatcaaaattcagcgccttgatcagaaggtgttgatctttctgaaaggaaagaatgaaactggccagatattctgtacagaagagaagggtaccgctgaagagaaagagaagaaaatcaagaacagactcaaaaagctgtaccacccttcagacattgaaaagtttaaaaagaaaatcattaaggacgagttcgggaatgaaaagatcgtcttaggcagcccactgacgccgtctataaagaaccccatggcgatgagggcacttcatcaattgcgtaaggtgctcaatgccctgattctagagggacagatcgatgagaaaaccatcattcacatcgaaatggctcgggagctgaacgacgccaataagcgaaaaggcattcaggattaccagaacgacaataagaaatttagagaagatgcaataaaggagatcaagaaactctatttcgaagactgcaagaaagaggtagaacctacagaggatgacattctgaggtaccaactttggatggagcagaaccgctccgaaatctatgaggaagggaagaatattagtatctgtgatataatcggaagcaacccagcctacgacattgagcatactatcccccggtctagatcccaggataattcacagatgaacaaaaccttgtgcagtcaaaggttcaaccgcgaggttaagaaacagagcatgcctattgaactgaataaccacttagagatcctcccacgaatagctcactggaaggaagaggccgacaatctgacacgggaaattgagatcatctcgcgttccattaaggcagcggctactaaagagataaaggataaaaagatcagaaggcgccattatcttaccctgaaacgggactacttgcagggtaagtatgacagatttatttgggaggaacccaaggtgggcttcaaaaactctcaaatcccggatacagggattatcaccaagtacgcccaggcatacctcaaaagctattttaagaaagtcgaatcagtgaagggaggcatggtcgccgagttcaggaagatatggggtatccaggaaagttttattgacgagaatgggatgaaacactacaaggtgaaagatcgatccaagcatactcaccatacgatcgacgctattacaatcgcctgtatgaccaaagagaagtatgatgttctggcacacgcttggactctagaagaccagcaaaacaagaaagaggcccgctctataattgaagcgagcaagccttggaaaaccttcaaggaggatctgctcaaaatcgaagaggagatcctggtgtcccactacacacccgacaatgtaaagaaacaggccaagaagattgtccgggtgagaggcaaaaagcagtttgttgctgaagtggagagggatgtcaacggaaaagcagtgccaaagaaagccgcttcaggcaagaccatctataaacttgacggggaaggtaaaaagttgcctcgtctgcagcaaggagatactatacgcggcagcttacatcaggacagtatttacggggccatcaaaaatcccctcaacacagacgagattaagtatgtaatccggaaagatctggagtctataaagggatccgacgtggaaagcattgttgatgaggtcgtgaaggagaaaatcaaggaagcaatcgcgaataaagtgcttctgctatcgtcaaacgcccagcagaagaataaactcgtcggcacggtttggatgaacgaagagaagagaattgctatcaataaggtgaggatttacgccaactctgtgaaaaacccactgcacataaaggagcatagtttgctgtccaaaagcaagcacgtacacaaacaaaaggtctacggtcagaatgacgaaaactatgcaatggctatctacgagttagatgggaaacgagacttcgaactcattaatatctttaacctggccaaacttatcaagcagggccaaggattctatcccctgcataaaaagaaagagattaagggcaaaatagtgtttgttcctatcgaaaagcggaataagcgcgatgtggtcttgaaaagagggcaacaggtggttttctacgacaaggaggtggagaacccaaaagatatttctgaaatcgtagacttcaagggaaggatttatatcatagagggcctcagcatccagcggattgtccgaccgtccggtaaagtggatgaatacggggtgatcatgctgagatattttaaggaggcacgcaaggccgacgatattaaacaagacaatttcaagcccgacggagtctttaaactaggcgaaaacaagcctaccaggaaaatgaatcacaaccagttcactgcttttgttgagggtatcgatttcaaggtgctgccatcaggcaagtttgagaaaatatga

SEQ ID NO: 3395 - RNA, 4425 nt, synthetic construct
  misc_feature 1..4425: note = Cas9 variant
  source 1..4425: mol_type = other RNA
atgaagaaaatcctgggcctcgaccttgggaccaacagcattggatgggccctgatagagtccgatttcgaaaagaaacagggtaagatcaatggcttggggtctagaattatccccatgtcacaagacattttaggaaaatttgatagtggcgtgagcatctcccagacagctgagaggacttcttaccggggtgtccgccgactgaaccagcgtaatctactcagaagggaacggctgcaccgcgttcttaacatactggacttcttgcctaagcattattcgaatgcaatcgattttgagaagaaactcgggcagttcaaggaaaacgtggaggagaaactgaattacgccaagaaccaaattggaagacacgaatttatcttcatggactcatttaaagagatggtaaaggagttcaagcagacgcagccacagctgttttataaaagggaaaatggcattgagaccaagatcccgtacgattggacactctattacttacggaaaaaggcgctgagccaaaagataaagaaagaggaacttgcttggattatcttgaacttcaatcagaagcgcggctattaccagctgcgaggggaagacgtgctagatgagagtaagattgaagacttttactccctcaaagtcgtggaggttcaggagactgaagataagaacgccagaggaacctggtataatgtgatcctggagaacgactgggtctacaaaaggcaatctaaggaaagccttgataattggatcggtaaaaacaaggagttcattgtgacaaccaacaaggaaaaagacggctccctgaagttggacaaagcagggaatgtaaagcggaactttcgtgccgttgattcagagaaagactggatagctatcaagaagaaaactgagcaggatgtggaaattagtaagcatacagtcggacagtatatctacgagaccctcctgcaaaatgcaaaacagaagataaaaggcaagttagtgaagacgattgaacgcaaattctataaggaggagttcatcaaaatcattaaggaacagctgaaacaccatcccgagctccagagcaagactctttacgaaacctgcatccaagagctgtatcctagaaacgaagcccaccagaataacattaaatctaagggttttgagtacttgttcacagacgatataatcttttaccagaggccactaaagtccaaaaagtcaactattagcgggtgtcagtatgagacccggctgttcaaaaagacagtgctcaataaagtcaccaacaaggaaaatgagatctggcaaaaggaacccctgaaagctatcagtaagtctcaccctctttttcaggagttccgactgtggcagtttttgaaaaacctcaagatttaccagaaagaagacgttaagggaaatctgatagatcatgacatcacgtccgatttactgaagactgaggccgactgggtggagctattcgattttctcaacattaaaaaggaaatcgagcaaaaacagattatccagttctttataaataacaagcagatcgaaaaaggcaagaagaataactatcgctggaactacgtagaggacaaaaagtatccatgcaatgaaacaaaaagccaactgatttcgagacttaagaaagtgaagaacttggacctgaatctcttctttacctctgagactgagctgaaactttggcacatcatttactccgtcaaggataagatccagtatgaaaaagcgataaagaacttcgcaattaaaaataacatcgacattgattcattcgtggagaattttaagaggtttcccccttttaaaaacgaatacgccgcttacagtgagaaggccatcaagcggctgttgccactcatgcgcatgggcgaatattggaatgagagcgagataaaacaggaagttaaggacagagcatactccatcattgagaggctgaaagggatcgatttcaacaaggacaaaattgatgaaaagatcacagacgatgacataaagaaacaattactgaagtcttttattgatttcaaagacaagaatccgctaaaaggactcaacacctatcaggcttgttacctggtgtataatcgtcatagcgaggtcaactcaatcgcctactggaagagtcccgatgacatcaataagtatcttgagggttttaaacagcactccttgcggaaccctattgtggaacaggtagttacggagaccctgcgaacagtgagagacatctggcaatactacggcaaggggaaagcgagcttctttaacgaaattcacgtcgagctcggaagggaaatgaagaatccagcctataaacgcaaggcatctactaaccgggtgaccgagaatgagaacacaaatcatagaataaaggaaatcctgaaagagttacagaacgaaggcgtccaggaggtgaagtcatacagtaggaatcagcaagaaattctgaaaatctatgaggagggtatttaccagagcatcgatgttgtggacgatgctatagaaaagatccgcaaaaactcctctcccactaaggccgagattatcaaatataaactttggttggaacaggggtacacctcgccttatacaggcaagaccattccaatgagcaaactcttcactacggactaccagatcgagcacataattccccaatccctgtactttgataattcactaagtaacaagatcatctgcgaatctgaggtaaatcagctgaaagacaaccagacagcttatgagttcattaagaaacatggaaccgaaaaggtcagcctcggcaagaataaaactgtggagatatttaccctggaacaatacgagaagcactgtaaccagtatttcaaaaagaataaaaacaaacttaagaaattgctgtccgaggaaatcccggaggggttcattaaccgacagttaaatgattcacggtacatcagcaagtttattaaaggactcctgggtaaccttgttcgtgaagaggacgaacaggaggtgacaaccaagcatatcgtccctgtgactggcgccataacatctaaactgaagcaagattgggggttgaatgacaagtggaacgagctcgtagcatccagattccagaggctgaatacgatgaccaacagtaataactttggatattgggatactaaaatcaatgccttccgcgtgcaggttcccgacgaaattagcaagggcttttctaaaaagcggatcgatcacagacaccatgctctagacgcgctggtcattgcatgctgtacaaggaaccacatcaattacctcaacgccctgaatgctgagaaaaagaactatggtcttcgagacttgctgttaataaagaatgataagaaccattacaccaagttctttaaacacccatgggacgggttccctgtggaagccaagtccgtgctcgagaaaacaattatctcatttaagcagaatactcgcgtcatcaacaaaaccaacaataagacgtggcaatgggcagaaaaggagggccagctgaaaaaggttcttgtgaaacagaccaagggagataactgggccattcggaaacccatgcacaaggagacagtgagtggcaagctgaatatcccaactcccaaagggaagatagctaccgccagcagagtatcgctatccgaaattaaaacaaggaagcagctcgacaaaatcactgatatttctatccaaaagatactggagcgtcatttgaacaattacctggacgataagggaaaagaaaagttcgacttagcatttaacgcggatggtgtcgaggaactcaataaaaacattaaggtgctgaataaaggcaagaaccaccagcctatctataaagttcgcctttacgagatcgggagccggttcaaggtgggaaattcaggcaacaagaaagacaagtatgtcgaggctgccaaaggtaccaatctgttctttgcaatttacttgaacgaaaaggataaaaagagagtgtatgagacgatcccactcaatgaagttattgagcatcagaaacaggtgagtaacctgccgaagaacgagaggacacccgtacctgtcaatcacaccaaggggaaattcctattttccctgtctccaaacgaccttgtgtacgtgcccactgacgaagagatagataatcctagcctcgtcaacttcaataacctgaataagaaacaagttgaaaagatctataagacagtgtcctgctcaacctaccagtgtttcttcgtacataacactattagcaaaccaatccagaataaggtggagtttagtgccttgaacaaaatggaaaagtctatcgacggcattatgataaaagatcgatgctggaagctgaagatggaccggttaggaaatatcatttccgtcatccgctga

SEQ ID NO: 3396 - RNA, 4443 nt, synthetic construct
  misc_feature 1..4443: note = Cas9 variant
  source 1..4443: mol_type = other RNA
atgaagaccatcctgggcctcgaccttgggacaaacagcattggatgggccaaagtgtgcgtcgataatgacggtaactacctgagagatataaagttgggctccaggatcattcccatgtctcaggacactttagggaatttcgataaaggagttacggactcacctaccgctgcacggacaggctttcgcggtgtgcgacgtatcagagagagggccctgcaacggcgcgaaagactacacagggtactccatgtgatgaagttcctgccaccgcactatgagaacgcgattgggtggaatcgggaagaggctactacctacggaaaatttcttaaccatggcgaacccaagctggcctgggagaagcaggaggatggcagtatgcgcttcttgtttatggacagcttccacgaaatgatggcagattttgccgagtcccagcctgggctcgtcgctggaggtaaaaagatcccactggactggacactgtattacctccgaaagaaagcattaacccaggccataagaaaagaggaactggcttggatccttttgaatttcaaccaaaagaggggctattaccagctgagaggggaggaagatgaggaaaatcccgccaagcgtgaggaatatcatgagctaaaagtggtttctgtggaggcggcagaagagggaaagggcggtaacacttggtacaatgtcacactcgaaaacgggtggatttaccgcagacagtcgaaagtggagctgcacgactgggtaggaaagaccaggcagtttatcgttacgactgaatatgagaaagatggcgtgaccattaagaaagacaagaatggcgaggtcaagcggtcattccgagcccctagcgaagacgattgggggcttcgcaaaaagagaacagagagtctgttggaagactccggaaaaactgtgggtgcttttatctacgatcacatactctctgagccaaccgacaagattaggggcaacttcatccggacaattgaacgcaaatattacaagaaggagctggaggccatcttactggaacaaaccaaacatcacaaggagctcaaagatcagaatacgcttatcgcatgtattaaggaactgtatcagagcaacaaaccccatcaggactccttgatgaagaaggatatgacttacctactgataacagacctcatcttttatcaaagacctctgaaatcaaagaaaagtcttattgctgattgcccatacgagtactatgagtacaccatcaaggaaactggggagataaaaaggcagggaattaagtgtatcgccaagagcaacccgtattaccaggaatttcgtctgtggcaattcatcattaatttgcggctctttgaccgaacagatgacaaagaggtgacctctgaatatctgtcctcaatggaggactacacgaagttattcacctatctgaacgatagaaaagacatcaatcaggagacactactcaaggatttcttcaaacagaagaaagtcaagatgggcatggaaaaggagtttcccattaggtggaactacatagaagacaaagagaagaaatacccttgcaatgaaactcgccacgagctgcttgcggccttggataaggcaggtatcgaccacagctggctggatgacaaagagcggttctatagactctggcatctgctttacagtgttgaatctaaggaggaagctgagggggccctgaggaagttgaaagataacgacgattttgtgaatgctttcctcaaggtaaaaccatttaagaaagactatggcgcctactccgaaaaggcagtgaagaaactgttagccattatgcgcatgggaggcctgtggaacgagaccgatatctgtgagcagacacgaaatcggatccaaagcattataaagggggaaatcgacgagaaaattaaggaacgtatgggaagaactttctgccagctatcggactttcagggtctccccgagtggctggcttgttatgtcgtgtacggcaggcactctgaggcgaccgatatccagcgctggacaaaacctgaaaaccttatggcatatattaatgggttcaagcaacattccttgcggaacccaatcgttgagcagtgcatactggaaaccctcagaactgtgcacgacatctggaaggaggccggacatattgatgaaatccacgtcgagctgggcaggtcaatgaaaagtacggctgaccagcgagcccgcatgagcaagtccattttacagaatgagaacacaaatctgcggatcaaatctcttttgatggaactcaagaacgcaaaagagatagaaaacgtgagaccctacagcccgatgcaacaggagattctgaggatctacgaagagggtgccctacaggagctgaccaaggaagatgctcagtatcctgagatttcaaaaatcagtcaaatggcccagccctccgcaaaggaactcctgaagtaccgtctttggttggagcagaaatattgtagcccatacactgggaagcctatatctctgtcaaaattatttaccagtgcgtatcaaatcgaacacattatcccccagagccgctacttcgacgattccttcacaaataaggtaatttgcgagaccgaggttaaccagctcaaatctaatatgctgggctatgaatttatcaagaagcattcgggagagatagtgcactgtactacaattggcgacgtcaaaatccttgatgctaaggaatactacaacttcgtgacggagcattatgccaataaccggcggaaaaaggagaaactgttgctcgaagacatcccacaggagtttctgaataggcaaatgaacgatagccgatacatttccaagaaggtcatggcaatcctatcaaatattgtgcgggaagaggacgaacaggagaccaacagtaaattcgttgtgtcttgcagcgggggaataactgatcgcctgaagcaggactggggtctcaatgacgtatggaactccatcgtctatcccagatttgagaggctgaataaacttacacagaccgaagccttcggccggtgggagaacaaggaagggaaacaagtgtttcagacatcattgcctctggagttacagcgaggattcagcaagaagagaattgatcaccgccaccatgctatggacgccctcgttatcgcatgcgcttctaggaatattatcaactacctgaacaatgaatccgccaaaagtcaggagcaacgtgaggatcttcggaagaaactgtgtgacaagaacagaataatcaggaaaccatgggaaacttttacccaggatgcgcgcacggccctagaggacgtggtcgtgagcttcaagaattatgtacgagtgattaacaaggctaccaattactatgaaaaatacgatgagtctggcaagaaaggtatggcagaacagaaggggcaagacatgtgggccatcagaaaaccgatgcacaaggagacagtttttggccaggtcaacctccggaggaaagtgactgtgaagctgaaggatgctttggagaatattcccgccatctgcgacaaagcactgcgcgattacgtcaacgacttaatagcgaagaaattcaataccaagcagatgctcgcccattttaaatccattaactatcgtctgaatatgaagtcagttaacaaggtgggaatctgggtgttcagtgacgaaaaagagcctatggtagctacaagaaaggccatcgatattagcttcgacgcaaaacggatagatactatcaccgacacgggcattcagcaaatcctttgtaagtacctgaaatcgaaggggaatgatccaaacgtcgcttttacacccgaaggaattgccgagatgaataagcacatcatagactataacaacggcaaacagcatcagcctatcttgaaggtgagggtttccgagccaaaaggtgcaaagtaccaggtgggggaaaccggaaataaaactaagaagttcgtcgaggcccaaaaaggcacaaacctctattttgctatttacgaagataaggacggtaatcgctcttataacaccatccccctgaatgaggtggcggaacgactaaaacagggcctgagcccggttcctgagaagaacgagaaagggatttcacttaagttctacctcagtccaaatgatctggtgtacgtacccactgaagaggaaaaattgtccaacgagtgcaagctgtctaaggaaagaatctataaaatggtcagctccacctcaaatgagtgtcactttataccttacacaacggccaagcccatttatgacaaattcgagtacgaagcaaagaacaaaatgggacgggctttaaccggcgagatgatcaaggccgtgtgctggaagctcgaagtggataggctggggaatatccttaaaattatcaagtga

SEQ ID NO: 3397 - RNA, 4452 nt, synthetic construct
  misc_feature 1..4452: note = Cas9 variant
  source 1..4452: mol_type = other RNA
atgaagaccatcctgggcctcgaccttgggacaaacagcattggatgggccaaaatatccatcgatgacaatggtaactacctgagagatattcagatgggctctaggatcattcccatgtcacaagacgtgttggggaatttcgatagtggagtcactgagagccagacggctgttcggaccggctttcgcggtttacgacgtatcagagaaaggtccctgctacggcgcgagagactccacagggtgctgcatgtaatggggttccttcctccacactatgactctgcaataggatggaacaaggaggaaccgacaacttacggcaaatttctgaatcatggcgaacccaagttggcctgggagcggcagggggatggatcgatgcgcttcctctttatggactcattccacaaaatgatggaggattttgcgcctcatcagccagctctggtggccgacggtcgaaagatccccctggattggaccctctattacttaagaaagaaagcactgacacaacctattaagaaagaggaacttgcctggatcttgctgaacttcaatcagaagaggggctattaccagctacgtggggaagaggaggaagagaacccaaccaaacgggaagagtatcacgaactcaaggtcgtgagcgttgaggctgcagaggaaggaaagggcggtaatacttggtacaacgtgaaactggagaatgggtggatttaccgcagaagttccaagatcccccttgacgattgggtcggaaaaacaaggccttttatagtgaccacggaatatgaggccgacggcattactctgaagaaaaacaaggaaggcgaggtaaaacggtctttccgagctccaggggaggacgattggggattgcgcaagaagagaaccgaaagccagctcgaggcctccggtaaaacagttggcgcgtttatctacgaccacctgttagcagaaccggccgataagattagggggaatttcatccggactatcgagcgcaaatattacaagcaagaactggctgacattctcagagagcagtcaaaatatcatgaggaacttcagagtaagaagatactggccgattgcgcagaggaattgtacaggagcaaccagccccaccgtgactctctactgaaaaaggatatggtgtatctcctgcttaccgacatcattttctaccaacggcctctgaaatccaagaaatcattgatcgctgattgtccatacgagtattacgagtatgtcgacaaggaaacaggagagataaagcgacagggcattaaatgcgtggccaagagcaatccctactatcaggaatttagactctggcaattcgtgctgaacttaaggctgtacgatcgcaccgaggacaaagaagtcacggcggagtatctacctagtaaggaggactacgcccggctctttgtttacctgaacgatagaaaagaaatcaatcaggagactcttttgaaggacttctttaagctgaaaaaggtgaaacagaggtctgaaaaggagttcccagtacgctggaactatatcgaagataaagagaagaaatacccctgtaatgagacacgacatgaactcctgatggcacttgaccgggctggtattgagcgttcctggctggatgacaccgccagacagtgcaggttgtggcacctcctgtatagcatcgaagtgaaggatgaggctgaacgcgccttacggaagctgaaagacgatgacgagtttgtctcggcattcctaaaggtgaaaccgtttaagaaagattacggggcctattctgagaaggctgttaagaaactcctggcggtgatgagaatgggctcccactggtgtgaagacgatatttgcaaggagactaaagaaaggatagagcatatccttcaaggagacgtcgaggaaaagattaaagagcgaatgaaccacacagcatactcattgggcgaactgagtgacttccaggccctccctgagtggctggcttgttatgtggtatacgggcgccatagcgaagccaccgatatcaagcactggaagacgcccgagtccttaatggcatacatcaatggatttaaacagcattctctgcggaacccaattgttgagcagtgcatacttgaaaccttgagaacagtgcacgacatctggaaggaggccggtcacattgatgaaatccatgtcgagctcggcaggagcatgaaatcaaccagtgaccaacgtgctcgcatgactgaaaatattctgcggaacgagaatacaaacctaagaatcaagtccctgctcatggagctgaaaaatgatgccgacataaaggatgtgaggccttatagccccatgcagcaggaaatccttcgaatttacgaggaaggggcattgcaggagctgactaaggaagacaacgattatgaggagatcttcaaaatttctaagatgccacaaccctcagcgaaagaattactcaagtacaaactgtggcttgagcagaagtatcggagtccttacaccggaaaaccaatcagcctgtccaagttgtttacatctgcttatcagatagaacacattatcccgcagtcgcgctacttcgacgatagctttaataacaaggtcatttgtgagtccgaggtgaatgccctcaaaggcaacatgctgggttacgagttcatcaagaaccatgggggcgaaatagttcactgcaccctactgggagacgtgaaagtacaaaatgaatcagagtataaggcattcgtcactgaacactacgccaacaataaatataagaaggagaaactcctgatggaggatatcccccaggactttcttaacagacatttgaatgacagtaggtacatttctaaggtggttaaaacgctgttaagcaacatcgtgcggacagaagatgagatggaaaccacttccaagttcgtcgtgtcatgtaccggcgggattacagaccgactcaaaaaggattggggactgaatgacgtatggaacagcatcgtgtattctagatttgagcgccttaatgaactgaccaagtccgatgctttcggtaggtgggagaacaaagagggcaagcgtgtttttcagacaagtgtccctctagaactccaacgggggttcaataaaaagagaatagaccacaggcatcacgccatggatgcactggtgattgcttgcgccagccgcaacatcatcaattacttgaacaatgagtctgcgaactccccaaagaagcgagaagacctgagacagcagttatgcgataagaaccggattatcaggaaaccctgggagtcatttactcaggacgcccgcgctgcactcgaagatgtggtcgttagtttcaagaattatgtgcgtgtgattaacaaagccacgaattactacgagagatatgacgctgacggaaagaaaaccataactaagcaaaagagccgggagatgtgggccgtaaggaaacctatgcataaggaaacagtctttggccacgtgaacctgcgccgaaaagcaatcgttaaacttaaagatgcgctggagaatattccatcgatctgtaacaaggaattgagagactacattaatggtctcgtggagcggaacttcaataccaaacagctgcacgcccattttaggtccacagattatcgctggaacaagcagaatgtcgacaaggtggaggtttggagattctctgatgaaaaagagcccctagtggctactaggaagccgctggacaccagctttgatgccaaacggatcgacacgataaccgatacagggatccagaagattcttctcaactacctggaagcaaaaggcggagaccctttgatcgctttcactccagagggcattgccgaaatgaatcaaaacatcgcactgtataatgatgggaagatgcaccagcccatattaaaggtacgtatttcagagcctaaaggagccaagtaccagatcggccagaccggtaacaaagctgacaagttcgtcgaggcgcaaaaagggacaaacctctattttgccatctacgaagatgaggaccgcaatcgaacttacaacaccattcccctgaatgaagtggcagagagacttaagcagggactgccacctgtgcccgaaaagaacgagaaagaggtcccattgaagttctatctcagtccgaatgacctggtttacgtgcctacggaagaggaaatactaatgaaagagtgcaagctgaacaaaaataggatctataagatggtatcctctacaggcaaccagtgctttttcattccctttcgggtggctgtcagcatcgtgaataagatggaatactccccacttaacaaaatggagaaggccatttcaagcgagatgatcaaagccgtttgttggaagctcgaagtggatcgcctgggtaatataatcagagtcgtgaaatga

SEQ ID NO: 3398 - RNA, 4452 nt, synthetic construct
  misc_feature 1..4452: note = Cas9 variant
  source 1..4452: mol_type = other RNA
atgaagaccatcctgggcctcgaccttgggacaaacagcattggatgggccaaagtgtccctggatgacaatggtaactacttgcacgatataaagttaggctgcagaatcattcccatgtctcaggacgtcctggataatttcgggaaaggagttactgtgtcacaaacgagtgtaaggaccggctttcggggtgtgcgccgaatccgtgagagaagcctacagaggcgggaacgcctccatagagtcctgcacaggcttgggttcctgcctcagcattatgacgctgcaattggatgggattccgactgtgccaagacatacggcaaatttttggataacggcgagccaaagctcgcgtgggaacggcaggaggacgggtctatgcgcttcctgtttatgaactcgttctatgaaatgatcgctgattttacttcacaccaaccggccctggtggcagacggaaagaaaatacccctcgattggaccttatactatctgcgaaagaaagcccttacacaggctatcagaaaggaggagttggcatggattctgcttagcttcaatcagaaaaggggttactatcagctccggggcgaagaggaagacgagaatcctaccaagcgtgaggaattttgcgagctgaaggttgtggccgtcgaagctgccgagaaagggaagggagacgatatctggtacaacgtgcatcttgaaaatggctgtatttaccgcagaagttccaaaatctctctggacgattgggtaggtaagactaaacaattcataattacaaccgagtatgagaaggacggggttacgcccaaaaaggataaggacggaaaagaaaagaggagctaccgggcgccaaaagaggatgactggggcttgcgaaagaaacgcactgaaaccgatctcgaggcatccggcaagacagtgggggcctttatctatgaacacctgttagctgagcctttcgacaagattagaggaaactttatccacactatcgagaggaaatactatcgggccgaactggaggcaattctcaccgaacagcgcaagtaccatgaggaacttagatcagagcagatgctggctgtctgcgccgaggaattgtataggagtaatctaccacaccagcaaagcctgctcaaaaaggatatggtgtacctgcttctgtctgacttgatattctaccagcgtcccctcaaatccaagaagtcactgatcgcggactgtccttatgagtactatcggtacgtggataaagaaacaggtgagattaagaaacagggcatcaagtgcatagccaaaagcaacccatattaccaagagttccgattatggcagtttgtcctgaatctaagactcttcgacaggatgaccgataaggaagttacggcagactatctgccgactaaggaggattacgtgcgcctttttgactacttgaacaatcggaaagaaattaaccaggagacactgctcaaggatttctttagactgaaaaaggtaaaacttgggagggaaaaggagttcgagatccgctggaactatatcgaagacaaagagaagaagtacccctgtaatgaaacccgatatgagctgttggtggctctcgatcgggccggaattgaccgtagttggatcgatgaagacggcagacagtacaggctgtggcatttactgtattctattgaggtcaaagctgaggccgaatccgcactacgcaagctcaacagcgatgacgcctttgtgtcgtctttcctgaaagttaagccttttaaaaaggactacggtgcttattccgagaaggcggtgaaaaagctattggcagtcatgcggatggggtcaatgtggagtgaagccaatatatgcgaggaaactcaaaacagaatcaggagcattatccgaggcgatatcgaggagaaaattaaggaacgcatgggacacacagctcggtccttcaatcagatagacgattttcaggccctgccagagtggctcgcatgttacgtggtatacggcagacactctgaagttaccgacatccagcattgggagacgcccgagcaactgcagagctatattaacgggttcaaacagcactcattaaggaatcctatcgtggaacagtgcattctggagacccttcgtacagtccatgatatctggaaggaagccggacacatagacgagatccatgtggaattgggtcgcgatatgaagcggactgctgaccaaagagccaggatgaccaaaaacattctcaagaatgagaacacaaatctgcgaatcaaaagtctactgatggagctcaagaaagatactgacattaaggaagtccggccatactcccccatgcagcaggagatcctgcgcatatatgaagagggcgcacttttgcagctgaagagagatgacgaagcgtttgctgatattagcaaaatctctcaaatggcccagccgaccgcaacagagttaaggcggtacaagctctggctggaccagaaatatcgatcaccttacaccgggaagttcattagtcttagcaaactgttcacttccgcctatcaaatcgagcacgtgataccccagtctagatactttgacgattcgttcagcaacaaggttatctgtgaagctgaggtgaatcgcttgaaatccaacatgctcggatacgaatttattaaggcccacggcggtgagatcgtacattgcacgatgctgggggacgtcaagattctatcagaaagtgagtataaagcattcgtgaatgagcactacgttaaccatagggctaagaaagaaaagctgctcatggaggatatcccacaggaatttctgaaccgtcagatgaatgactctcggtatataagcaaagtggtcaaggcccttttgtccaacattgtgagaacagaggatgagatggacgtaacctcaaagttcgtggttccttgcagcggcggaatcactgataggctgaaaaaggactggggcttaaatgatgtctggaactctatcgtgtacccccgctttgaacgactcaatagaatgaccgggacagaggcgttcggacactgggaaaacaaagagggtaagcgggtgtttcaaacctccgtcccaattgaactgcagcttggcttcagtaaaaagaggatcgaccaccgccatcacgccatggatgctctggttattgcatgtgccagccgtaatataatcaactatctaaataacgagtctgctaattcccagaagaaaagagaggacctccggaggctgttgtgcgacaagaaccgcattatccgaaaaccctgggaatcatttactcaggatgccagagtggcactgcaagacattgtggtaagtttcaagaattacgtccggatcataaacaaagcgacaaattattacgagaggtacgatgaacaggggaagaagacgaccgccgagcagaaaagctcggaaatgtgggctatccgcaagcctatgcataaagagactgtgtttggacacgttaacttaaagagaaaaacaaccgtgaagctcaagaacgccattgagaatatcccaaacatttgtaataaagaactgaaggcatatatcaacgagcttgtcgaaaaacatttcaatacaaagcagatgctggctcacttcaaatccataaactacaggtggaatcggcaaaacgtggagaaggttgaagtgtggcagtattctgacgagaaagagcgtatggccgcaactcgcaagccgttggataccagctttgacaagaaacgaattgaaacgatcaccgatacaggcatccagaagattctcctgaattacctagaggaaaaaggtggggaccccaacatagccttcactcctgagggcatcgctgagatgaataagaacatttcactgtttaatgatggaaaacttcaccaaccaatcctcaaggtaagagtcgcgaagaccatgggcgccaaatatcaggtggggcagacaggaaacaaggcagctaaatacgtgggcgcccaggaaggtactaatctgtatttcgccatttacgagaacgaagagggggaaaggagttacaacgctgtccccttgaatgaggttgcagagcggctgaagcaaggaatgtcccctgtgccagagaaaaacgaaaaggacgtacccttaaagttttatctctctccgaatgatctggtgtacgtccctaccgaagaggacaaacttagcaacgaatgcaagctggataatgagcgcatctataaaatggtgtccgccacgggcaagaaatgtcatttcttgccatactcagttgcgaacataatctataataaggtggagtttgaaagcatgaacaagatgggtaaagctctcagtggcgagatgattaaggccgtctgctggaaactggaagtggacagactagggacaatcctgagggttattaagtga

SEQ ID NO: 3399 - RNA, 4452 nt, synthetic construct
  misc_feature 1..4452: note = Cas9 variant
  source 1..4452: mol_type = other RNA
atgaagaccgagctggacctcaacaaagatagactttacaagcacgtgctgggcttggacttaggggtcacaagcatcggattcgcccatgttgtggaatccgagaataggaacgaatctgagattaaacagataggtgtacgggtgatccaactggataattttgacaaggtcgataaatcaggcaagacttccgaaagcaagaaccccgctgtggacttcgcagccgggaaaggactaacgcctaatggctcccgcaccaagaaacgaggtgcgcgtagaaacctcgataggtatcaggaccggcgcgataatctgcttgaggttctgacaaagtctgggtttattaactcggagactaaaagaaccgaagacggaaagcacacaacccatcagacttgggagatcagggctaaggccgtgtcagaaaaagtcgagaaggaggagttcgcacggattttgctcgccatcaataaaaagcgcggctacaaaagcagtcgaaaggctaaaaacgaagatgaaggccaggcagtggacgggatggccgtagctaagagactgtatgaggaaaatctgacaccaggacaatacgcctatgaggttctctccggtggcaagaaatctataccggatttttacaggagcgacttacaggcggagttcgacaagatctggaactttcagaaacagttctatcccaatattctgaccgatgaattttacgaggaacttaaggggaaaggacaacgggcaacgtccgccgctttctggaagatccaccagtttaacactgccgacattaaggatttggaggacgaactgaaaaatgagcgtaccatcaagctatcaaaacgcgatcagaagaaactccaggcatacaagtggagaagtgaggctgtggtcaagcaactgggcaaagaagaggtggcctatgtgcttacagaaataaacaacaatctgaacaatagctctggttacttgggggcgatttccgacaggtcaaaggagctctatttcaacaaacagactgtcggacagtttctgtacaagcaattaaaagaaaatcctcatacccggctgaagaaccaggttttctatcgacaggattacctcgacgagttcgagacaatctgggaaatgcaggcccaatttcacccagagcttacccaggaactgaaggaggagattcgcgatatcatcattttctatcagagaaaactaaagagccagaaaggcctaataagtttttgcgaactggagtctaaggaagtggtaatcaatgacacgaaaaagattatcggcctcagggtggcacccaaatccagccctctgttccaagagtttaagatatggcagaaccttaataacgtcctggtgcggaagaaagggtcgcgcaagagaatggttaaagctcagaatcagcactctttgttcgaggaaccaaaggagatttttagtctcgatctggcctcaaaagaaaagttattcgaggaactgaacctaaagggaaatctcagtgctaaaaactgtctggacatccttggtttgaatagcaacgagtgggaactgaactacactcaactcgagggcaataggacaaacaagtccctgtacgaggcctttcttaaaatcctggacattgaagggtatgatgtgaaggacttgctcaaagtcaagtctagcaaggatgaggtggaactggacgatttaaaagtacccgcatcagagatcaagaatatggttcgtgaaattttcagtaccaacaaaatagacactgagatcctggattttgacgccgagattgatggaaaggctttcgaaaaacagtccagctaccagctatggcatctcctgtattcttacgagggcgacgattcacagagtggtaatgaaaaactttatgagttgctggcgaagaaatttgggttcaagcgggagcacgcacaaatcctcgccaacgtgagcctggtcgacgattacggcaatttatcctctaaagctatgcgaaagatctatcctcatattagagaaaacaattactcgacagcctgcgagctggtgggatacaggcacagcaaacactcccttaccaaggacgaattgaaagaccgcgtcctcgaggatcggctggaactactgaagaagaactcactcagacagccagtggttgagaaaatactgaatcagatgatcaacgcagtgaatgcccttattgagaagaacagtgaaagggacgagaatggcaacatcacgaaatatttcaagtttgatgaaattcgcatcgagttggctcgagaactgaaaaagaacgccgcagagcgggcggagatgaccacaaatataaacgctgccaagttagtacatgaaaagatcttcaagattctccaaaatgagtttgggatcaaaaacccgactcgtaatgacattatcagatacaggctgtatgaggaacttaagggaaacggttacaaagatctgtattctaatacctacataccccgcgaaattttgttcagcaaccagatcgacattgatcacatcctccctcagtcccggctgtttgacgattcattcagcaataaggtcgtggtttttagaaaggacaacttgaaaaagggcaatcagacagcaatagattatatcgggtctgaggtgggagaggaaggcctgaaaaacttcattgagagggtcgaatccctctacgagctgggtaagaaaaataaggaggaagggatcagtaaggccaaataccaaaaacttttgaaaagcgcttctgagattggcgacggatttatcgaacgagatctgcgcgagtcccagtatatagccaagaaagcaaaggaattactcttcaaggtgactcggtcagtagtgagtaccagcggctcgattacagacagactgagggaggactgggggcttatcaacgttatgaaagagctgaatctaccaaagtacaaatccctcggactgaccgaaatccaggagcgtcgcaacggtcatcaggtcgaagtgattaaggattggactaaacggaacgaccacagacatcacgctatggatgccttggcggtggcctttacgaagcacaatcatatccaatatctgaactacttaaatgctaggaaaaacgagtctcacaagctccatggcaatattatagcaatcgaaacactggagaccgaggtcaagattgacgatcttgggaacaaaaagcgagttttcaaagaacccatccctaattttcgccaggtggccaaggagcacctggaaaacgtgttgattagccacaaagctaagaataaggtagtcactaaaaacaagaataaaatctcaggaaaggagaaactccagataaccctgacaccacggggccagctacataaggaaaccgtgtatggtaagtacagattctatcaaagtaaagacgagaaggtttccgccaaattcgatctggagactatcgaaaaggtggcaaacccctcttacaaagcggcccttctccagaggctgaatgagaacgaaaatgacccgaagaaggcttttagcgggaaaaacgccttgtccaagaatcctatttacatctcaatggagaacgatattaaagtccccgacacagtgaagctggtttggttagaggaagattatagcatccggaaagacgtgacgccagagaacttcaaggacgaaaagagtatagagaagattctcgatgaaggcgtaaagcgaatcctgaaaaatagacttaaggagtttggaggcgacgcaaaagaggctttctctgatctggacaagaaccctatctggttgaatgaagagaaagggacctccattaagcgcgtcaggataagcggagtgaagaacgccgaacccctccactacaaaaaggatcattttggcaatgacatcctggatggtaacgggaataaaattccagcagacttcgtgtcgactggaaacaatcaccatgtcgccatctataaggagcccgaatttgataaaaagggccagcctgttctagacgagctgggtaaccaaaagtacaatcttcaggagaaagtggtatcattctttgaagctgtggagcgtgtcaaccagggcctcccaattatcgataagacatataatcagcacctggggtggcaattctttttcaccatgaaacagaacgaaatgttcgtgtttccgaatgagaagacacggttcaaccccatagaaatcgacttgttagatcctaacaataaaaagctgatttctctcaacctgtttagagttcagaagatcgcgaataaaaactacatgttcaggcaccatcttgagactaatgtggacgacaagaaagagatgaagaacattgcctttatccacatacagagttgtaatctgttgaaagaaattatcaaggtccgcctaaaccatctgggagatatcgtgtccgttggcgagtattga

SEQ ID NO: 3400 - RNA, 4452 nt, synthetic construct
  misc_feature 1..4452: note = Cas9 variant
  source 1..4452: mol_type = other RNA
atgaagaccatcctgggcctcgaccttgggacaaacagcattggatgggccaaagtgtccgtcgatgaccacggtaattacctgcatgatataaagttgggctctagaatcattcccatgtcacaggacatcttagggaacttcgataaaggagttactgagagtcaaacggctattaggaccggctttcggagcgtgcgccgaatccgtgaaagatccctgctaaggcgggagcgcctccacagagtactgcatgtgatgggtttccttcctccacactatgactctgcaatagggtggaatagggaagaggcctcgacatacggaaagtttctgaaccatggcgaaccgaaattggcgtgggagcggctcgaggatggctcaatgcgcttcctgtttatggacagcttccacgaaatgatggctaattttgcccgacaccagcccgcactggtcgccgatgggagaaagatccctctcgactggactttatattacctgaggaagaaagctcttagtcaggcagtgggaaaggaggaattggcctggattctgctaaacttcaatcagaaacggggttattgccaactccgtggcgaggaggaagaggaaaccccaacaaagcgcgaggaatactatgagctgaaagttgtgtccgtcgaggctgccgaagaggggaagggaggcaacacctggtacagagtgcagcttgaaaatggttggatctacaggcggccctctaagattgcgctggatgactgggtagggaaaactaagcagtttatcgttacaaccgagtatgaaaaagatggaacgactttgaagaaagacaaggacggcgaggtgaaacgatccttccgcgcacctggcgagaacgattgggggctcagaaagaagaggaccgaatcccagctggaggcctcaggaaaaacagtcggtgcttttatatacgaccatttactggccgaaccagcagataagattcggggcaatttcatccgcactattgagagaaaatattacaagcaagaactcgaggctatccttagggagcagaccaaacaccatgaagaactgcgtagtaaggaaatgttggccaagtgtgcggaggagctatatcagagcaaccagccccaccggaaatctctgctcaataaggacatgacatacctgcttctgaccgatttgatcttttatcaacgacctctcaaatccaagaaatcactgattgccgaatgcccatacgagtactataagtacaaggacaaagaaaaggggaaaaagaaaagacagggaataaagtgtgtggcaaagagcaacccgtattaccaggagttcaggttatggcaattcatcgtgaatctgcgcctatttgatcggacggacgataaagaagtcactgctgagtatctcagaagtagggaggactacgcccgcctgttcgcttatcttaacgatcgaaaggaaattaaccaggagacattgctgaaagactttttcggcctcaagaaagttaagatcggtgccgaaaaagagtttgcaatacggtggaattacattgaagacaaggagaagaaatacccctgcaacgagacccgtcacgaactgcttctggccttggatagagctgggatggacaggtcttggctcgatgactccgagctgcagtatcgcttatggcatctgctatacagcgtggaagcgcgggatgaggcagaaggcgccctcagaaagctgagggacgatgacgagttcgtaggagcttttcttaaagtgaagcctttcaaaaaggattatggcgcctactcggagaaggcagtcaaaaagttgctggccgtgatgcgaatggggtcttggtggcacgaagaggacatctgtaaacagactcgcgatcggatcgaaagaattgttcaaggagacatcgaggagaagattagggaacgtatgggtcatgctgcctattccttttcacgcctcgcagatttccagggcctgccagagtggttagcgtgctacgtggtctatgggcggcacagtgaagctacacatatactgagatgggacagccccgacaaacttttgtcctacatcaagggatttaggcagcactctctccgaaatcctattgtggagcagtgtatcctggaaaccctacggacggtacacgatatctggaaggaggccggccatattgacgagatacacgttgaactgggtcgcagcatgaaatcaaccgcagagcaaagagcccatatgacaaagaacatcctcaggaatgaaaacactaatctgcggattaaatgccttttgatggagctgaagaacgatgctgacgtgaaagatgtccgaccatacagtcccatgcagcaggaaatcttaagaatttatgaggagggggccctccagcaactgaccaaggacgatgcagaatacgctgagatctccaagataagcaaaatggcccagccgtctgcgaaggaacttctgcgctataaattgtggctcgagcagaagtacaggtcaccttatacaggcaaacccatcagtctgagcaagctattcacttccgcctaccagattgaacacgtgatcccacaatctcgttattttgacgattcgttcaataacaaagtcatttgtgagagcgaggtgaataccctgaagtccaacatgctcggatacgagttcatcaagaatcactgcggcgagatagttcattgtacaatgctgggggacgtgaaagtattttcagaaagtgagtacaaggctttcgtcaccgagcactattctaacaataaatacaagaaagaaaaacttttgctggaggatattcctcaggaatttttaaaccggcagatgaacgacagcagatatatctccaaggtggttaagggactcctgtcaaatgtggtcaggactgaggatgaacttgaggcaacgagcaagttcgtggtatcttgcacaggtggcattaccgaccgcctgaaaaaggactgggggctaaacgatgtgtggaatagcatcgtttacagtcgatttgagagactcaacggactgactaaaagcgaacatttcggccactgggagaataaggaaggtaagcgggtctttcaaacctctgtgcccatggagttgcagagggggttcaacaaaaagcgcatagaccatcgtcaccacgccatggatgctctggtgatcgcctgcgcatccagaaatattatcaactatttaaataacgaatttgcgaaatcaccaaagcagcgggaggacctcaggcagctgctttgtgataaaaatcgcattatccgaaagccctgggagacattcacccaagacgccagagctgccctggaagatgtcgttgtgagttttaagaactacgtgcgggtaataaataaaactacaaactattacgagaggtacgacgcagatggcaagaaaacgatggtccctcagaagggaaatgaaatgtgggctgtgcgcaaaccaatgcatgagggcaccatgtatgggagagttaacttgaggcggaaggccgtggtcaagctcaaagaagcactggagaacattagctcgatctgcaataaggagctacgtgactacatcaacgtgctggttgaaaaacagttcaatactaagcagcttctcgcccactttaaatccatggattatcgctggaacaagcaacatattgacaaagtggaggtatggcgattctctgacgaaaaggtccagatggtggctgcgagaaagccgctggataccagcttcgacaaagagtgtatcgcctcaattacagatacaggaatacagaagatcttgctgaattacttagagagtaaaggcggtgaccccgcaattgcttttacttccgaagggatcgccgagatgaaccagaatattgccgtgtataacgatggaaagaaacaccaacctgtcatcaaggttaggaagtctaccaaactcggcaagaaattcgctgtgggtcagataggctgcaagagcaaacagtttgtagtggcagaagccgggacgaatctgtacttcgcgatctatgaggacgaagagggaaagcggtcctacgataccattccacttaacgaggtcacagaacgcctgaagcaaggcttgtcacccgtgcctgagaaaaatgaaaaggaggttccactcaaattttacctgagccccaacgacctagtgtatgtcccgactgaagatgagatgcagatgaaggagtgtaaactgaataaggaaagaatctacaagatggtgagttctaccgggaacgagtgccatttccttccttattccgttgctagcgtgatttacaataaagtcgaatttgagtcgatgaacaagatgggaagggccctcacaggcgaaatgatcaaagcagtatgttggaagctggacgtggatcggttgggtaacatattacgagttattaaatga

SEQ ID NO: 3401 - RNA, 4452 nt, synthetic construct
  misc_feature 1..4452: note = Cas9 variant
  source 1..4452: mol_type = other RNA
atgaagaccatcctgggcctcgaccttgggacaaacagcattggatgggccaaaatatccatcgatgacaatggtaactacctgagagatattcagttgggctctaggatcattcccatgtcacaagacgtgttagggaatttcgataacggagtcactgagagtcagacggctgttcggaccggctttcgcggtctgcgacgtatcagagaaaggagcctactccggcgcgagagactgcacagggtgcttcatgtaatggggttcctgcctccacactatgactccgcaataggatggaataaggaagaaccgacaacttacggcaaatttttgaaccatggcgaacccaagctcgcctgggagcggcagggggatggatctatgcgcttcctgtttatggactcgttccacaaaatgatggaggattttgcgcctcatcagccagctctggtggccgacggtcgaaagatccccctcgattggaccttatattacctgagaaagaaagcacttacacaacctattaagaaagaagagttggcctggatcctgctaaatttcaaccagaagaggggctattaccagctccgtggggaagaggaggaagagaatccaaccaaacgggaagagtatcacgaactgaaggtcgtgggagttgaggctgcagaggaaggcaagggtgggaacacttggtacaatgtgaaacttgagaacggatggatttaccgcagatcaagcaagatccccctggacgattgggtcggcaaaacaaggccttttatagtgaccacggaatatgaggccgacggcattactttgaagaaaaataaggaaggggaggtaaaacggagtttccgagctccaggagaggacgattggggtctctggaagaagcgcaccgaatcccagctggaggcctctggcaaaacagttggggcgtttatctacgaccacttactggcagaaccggccgataagattagaggaaacttcatcaggactatcgagcggaaatattacaagcaagaactcgctgacattcttcgcgagcagagcaaatatcatgaggaactgcagtccaagaagatattggccgattgcgcagaggaactatacagatcaaatcagccccacagggacagtctgctcaaaaaggatatggtgtatctgcttctgaccgacttgatcttttaccaacgtcctctcaaaagcaagaaatctctgattgctgattgtccatacgagtattacgagtatgtcgacaaggaaacaggcgagatcaagcggcagggtataaaatgcattgccaagtccaacccctactatcaggagttccgattatggcaattcgtgctgaacctaagactctacgataggaccgaggacaaagaagtgacggcggagtatctgccttcaaaggaggactacgcccgcctttttgtctacttgaatgatcggaaagaaatcaaccaggagactctgctcaaggacttctttaagctgaaaaaggttaaacagagaagcgaaaaggatttcccagtgaggtggaattatatcgaggacaaagaaaagaaatacccctgtaacgagacacgccatgagcttctgatggcattggatcgagctgggattgaacggagttggctcgacgataccgcccgtcagtatagactgtggcacttactgtactctatcgaggtaaaggacgaagctgagagggccctacgcaagctcaaagatgacgatgaatttgtgtccgcattcctgaaggtcaaaccgtttaagaaagactatggcgcctacagcgagaaggctgtgaagaaacttttggcggttatgcggatgggatcgcactggtgcgaggatgacatttgtaaggaaactaaagagagaatagaacatatcctgcaaggcgacgtgggggagaagattaaagagaggatgaatcacacagcatattctctcggagaactgtccgatttccaggccttacctgagtggctggcttgctacgtcgtgtacggtcgacattcagaagccaccgacatcaagcactggaagacgcccgagagtcttatggcatatatcaacggctttaaacagcatagcttgcgcaatccaattgtagaacagtgtatactcgagaccctgcggacagttcacgatatctggaaggaggccgggcacattgacgaaatccatgtggagctaggaagatccatgaaatctactagcgatcaaagggctcgtatgaccgaaaacattctgcgcaatgagaacacaaatctccggatcaagtcactgcttatggaattgaaaaacgacgccgatataaaggacgtcagaccttacagtcccatgcagcaggagatcctgaggatttatgaggaaggcgcattacaggagctcactaaggaagataatgactacgaggaaatcttcaaaatttccaagatgccacaacccagcgcgaaagagctgcttaagtataaactgtggttggagcagaagtaccgatctccttataccggtaaaccaatctcactcagtaagctgtttacaagcgcttaccagatagaacacattatcccgcagtcccggtacttcgatgactcttttaacaataaggtgatttgcgagtcggaagtcaacgccctaaaagggaacatgctgggctatgagttcatcaagaatcatggaggcgagatagtgcactgtaccctcctgggggatgttaaagtgcaaaacgaaagcgagtacaaggcattcgtaactgaacactatgccaataacaaatacaagaaggagaaacttttgatggaagacatcccccaggactttctgaatcgccatttaaacgattccagatatatttcaaaggtcgtgaaaacgctcctgagtaatatcgttaggacagaggacgagatggaaaccacttctaagttcgtggtcagctgcaccggaggtattacagatcggcttaaaaaggactggggcctgaacgatgtgtggaactccatcgtatactcacgatttgagagactaaatgaactcaccaagagcgacgctttcgggcgctgggagaataaagaaggaaagagggtgtttcagacttctgttcctctggagttgcaacgtggcttcaacaaaaagcggatagatcacagacatcacgccatggacgcactggtcattgcttgtgcctccaggaatatcatcaactatttaaataacgagagtgcgaacagccccaaaaagcgcgaagatctccgacagcagctgtgcgacaagaatagaattatccggaaaccatgggagtcttttacacaggatgccagggctgcacttgaagacgtggtggtctccttcaagaactacgttcgcgtgattaataaagccacgaactactatgagcgttacgacgctgatggtaagaaaaccataactaagcaaaagtcaagagaaatgtgggccgtgcggaaacctatgcataaggagacagtatttgggcacgtcaatctgaggcgcaaagcaatcgtgaagttgaaagacgcgctcgagaacattccaagtatctgcaataaggaactgcgagattatattaacggcctagttgagagaaatttcaacaccaaacagctgcacgcccattttcggagcacagactacaggtggaataagcagaacgtggataaggtcgaagtgtggcgcttctcggacgagaaagagccccttgttgctactagaaagccgctcgatacctcctttgacgccaaaaggatcgatacgataaccgacacaggaatccagaagattctgttgaattatctggaagcaaaaggcggggatcctttaatcgctttcactccagagggaattgccgaaatgaaccaaaatatcgcactctacaacgacggcaagatgcaccagcccatactgaaggtgcggatttctgagcctaaaggtgccaagtatcagatcgggcagaccggaaacaaagctgataagttcgtagaagcgcaaaaaggcacaaatctttactttgccatctacgaggacgaggaccgtaaccgcacttataataccattcccctgaacgaagtcgcagagcgattgaagcagggtctcccacctgtgcccgaaaagaatgagaaagaagtgccactgaagttctacctaagcccgaacgatctggtctatgttcctacggaggaggaaatacttatgaaagagtgtaagctcaataaaaacagaatctacaagatggtgtcaagtacaggcaatcagtgctttttcattccctttagggtagctgtgtccatcgtcaacaagatggaatattctccactgaataaaatggagaaggccattagctccgaaatgatcaaagccgtgtgttggaagttggaggttgaccggttagggaacataatccgcgtggtcaaatga

SEQ ID NO: 3402 - RNA, 4458 nt, synthetic construct
  misc_feature 1..4458: note = Cas9 variant
  source 1..4458: mol_type = other RNA
atgaagaacatcctgggcctcgaccttgggaccaatagcattggatgggccaaaatatccatcgatgacaacggtaagtacattaaagattctatcaagctgggctcaagaattatccccatgagtcaggacgtgttgagcaatttctccaaaggggtcacattatctcaaacttcggagaggacgtcatttcggggagctcgccgactgcgtgaaagaaccctactcaggcgggagcgcctgcacagaatacttcatctgttgggcttcctccctaagcactatgaaaaggcaatcggttgggataggaacgacaataaaacatacgggaagtttattaaccatgccgagccaaaactggcgtggtgcaaggataataacggaaaaatgcggttcctgtttatggacagcttccacgatatgctcagtgaattttccgagaagcatccggagttactggctaatggcaagaaaatcccccttgactggactatttattacttgcgcaagaaagccctgtataaggcaatcaccaaagaggaactagcctggatactcctgaacttcaatcagaagcgaggctactatcagcttagaggggaagaggatagggactctgaggctaacaaaaaggaatacctggagttgaaggttattggagtggaagcaacaggtgagaaaaagggcaatgatatctggtacaacattcacctcgaaaatgggtggatctatcggcgtagctccaaaaaccctctgaacgactggttaggaaaggtaaaatcatttatcgtgaccactgacctggatgccgacggcaatccaaagaaggataaagacggtaacattaagcgcagtttcagagctcccagcgagggggattggacactcatcaaaaagaggaccgagtctcttctggaaaattccggacagacggtcggccaatttatatacaaccacattttggaggaaccttcagccaaaatccggggcaatttcatacgaactattgagcgcaagtattacaaggacgaactaaaagcgatcctggagaagcagaaagagtttcatcacgaactcagcagtgagtctctgcttaccgaatgtgcaaaggagctgtataaaagaaacatcgcccatcaggaagtgttgctcaagaaggggatgattcacctgttactgaatgatatcctattctaccagaggccactcaaaattaagaaatccctgatagacaactgcccctatgagaattacaagtacgttgataaaaagagcggagacatcaaagtgaagtcgattaagtgtatcgctaaatctaaccctttctttcaagagttccggctttggcagtttgtctccaatttgcgcctgtatagaaagtcagatgacaaagacgtgacaagtgaacacctcgtaactaccgatgactacgccaacctgttcacatatcttaataacaggaaggatatcaaacagagcgttctgttgaaggagtactttaagattaaaaaggtgaaaaccataaatggtgcagaatatccagtccgttggaactacatcgacgatgacaacaagacgtatccgtgcaatgagactcggtacgatattctccatgctctgtccaaaacagagttaaagtctgaatggctgacccccgagcgaacttacagactatggcacctcctgtatagcatcgaatcaaaggaggaaaccaaaaaggcccttaacaaattgaatctgagtgacgatttcacagaggcgtttctcacgattaagcctttcaaaaaggagtacggctcctatagcgaaaaggccatcaaaaagctgttatctctgatgaggatggggtacctttggtcagaggacgaagcaataaaacaggtgggagctgagatcgaaaagaccattgagggcgagttgccagattatgtgctccaacgcctggaaaaatcacagcataactacaataagatcagcgacttttccggtctacccctgtggctcgcctcttatattatctacgggcggcactcggaggctaaagaaataattcattgggataaccctgagagcatgatggcctacatcaaggacttcagacagcactccatgaggaatccaattgtcgaacaatgtgttctggagacacttcgcactgtgcacgacatctggaaggagataggccatatcgatgaaattcacatcgagttgggacgagaaatgaaatcaaccagtgagcagcggaaggcaattacacagaacgtactgcataatcagaacactaatatccgtataaaattactcctgcaagagcttaagaacgacaataacattaccggcgtgagaccctattctccgatgcagcaggaaatcctgaggatctacgaggaaggggccttgcagggactcacaaaagaggataaggactataatgatattctgaagatcagccaaaccgctcagcctacttccaacgaactaacgcgctacaaactgtggctcgagcagaagtatcggtcaccctacacaggtaaagcgattagcctgtctaaactttttacctccgcatatcagatagagcacgtcatcccacaaagtagatacttcgacgatagcttgtctaacaaagtgatttgcgaatccgaggttaatactctgaagaaggccatgttaggcatggaatttatcaaaacctgtgggggacagaaggtgcactgcacactcctgggcgacgtcgagatttacaacgaagaggattataaggctttcgtgaatgagcattactcaaacaataggaccaagcgaaacaaacttctgatggaagacatccctcaggagttcataaatcgccagctaaacgatagtcggtatatcagcaagatggtaaagcaactcctgtcggccattgttagaggtcaggaagaggtggaagcaacttccaaatttgtcatcccctgtacagggggcattacggacaggttgaagaaagattggggactgaatgacatctggaacaatttagtgtctccacgtttccagcgcatgaacgccctcaccggcagcgagtactttgggcactgggagaataaggaaggaaaacgggtcttccaaactacaatgcccatacagctgcagcagggtttttcaaagaagagaattgaccataggcaccatgctatggatgcccttgtgatcgcatgcgcgagtcgaaacatcatttcctatctgaataacgagaccgctcaagacacagaacggcgcagagatttgaggcagaaactctgtgacaagggcgggtctgttcggaaaccttgggatagcttcactcaggacacccagtacgccctgaaggatataatcgtgacgtttaaaaactatgtacgaattatcaataaggcaaccaactactacgagcactataaaacagacggaaagaagggcatgatttcccaaaaaggtgatgagctatgggccatcagaaagccaatgcacaaagaaactgtcttcgggaaggtgaatctgcgcaggccgaaacgtgtttcacttagcaaggctatagacagtgtggatgtcatctgcaaccggaagctcaaaaagtacattaaagccagactgaatgagggcttgcagaagaaacagatcctgaacatttttaaggaagtgaataacgtatgggagggaatcgacgtgaataagatagacatttgggaaatgtctaacgataaagagcccatggttgcaaccaggaagcagttagacacatccttcgatgagaaaaagatccgcagcatctcggacactggcattcagaaaatcctcctgaattatcttataaccaagaacaataaccctgaactggcttttacgccagaggggattcaagaaatgaatagtaacatctctgagtacaatgatcataagaaacaccagcccatttataaggtccgagtgacagaacctttgggagccaaatacccaatcggcaccatgggtaacaaccccaagaaattcgtggaggcgcaagccgggactaatctctattttgctatatacgaggacaaggaaggaaacagaaattacgatacaattccgctgaacatcgcagccgagcggctaaatcagcagctgagtcctgtcccagaaaccaacgagaataacactccccttaaattctatctctcccctaatgacctggtttacgtgcccagcgaagaggagaggcattctggcaacaatatccagttggataagaaccgcatttataagatggtgagctccacctcaaaacaatgcttctttatccaccatcgtgtagctattagtttagtcgacaagaaagagttcagcgcccagaataagatggaaagatctatagataacgaacaggtgatgatcaaatccgtttgttggaagctgattacagaccggctcggtaatatcatcaaggtgattaaatga

SEQ ID NO: 3403 - RNA, 4458 nt, synthetic construct
  misc_feature 1..4458: note = Cas9 variant
  source 1..4458: mol_type = other RNA
atgaagaacatcctgggcctcgaccttgggaccaatagcattggatgggccaaaatatccatcgatgacaacggtaagtacattaaagattctatcaagctgggctcaagaattatccccatgagtcaggacgtgttgagcaatttctccaaaggggtcacattatctcaaacttcggagaggacgtcatttcggggagctcgccgactgcgtgaaagaaccctactcaggcgggagcgcctgcacagaatacttcatctgttgggcttcctccctaagcactatgaaaaggcaatcggttgggataggaacgacaataaaacatacgggaagtttattaaccatgccgagccaaaactggcgtggtgcaaggataataacggaaaaatgcggttcctgtttatggacagcttccacgatatgctcagtgaattttccgagaagcatccggagttactggctaatggcaagaaaatcccccttgactggactatttattacttgcgcaagaaagccctgtataaggcaatcaccaaagaggaactagcctggatactcctgaacttcaatcagaagcgaggctactatcagcttagaggggaagaggatagggactctgaggctaacaaaaaggaatacctggagttgaaggttattggagtggaagcaacaggtgagaaaaagggcaatgatatctggtacaacattcacctcgaaaatgggtggatctatcggcgtagctccaaaaaccctctgaacgactggttaggaaaggtaaaatcatttatcgtgaccactgacctggatgccgacggcaatccaaagaaggataaagacggtaacattaagcgcagtttcagagctcccagcgagggggattggacactcatcaaaaagaggaccgagtctcttctggaaaattccggacagacggtcggccaatttatatacaaccacattttggaggaaccttcagccaaaatccggggcaatttcatacgaactattgagcgcaagtattacaaggacgaactaaaagcgatcctggagaagcagaaagagtttcatcacgaactcagcagtgagtctctgcttaccgaatgtgcaaaggagctgtataaaagaaacatcgcccatcaggaagtgttgctcaagaaggggattatccacctgttactgaatgatattctattctaccagaggccactcaaaataaagaaatccctgatcgacaactgcccctatgagaattacaagtacgttgataaaaagagcggagacattaaagtgaagtcgatcaagtgtatcgctaaatctaaccctttctttcaagagttccggctttggcagtttgtctccaatttgcgcctgtatagaaagtcagatgacaaagacgtgacaagtgaacacctcgtaactaccgatgactacgccaacctgttcacatatcttaataacaggaaggatattaaacagagcgttctgttgaaggagtactttaagatcaaaaaggtgaaaaccataaatggtgcagaatatccagtccgttggaactacattgacgatgacaacaagacgtatccgtgcaatgagactcggtacgatatcctccatgctctgtccaaaacagagttaaagtctgaatggctgacccccgagcgaacttacagactatggcacctcctgtatagcattgaatcaaaggaggaaaccaaaaaggcccttaacaaattgaatctgagtgacgatttcacagaggcgtttctcacgatcaagcctttcaaaaaggagtacggctcctatagcgaaaaggccatcaaaaagctgttatctctgatgaggatggggtacctttggtcagaggacgaagcaataaaacaggtgggagctgagattgaaaagaccatcgagggcgagttgccagattatgtgctccaacgcctggagaaaagtcagcataactacaataagattagcgacttttccggtctacccctgtggctcgcctcttatatcatatacgggcggcactcggaagctaaagaaattatccattgggataaccctgagagcatgatggcctacattaaggacttcagacagcactccatgaggaatccaatcgtcgaacaatgtgttctggagacacttcgcactgtgcacgacatatggaaggagatcggccatattgatgaaatccacattgagttgggacgagaaatgaaatcaaccagtgagcagcggaaggcaatcacacagaacgtactgcataatcagaacactaatatacgtattaaattactcctgcaagagcttaagaacgacaataacatcaccggcgtgagaccctattctccgatgcagcaggaaatcctgaggatttacgaggaaggggccttgcagggactcacaaaagaggataaggactataatgatatcctgaagattagccaaaccgctcagcctacttccaacgaactaacgcgctacaaactgtggctcgagcagaagtatcggtcaccctacacaggtaaagcgataagcctgtctaaactttttacctccgcatatcagatcgagcacgtcattccacaaagtagatacttcgacgatagcttgtctaacaaagtgatctgcgaatccgaggttaatactctgaagaaggccatgttaggcatggaatttattaaaacctgtgggggacagaaggtgcactgcacactcctgggcgacgtcgagatctacaacgaagaggattataaggctttcgtgaatgagcattactcaaacaataggaccaagcgaaacaaacttctgatggaagacatacctcaggagttcatcaatcgccagctaaacgatagtcggtatattagcaagatggtaaagcaactcctgtcggccatcgttagaggtcaggaagaggtggaagcaacttccaaatttgtcattccctgtacagggggcatcacggacaggttgaagaaagattggggactgaatgacatatggaacaatttagtgtctccacgtttccagcgcatgaacgccctcaccggcagcgagtactttgggcactgggagaataaggaaggaaaacgggtcttccaaactacaatgcccattcagctgcagcagggtttttcaaagaagagaatcgaccataggcaccatgctatggatgcccttgtgatcgcatgcgcgagtcgaaacattatatcctatctgaataacgagaccgctcaagacacagaacggcgcagagatttgaggcagaaactctgtgacaagggcgggtctgttcggaaaccttgggatagcttcactcaggacacccagtacgccctgaaggatatcattgtgacgtttaaaaactatgtacgaatcattaataaggcaaccaactactacgagcactataaaacagacggaaagaagggcatgatctcccaaaaaggtgatgagctatgggccataagaaagccaatgcacaaagaaactgtcttcgggaaggtgaatctgcgcaggccgaaacgtgtttcacttagcaaggctatcgacagtgtggatattatctgcaaccggaagctcaaaaagtacattaaagccagactgaatgagggcttgcagaagaaacagatcctgaacatatttaaggaattaaataacgtctgggagggaattgacgtgaataagatcgacatctgggaaatgtctaacgataaagagcccatggtagcaaccaggaagcagctcgacacatccttcgatgagaaaaagattcgcagcatctcggacactggcatacagaaaattctgcttaattatctgatcaccaagaacaataaccctgaattggcttttacgccagaggggattcaagaaatgaactcaaatatctctgagtacaatgatcataagaaacaccagcccatatataaggtgcgagttacagaacctctcggagccaaatacccaattggcaccatgggtaacaaccccaagaaattcgtcgaggcgcaagccgggactaatctgtattttgctatctacgaggacaaggaaggaaaaagaaactacgatacaatcccgctaaatattgcagccgagcggctgaaccagcagcttagtcctgtgccagaaaccaatgagaacaatactcccctcaagttctatctgtcccctaacgacttggtgtacgtccccagcgaagaggagaggcattctggcaataacatccagttagataagaatcgcatttataaaatggttagctccacctcaaagcgttgcttctttatacaccatagagtggctatcagtctggtggacaaaaaggagttcagcgcccaaaacaaaatggaacggtctattgataatgaacaggtaatgatcaagtccgtctgttggaagctcatcacagacaggctgggtaacattataaaagtgatcaagtga

SEQ ID NO: 3404 - RNA, 4458 nt, synthetic construct
  misc_feature 1..4458: note = Cas9 variant
  source 1..4458: mol_type = other RNA
atgaagaacatcctgggcctcgaccttgggaccaatagcattggatgggccaaaatatccatcgatgacaacggtaagtacattaaagattctatcaagctgggctcaagaattatccccatgagtcaggacgtgttgagcaatttctccaaaggggtcacattatctcaaacttcggagaggacgtcatttcggggagctcgccgactgcgtgaaagaaccctactcaggcgggagcgcctgcacagaatacttcatctgttgggcttcctccctaagcactatgaaaaggcaatcggttgggataggaacgacaataaaacatacgggaagtttattaaccatgccgagccaaaactggcgtggtgcaaggataataacggaaaaatgcggttcctgtttatggacagcttccacgatatgctcagtgaattttccgagaagcatccggagttactggctaatggcaagaaaatcccccttgactggactatttattacttgcgcaagaaagccctgtataaggcaatcaccaaagaggaactagcctggatactcctgaacttcaatcagaagcgaggctactatcagcttagaggggaagaggatagggactctgaggctaacaaaaaggaatacctggagttgaaggttattggagtggaagcaacaggtgagaaaaagggcaatgatatctggtacaacattcacctcgaaaatgggtggatctatcggcgtagctccaaaaaccctctgaacgactggttaggaaaggtaaaatcatttatcgtgaccactgacctggatgccgacggcaatccaaagaaggataaagacggtaacattaagcgcagtttcagagctcccagcgagggggattggacactcatcaaaaagaggaccgagtctcttctggaaaattccggacagacggtcggccaatttatatacaaccacattttggaggaaccttcagccaaaatccggggcaatttcatacgaactattgagcgcaagtattacaaggacgaactaaaagcgatcctggagaagcagaaagagtttcatcacgaactcagcagtgagtctctgcttaccgaatgtgcaaaggagctgtataaaagaaacatcgcccatcaggaagtgttgctcaagaaggggatgattcacctgttactgaatgatatcctattctaccagaggccactcaaaattaagaaatccctgatagacaactgcccctatgagaattacaagtacgttgataaaaagagcggagacatcaaagtgaagtcgattaagtgtatcgctaaatctaaccctttctttcaagagttccggctttggcagtttgtctccaatttgcgcctgtatagaaagtcagatgacaaagacgtgacaagtgaacacctcgtaactaccgatgactacgccaacctgttcacatatcttaataacaggaaggatatcaaacagagcgttctgttgaaggagtactttaagattaaaaaggtgaaaaccataaatggtgcagaatatccagtccgttggaactacatcgacgatgacaacaagacgtatccgtgcaatgagactcggtacgatattctccatgctctgtccaaaacagagttaaagtctgaatggctgacccccgagcgaacttacagactatggcacctcctgtatagcatcgaatcaaaggaggaaaccaaaaaggcccttaacaaattgaatctgagtgacgatttcacagaggcgtttctcacgattaagcctttcaaaaaggagtacggctcctatagcgaaaaggccatcaaaaagctgttatctctgatgaggatggggtacctttggtcagaggacgaagcaataaaacaggtgggagctgagatcgaaaagaccattgagggcgagttgccagattatgtgctccaacgcctggaaaaatcacagcataactacaataagatcagcgacttttccggtctacccctgtggctcgcctcttatattatctacgggcggcactcggaggctaaagaaataattcattgggataaccctgagagcatgatggcctacatcaaggacttcagacagcactccatgaggaatccaattgtcgaacaatgtgttctggagacacttcgcactgtgcacgacatctggaaggagataggccatatcgatgaaattcacatcgagttgggacgagaaatgaaatcaaccagtgagcagcggaaggcaattacacagaacgtactgcataatcagaacactaatatccgtataaaattactcctgcaagagcttaagaacgacaataacattaccggcgtgagaccctattctccgatgcagcaggaaatcctgaggatctacgaggaaggggccttgcagggactcacaaaagaggataaggactataatgatattctgaagatcagccaaaccgctcagcctacttccaacgaactaacgcgctacaaactgtggctcgagcagaagtatcggtcaccctacacaggtaaagcgattagcctgtctaaactttttacctccgcatatcagatagagcacgtcatcccacaaagtagatacttcgacgatagcttgtctaacaaagtgatttgcgaatccgaggttaatactctgaagaaggccatgttaggcatggaatttatcaaaacctgtgggggacagaaggtgcactgcacactcctgggcgacgtcgagatttacaacgaagaggattataaggctttcgtgaatgagcattactcaaacaataggaccaagcgaaacaaacttctgatggaagacatccctcaggagttcataaatcgccagctaaacgatagtcggtatatcagcaagatggtaaagcaactcctgtcggccattgttagaggtcaggaagaggtggaagcaacttccaaatttgtcatcccctgtacagggggcattacggacaggttgaagaaagattggggactgaatgacatctggaacaatttagtgtctccacgtttccagcgcatgaacgccctcaccggcagcgagtactttgggcactgggagaataaggaaggaaaacgggtcttccaaactacaatgcccatacagctgcagcagggtttttcaaagaagagaattgaccataggcaccatgctatggatgcccttgtgatcgcatgcgcgagtcgaaacatcatttcctatctgaataacgagaccgctcaagacacagaacggcgcagagatttgaggcagaaactctgtgacaagggcgggtctgttcggaaaccttgggatagcttcactcaggacacccagtacgccctgaaggatataatcgtgacgtttaaaaactatgtacgaattatcaataaggcaaccaactactacgagcactataaaacagacggaaagaagggcatgatttcccaaaaaggtgatgagctatgggccatcagaaagccaatgcacaaagaaactgtcttcgggaaggtgaatctgcgcaggccgaaacgtgtttcacttagcaaggctatagacagtgtggatgtcatctgcaaccggaagctcaaaaagtacattaaagccagactgaatgagggcttgcagaagaaacagatcctgaacatttttaaggaattaaataacgtgtgggagggaatcgacgtaaataagatagacatttgggaaatgtctaacgataaagagcccatggtggcaaccaggaagcagctcgacacatccttcgatgagaaaaagatccgcagcatctcggacactggcattcagaaaatcctgcttaattatctgataaccaagaacaataaccctgaattggcttttacgccagaggggattcaagaaatgaatagtaacatctctgagtacaatgatcataaggaacaccagcccatttataaagttcgagtcacagagcctctcggagccaagtacccaatcggcaccatgggtaacaaacccaagaaattcgtggaggcgcaagccgggactaacctgtattttgctatatacgaagacaaggagggaaatagaaactacgatacaattccgctaaatatcgcagccgaacggctgaaccagcagcttagtcctgtgccagagaccaatgaaaacaatactcccctcaaattctatctgtcccctaacgacttggtctacgttcccagcgaggaggaaaggcattctggcaataacatccagttagataagaatcgcatttataagatggtgagctccacctcaaaacaatgcttctttatccaccatcgtgtggctattagtctggtagacaagaaagagttcagcgcccagaacaagatggaaagatctatagataatgagcaggtcatgatcaaatccgtgtgttggaagctcattacagaccggctgggtaacatcatcaaggttattaaatga

SEQ ID NO: 3405 - RNA, 4461 nt, synthetic construct
  misc_feature 1..4461: note = Cas9 variant
  source 1..4461: mol_type = other RNA
atgaccaagatcctgggcctcgaccttgggacaaacagcattggatgggccataagagaggatgaaaatgagggtgtgaaccagatcattgacaaaggcgtcaggatcttctccgaaggggttaagtctgagaatggaaaagaaatttcacgggctgcagagcgcactgcctaccgaagtgcgcgtaagatcaaatatagaaggaagctgcggaagtacgagacgttgaaagtgttaagcgtaaacggcatgtgccccctgtccgtggaagaggtcgaacaatggaagaaatctggttttaaggagtatcctctaaatccagagttcctcaactggctgcgcaccaatgaagataaaaacataaatccgtactttttcagagacaaggcttcgaagcagaaagtgacactttttgagctggggagggccttgtatcacatcgcacagcggcgcggattcctctcaaaccgactggatcagagcgccgaaggcgtttttgaggaacataatccccaaattcagaacctgatcgaggacctcgatagttccaatactattttaaacgagctgaaggaatactatatcaatcttggcataattgacgagtctgaaaagagcgggttcaagaaagatttggacgagggagaaaagaacctgaaaaagctatacacctccctcgtgtcaatcacaaagaaaaacgctaatgatattgagacctgtaagcaggagctgatcgcaagacttaacaaaaaggaagacctgggtaaagtcaagggcgagatcaaggatattagtcaggccatgttggacgggaattttaaaactctcggacaatacttctttagcctgtataacaagacaaggatacggaatcagtacacctctcgtgaggagcactatttagaagagttcatcattatctgccagacgcagggcatagaggaaattaacactaatgagaaactgcctgaaaagaaatttaccggtctcgctaaggacctttaccgcgccatcttcttccaaagaccactgaagtcccagaaagggttgatcggaaagtgttcatttgagaaaaacaagagtaggtgcgcggtgagccatcccgattatgaggagttccggatgtggtcttacctaaatacaattaaaatcggcactcagtccgaaaagaccctgcgatttctcacactggaagagaaacttaaactggtacctaagttctatcgcaaaaacgactttaatttcgaagttttggcaaaggagctcgtggagaaaggcgccagctttgggtactacaagtcgtctaaaaagaacgagttcttttattggttcaattacaagccaaccgattccgtctcagcttgtgtggtgagtgccagcctggaaaacgcaattggaaaagactggaagacgaaaacttttgaatatcaaacatccaataccaagaaagaggaagtcactaagtctgttaactacaaggatttatggcatctgctaagcgtggctacatcagacacctatctctacgatttcgccatagagaaactgaaacttgagcccaaaaacgcgaaggcctttagtaaaacgaagttgaagaaagacttcgcatccctgagcctcgctgccatcgctaagattctgccttatcttaaacagggtctgttgtactctcacgccgtattcatcgcaaatatcgaaaacattgtggatgccgacatatggaaggataaagagcagcagaagtttatccaatcaaagattgtcgacctcatcgacaattacctggtggaaaagagtaagttagagattatcaactgcctgctaaaaatatataataccgaagatatcgagggcagaaaggtttactatagcaaagaggctgaatccctcttcgaggcggacctgaggaagaaacttgtgccattttacaaggcaaacacaatttctgaacagcaggagcaggagatcattttcaaggatttgtttccggtcctgatcgaacaactcaaaaagcaggagttcataaaaattgtgcggctggacaagaaaatcgaagcctttttaaagggggagaatgaagagggacagattttctgtaactatcccgagaagtttaaaaagctgtaccacccttcggatatcgaagtattcaaaaagaaaataatcaaggacgagtggggcaatgaaaaggttgtgcttggtagcccattgactacctccattaaaaaccccatggctatgcgcgccctccaccagctgagaaaggtcctaaatacactgatcctcgatgggcaaattgacgagaaaactaggatccatatagaaatggcacgtgagctgaacgatgccaataagcggaaaggcattcaggactttcagaaggagcgagaggaactttataagatctacgaagctaaaatcaaggagttgtaccaggtgaaaaccggaaaggaactgttacacgtcacagatgaggacctccaaaaattcgagtgggccctggaacagaccaaggatggcagaattatcactaaggaggaacttattaaatataagatatgggaggagcagaaccatatctgcatttacacggggaaaacaatctcaattgacagttttctgggaggtaatcctaagttcgacatcgaacacaccataccaaggtctatcagccaagataactccttgatgaacaaaactctctgtgacaaggatttcaatcgctcagtgaaaggcaagaagatgcccgttgagctgagcaactataatgaaattctaccgcggatcgcacactggaaaaagcaggcggaggaactgaccagacagattgagacaatctctaggtccataaaaagtgctgccaccaaggtggcaaaagacaagaacattcgcaagcgacattacctcactctgaaacgggattatatccaggggaagtacgaccgttttacatggggagagcctaaagtaggcttcaagaatagccaaatccccgatacgggtattataaccaaatatgcccaggcttaccttaagtcttactttaagagagtcgaatccgtgaaagggggcgccgttgcagagttcaggaagttgtggggaatccaggaatcatttattgacgagaacggcttcaaacactttaaggaaaaagatcgcagtaagcatactcaccatacaatcgacgctattaccatcgcctgcatgccaaaggataaatatgacctgttagcgcacgcctggcggctcgaggatgagcagaataagaaagctgcaaaggccctgatagaacaagctaaaccttggaagacattcaaagaggacatcgaaaagattgaggccgaaatccttgtgagccactttactcccgacaacgtcaagaaacaggcaaagaaaattctgagagtgagggggaagaaacagtacgtagcggagatcgagcgaaatgccaacggaaaggctataccaaagaaagatgcctcgggtaagattatctataaactaaatgaacgcggcaacaagatccccattctccagcaaggggacaccatccggggatccctgcatcaggattctatatacggcgcaattaaaaatcctttgaacacgaatgagatcagatatgtgattaggaaggacctggagagcttaaaggctaacgatatcgaaaacatagttgacgagaatgtcaaagccaaggtgaaagaagcagtggccaacaagattctcctgatctcaagtaatccacagcagaaaaacaagttcgctgagggtaagaatgtctggatgaacgaagagaaaaagatcccgattaataaagttcgtatctacgcgaactccgtgaagaatcccattgaaatcaaaaagcactctacccttagcaaatccaagcatgagcacaagcaaacagtgtatgggcagaacgatgagaattacgccatggcactgtacgaattggacggcaaacgcgagtttgaactcataaacaatttcaacctggctaagctactgaaacagggacaaggctattaccctcttcacaaggagaaagaaattaaggggaagaaagtactcatcccaatcgagaagcggaataacagagatgtcgtgctgaaaaggggacagcaggttgtgttctatgacaagactgtcgaaaattcaaaagatattagcgaaatagtggactttcgaggccgggtttacttgatcgagggtctgaccattcagcgccaaaaggacaagaaaacagggaaggtgaacgaatatggaatcattcagttaagatacttcaaagaggccaggaagagtgaagagatctctaaagattcctttaagcccgacggcgagttcaagataaacgaaaataaacctactcggaagatgaaccataatcagtttaccgccttcgtagagggtatcgattttaaagtcctcccaagcggcaagttccagaaaatttga

SEQ ID NO: 3406 - RNA, 4464 nt, synthetic construct
  misc_feature 1..4464: note = Cas9 variant
  source 1..4464: mol_type = other RNA
atgaagaacgtgctgggcctcgaccttgggagcaattccgtcggatgggccctggttaaaaccgaggataacggtaatcccatcggctctattaagatggggtcaagaataatccctatgagtcaggacattttgggcagcttcgaaaaaggagatacagtgtcccaaactgctcagaggacgttataccggggtaagcgccgactgatcgagcgtcacgtactaagaagggaacggctctgccgcgtgctgcatattatgaactttcttccagaccacttcgataaactgttggggtgggacaagaccgataataagacatatggaaaatttatcgacgattctgagccgaagctcgcatggagacagaacaaaaatgaaaaggagaaaatggagttcgtctttatggactcgttccatgaaatgctgtcagattttgccaagcaccagccccaactgatagcgaacggcaagaaagtgcctctcgactggactatctactatttaaggaagaaagctctgacccagcttattagcaaggaggaattggcctggatcctgctaaatttcaacaaaaagcggggctactatcagctccgcggggaggaggaagaggaacagccaacaaagaaggaggaatacaaggttctgaaagtgattagtgtcgatgcagacgagggacaaaagggtaatggcatctggtataacatacatcttgaggacgggggaatttacaaacgaaagtccgatacacccctgtacgactgggtgggcaaaactttgcagctcatcgtagttacaatttatgaaaaggatggtaagacccctaaaatctttgactctgggaagcagaatccaagctacagactgcccaaagaggatgactggggattaatcaagaaaaggacggaatcccagattcaatcaagtggcaagactgtgggcgccttcatatatgataacatcctgagcaagcctgacgataaaattcgggggaatctcgtccgtaccatcgagcgcaagtactataaaaaggaacttatagagattctgcagcagcaagctaaataccacgacgagttgcacaaccagaacctactggaatcttgtgcaaaggagctctatgcccataatgatgtgagatacaacgaagtggtcaagtccaatatgatccatctgcttgttgacgacatcatcttttaccagaggccactgaaatcaaagaaaagtttgattgctaactgcaagtatgagagctacgaatatgtggataaagagacaggagaggtaaaggaaatgccgattaaatgtatagccaagtctaatccctactatcaggagttccggctctggcaatttatccacaacctgcgattatccgacgtggtcactcgcgaagatgtgaccgcgcagtacctgagcacacctcaggactattgcaatctattcacctacctcaacgatagaaaggagattaaacaggacatcctgcttaaggatttctttaaaatcaagaaagttcaaattgacaaggagaaggtgttcccaatagaatggaattacatcaaagatgcaacgaagacttatccctgtaacgagacaaggtacgaattgctgtcggccctcaaacgggctggtatggacaagcagtggctggatgacacccctaatatgcagtatcgcctttggcacctgttgtactctgtcgaggaacaggaggagtccgccaaagcactcagaaagctgtatgataacgacaattttgtgtcaagtttcttaaagattaaaccatttaagaaatgctacggcgcttatagcgaaaaggccatcaaaaggctgctaactctcatgcgtatggggaaggcgtgggacgagcaagccattgatgcaaagacactgaaatgtatccagcagataatcaccggaaacattgactccaaacttaaagaaaagatcgatgactctcggtacgtattgcaccatgttagcgatttccagggcctgcccacgtacctcgcttcatatgtgatttacggtcgacacagtgaggtcaccgacatcagatgctgggatacaccgaaagacctgttaaagtttatatgtgggttccctcaacattccctgaggaatcccattgtggaacaggtcatccttgagactttgcgcgtggtttatgatatttggaaagccgagaagcacatcgacgaaatacatgtggaggtagctcgggaaatgaagctcaccgcccagcaaagaaacgaggcaaacctgaggaatctaaacaatgaagccacaaacctgcgcatcaaatacctcctggaggagcttaagaatgatacttttattaaagacgtccgaccattgagccctatgcaccaggaaaagatgcggatctatgagcaggctgtgctgggcaacttaaataaacaggataaggactacgacgatattatcaagatatctaaaaaggaacgtcccacctcagcggagctcattagatataaactgtggcttgagcaaaagtactgcagtccatacacaggaaaagcaatcagcctgtccaagttgttcaccactgcctatcagatcgaacacgttattccccagtctaggtactttgacaactcgttcaataacaaggtgatctgtgagagcgaagtcaataaagagaaggataaaatgctcggctatgaatttattaaggggcgcggaggtgaccggatatactgcacggctcatggcaaagaggtgacaatcctgaaggaggaagagtataagcagttcgtaaacgaacactacgcccataataaaagaaagagggataacctactggcagagaatattcctgaatccttctcaagtcgacaactcaacgacacccgctatatcactaaaaccattatgtctctgcttagcaacgtggttcggcagcagggggaggaggaagccacagctaagaatttgctgccatcctcaggagccgtcaccgataaattaaagaacgactggggcctcaaggatgtgtggaatactatcgtgacaccgagatttgagaggctgaacaaacttagcggtacgaatgacttcggggaaatgaaggaggaaaacggcaatcgttactttcagaccaacgtcccctctgagtacgagaaaggattcaagaaaaagcgcatagatcaccggcaccatgcaatggacgcgctggttatcgcttgcactacaagaaatatggtgaactatatttccaatgtgaacgccaatagtcctaaacaaagggaagacctacgacagctcctgtgtgataagaaccggatcattaataagccatggaacacctttacacaggacgcattgaaagccctgaacgatatcgtagtcagcttcaagaataacgtgcgcataattaatagagctactaacaggtaccaacggtatgacaaaaatggcaagaaaatgatctgctctcagaaggggaacgatatgtgggccatccgaaagtccatgcacaaagagaccgtttttggaagagtgaatttaattcgcaaggaagcactccccatagctaaagccctggacaacatctcagcgatttgtaatgcccagcttagggcttacgtcaacgatctggtggacaagcatttcaataaaaagcagttggttgcacactttaagagtctcgattataaatggaaccgtcaagacgtgagcaaggtagaggtctggatctcgtccgatgacaaaacgcctatggtggccgtgcggaagccactggatacctctttcgacaaaaagaagattgctagcatcacagacactggtatacaggccatcctactgaattaccttgagtcaaaaggcggggatgcactcgtcgcgtttgcccccgaaggcattcaggagatgaacagtaatatcgaactgtataacaatggaaaggctcataaaccgattaagaacgttagattgtccgagaccctgggtgccaaataccaggtgggggaaaggggcgcaaagaccaaaaagtacgtagtggctgacaagggaactaacttattctttgccatctatgaggatgaggaaggcaaacgctactattactctgtccctctccgagaggcaatagaaagacaaaagcagaaactgagcccagtgcccgagtataatgaaaagggggttgcccttaaattctacctgtcccctaacgacttggtgtatgtccccaccgaggaggaacggacgatgggaacatgccacattgataagaccaggatctacaagatggtgtcaagcagtgagaatcgctgttgcttcgttccatctactatcgctaaagtgattgcggacaaggtcgaactcctgtcccacaacaaaatcgagaaggccataacaggcgaaagcattaaagaggtatgttggaagctaaaggtggatcgtctgggtaatatccttaacgttattaaatga

SEQ ID NO: 3407 - RNA, 4464 nt, synthetic construct
  misc_feature 1..4464: note = Cas9 variant
  source 1..4464: mol_type = other RNA
atgaagaacgtgctgggcctcgaccttgggagcaattccgtcggatgggccctggttaaaaccgaggataacggtaatcccatcggctctattaagatggggtcaagaataatccctatgagtcaggacattttgggcagcttcgaaaaaggagatacagtgtcccaaactgctcagaggacgttataccggggtaagcgccgactgaccgagcgtcacgtactaagaagggaacggctctgccgcgtgctgcatatcatgaactttcttccagaccacttcgataaactgttggggtgggacaagacagataataagacttatggaaaatttattgacgattctgagccgaagctcgcatggagacagaacaaaaatgaaaaggagaaaatggagttcgtctttatggactcgttccatgaaatgctgtcagattttgccaagcaccagccccaactgatcgcgaacggcaagaaagtgcctctcgactggaccatatactatttaaggaagaaagctctgacacagcttatcagcaaggaggaattggcctggattctgctaaatttcaacaaaaagcggggctactatcagctccgcggggaggaggaagaggaacagccaaccaaaaaggaggaatacaaggttctgaaagtgatcagtgtcgatgcagacgagggacaaaagggtaatggcatttggtataacatccatcttgaggacgggggaatatacaaacgaaagtccgatattcccctgtacgactgggtgggcaaaactttgcagctcatcgtagttacaatttatgaaaaggatggtaagacccctaaaatctttgactctgggaagcagaatccaagctacagactgcccaaagaggatgactggggattaatcaagaaaaggacggaatcccagattcaatcaagtggcaagactgtgggcgccttcatatatgataacatcctgagcaagcctgctgacaaaattcgggggaatctcgtccgtaccatcgagcgcaagtactataaaaaggaacttatagagattctgcagcagcaagcaaaataccacgatgagttgcacaaccagcatctactggaatcttgtgccaaggagctctatgctcacaacgacgtgagatacaatgaagtggtcaagtccaacatgatccatctgcttgttgatgacatcatcttttaccagaggccactgaaatcaaagaaaagtttgattgacaattgcaagtatgagagctacgaatatgtggataaagagacaggagaggtaaaggaaatgccgattaaatgtatagccaagtctaacccctactatcaggagttccggctctggcaatttatccacaatctgcgattatccgacgtggtcactcgcgaagatgtgaccgcgcagtacctgagcacacctcaggactattgcaacctattcacctacctcaatgatagaaaggagattaaacaggacatcctgcttaaggatttctttcaaatcaaaaaggttcagattgacaaagagaaggtgttcccaatagaatggaactacatcaaggatgcaacgaaaacttatccctgtaatgagacaaagtacgaattgctgtcggccctcaaaagggctggtatggacaagcagtggctggatgacacccctaacatgcagtatcggctttggcacctgttgtactctgtcgaggaaaaagaggagtccgccaaggcactccgcaagctgtatgatgacgacaattttgtgtcaagtttcttaaaaattaagccatttgaaaaatgctacggcgcttatagcgagaaggccatcaaaagactgctaactctcatgaggatggggaaggcgtgggatgaacaagccattgacgcaaagacactgaaatgtatccagcagataatcaccggaaacattgattccaaacttaaagagaagatcgacgattctcgttacgtattgcatcacgttagcgacttccagggcctgcccacgtacctcgcttcatatgtgatttacggtcggcatagtgaagtcaccgatatccgatgctgggacacaccgaaagatctgttaaagtttatatgtgggttccctcaacactccctgagaaatcccattgtggagcaggtcatccttgagactttgagggtggtttatgacatttggaaagccgaaaagcatatcgatgagatacacgtggaagtagctcgcgagatgaagctcaccgcccagcaacggaacgaagcaaatctgagaaacctaaacaatgaggccacaaacctgaggatcaaatacctcctggaggaacttaagaatgacacttttattaaagatgtccgcccattgagccctatgcaccaggagaagatgcgaatctatgaacaggctgtgctgggcaacttaaataaacaggacaaggactacgatgacattatcaagatatctaaaaaggagcggcccacctcagcggagctcattcgttataaactgtggcttgaacaaaagtactgcagtccatacacaggaaaagcaatcagcctgtccaagttgttcaccactgcctatcagatcgagcatgttattccccagtctagatactttgataactcgttcaataacaaggtgatctgtgaaagcgaggtcaataaagaaaaggacaaaatgctcggctatgagtttattaaggggaggggaggtgatcgcatatactgcacggctcacggcaaagaggtgacaatcctgaaggaagaggaatataagcagttcgtaaacgagcattacgcccacaataaacggaagagagacaacctactggcagaaaatattcctgagtccttctcaagtaggcaactcaacgatacccgatatatcactaaaaccattatgtctctgcttagcaatgtggttcgccagcagggggaggaagaggccacagctaagaacttgctgccatcctcaggagccgtcaccgacaaattaaagaacgattggggcctcaaggacgtgtggaatactatcgtgacaccgcggtttgaaagactgaacaaacttagcggtacgaatgatttcggggagatgaaggaagagaacggcaataggtactttcagaccaacgtcccctctgagtacgaaaaaggattcaagaaaaagcgtatagaccaccgccatcacgcaatggacgcgctggttatcgcttgcactacacggaatatggtgaactatatttccaatgtgaacgccaatagtcctaaacaaagagaggatctaaggcagctcctgtgtgacaagaaccgaatcattaataagccatggaacacctttacacaggatgcattgaaagccctgaatgacatcgtagtcagcttcaagaacaacgtgcggataattaatcgcgctactaacagataccaaaggtatgataaaaatggcaagaaaatgatctgctctcagaaggggaacgacatgtgggccatccggaagtccatgcataaagaaaccgtttttggacgagtgaatttaattagaaaggaggcactccccatagctaaagccctggataacatctcagcgatttgtaatgcccagcttcgcgcttacgtcaacgacctggtggataagcacttcaataaaaagcagttggttgcacattttaagagtctcgactataaatggaacaggcaagatgtgagcaaggtagaggtctggatctcgtccgacgataaaacgcctatggtggccgtgcgtaagccactggacacctctttcgacaaaaagaagattgctagcatcacagatactggtatacaggccatcctactgaattaccttgaatcaaaaggcggggacgcactcgtcgcgtttgcccccgagggcattcaggaaatgaacagtaatatcgagctgtataacaatggaaaggctcacaaaccgattaagaacgttcggttgtccgaaaccctgggtgccaaataccaggtgggggagagaggcgcaaagacaaagaagtacgtagtggctgataagggaactaatttattctttgccatctatgaggacgaagagggcaaaaggtactattactctgtccctctccgcgaagcaatagagcgacaaaagcagaaactgagcccagtgcccgaatataacgagaagggggttgcccttaaattctacctgtcccctaacgatttggtgtatgtccccaccgaggaagagagaacgatgggaacatgccacattgacaagacccggatctacaagatggtgtcaagcagtgaaaataggtgttgcttcgttccatctactatcgctaaagtgattgcggataaggtcgagctcctgtcccataacaaaatcgaaaaggccataacaggcgagagcattaaagaggtatgttggaagctaaaggtggaccgcctgggtaatatccttaacgttattaaatga

SEQ ID NO: 3408 - RNA, 4464 nt, synthetic construct
  misc_feature 1..4464: note = Cas9 variant
  source 1..4464: mol_type = other RNA
atgaagaacatcctgggcctcgaccttgggagcaattccgtgggatgggccctggtcaaagttgaggaaaacggtaatcccattggctctataaagatggggtcaagaatcattcctatgagtcaggatatcttgggatcattcgagaaaggcgacaccgtgtcccaaacagctcagaggactttataccggggtaagcgccgactgattgaacgtcacgtactaagaagggagcggctctgccgcgtgctgcatatcatgaactttcttccagcacacttcgatagactgttggggtgggacaaaacggataataagacctatggaaagtttatagacgattctgaaccgaaactcgcctggaggcagaacaagaatgagatgggcaaaatggagttcgtctttatggactcgttccatgaaatgctgtcagattttgcgaagcaccagccccaactgatcgctaacggcaaaaaggtgcctctcgactggacaatttactatttacggaagaaagccctgactcagcttatcagcaaggaggaattggcatggattctgctaaatttcaacaaaaagcgcgggtactatcagctccgaggagaggaggaagaggaacagccaaccaaaaaggaggaatacaaagttctgaaggtgatcagtgtcgatgccgacgagggtcaaaagggcaatgggatatggtataacattcatcttgaggatggaggcatctacaaaaagaaatccgacattcccctgtacgactgggtgggtaagacattgcagctcatcgtagttaccacttatgaaaaagatgggaagacacctaagatctttgactctggaaaacagaatccaagctacagactgcccaaggaggatgactggggcttagtgaaaaagaggaccgaatcccagctgcaatcaagtggcaaaacggtcggggctttcatttatgataacatactcagcaagcctgacgataagatccggggaaatcttgtgcgtactattgagcgcaaatactataagaaagaactgatcgagatattgcagcagcaagcaaagtaccacgacgagctacacaaccagaacctgctcgaatcttgtgccaaagagctgtatgctcataatgatgtgcactacaacgaagtcattaagtccaatatgatcaaccttctggttaatgacatcatcttttaccagagaccattgaagtcaaagaaaagcctcattgccaactgcaaatatgagagttacgaatatgtggataaggagaccggtgagattaaagaaatgccgataaagtgtatcgcgaaatctaatccctactatcaggagttcaggctgtggcaatttattcataacttacggctgtccgacgtagtgacacgagaagacgtcactgcacagtacctaagcacccctcaggattattgcaatctcttcacatacctgaacgaccgcaaggagatcaagcaggatatccttttgaaagacttctttaagattaaaaaggtgcaaatagataaagagaaggttttcccaatcgaatggaattacattaaggacgccaccaaatcgtatccctgtaacgagacgagatacgaactgctctctgctctgaagagggccggcatggataaacagtggcttgacgatactcctaatatgcagtatcggctgtggcacttgctctactccgtggaggaaaaggaggagtcagcaaaagctctgcgcaagttatatgacgatgacaagtttgtcacaagtttcctgaaaatcaagccatttaacaaatgctacggggcctatagcgaaaaggcgattaaaagactactcaccctgatgaggatgggaaaggcctggaatgagcaggcaatcgatgctaagactcttaaatgtatacaacagatcattacagacaacgtggactccaagttgaaagaaaagatcgatgactctcgttacgtactgcaccatgttagcgatttccagggcctccccacctacctggcctcatatgtgatttacggtcggcacagtgaggtcacggacatccagtgctgggattccccggaagacttactgaaatttatacgagatttcaagcaacatagccttagaaaccctattgtggagcaggtcatcttggagaccctcagggtggtttatgacatttggaaagctgaaaagcacatcgatgagatacatgtggaagtagcccgcgagatgaagctgacagcacagcaacggaatgaagccaacctaagaaatctgaacaatgaggctactaacctcaggatcaaatacctgcttgaggaattgaagaatgacacctttattaaagatgtccgccccctgtctccaatccaccaggagaagatgcgaatttatgaacaggcggtgttagggaacctcaataaacaggacaaggattacgacgacatcataaagattagcaaaaaggagcaccctacaaacgcagagctgatccggtataaactttggctggaacaacgttactgtagtccctacactggcaaggccatcagcttgtccaaactcttcaccacagcttatgagattgaacatatcattccacagtctagatactttgataattcgttcaacaataaggttatatgcgaggccgaagtgaacaaggcaaaaggaaatatgctgggctatgagtttatcaagaaacagggcggacagaagatttactgtacccaactaggtaaagccgtcactatcctgaaggaggaggcttataagcagttcgtgaacgaacactacgcccataacaaaaggaagcgcgacaatctcctggcagaaaacattcccgagagcttctcctcacggcagcttaatgatacgagatatatcacaaaaaccataatgagtttgctgtctaacgtagtgaggcagcaaagcgaagaggaggcgactgctaagaatttactcccttcctcaggcagcgttaccgaccgactgaaaaacgattgggggcttaaggacgtctggaatacaatcgtgaccccacgctttgaacggctgaacaagctatctggaactaatgatttcggcgagatgaaagaagagaacggtaatagatactttcagacaaacgtgccgctcgaatacgagaaggggttcaaaaagaaaaggattgaccaccgtcaccatgccatggatgcactggtcatcgcctgcacgacccgcaatatggttaactatatttccaatgctaacgccaacagtcccaagcagcgggaggacttgagacaactgttatgcgataaaaataggatcataaacaagccttgggacacttttacacaggacgcactcaaggctctgaatgatattgtggtgagcttcaaaaacaatgtacgaatcatcaaccgggccaccaatcgctaccagagatatgacaagaacggcaaaaagattatattttctcagaaaggagatgacatgtgggcgatcaggaagtccatgcacaaggaaacagtcttcggccgggtgaatcttattcgaaaagaggttctgccaatcgccaaggctttggataacatttcagcaatctgtaatgcccaactcagagcttacgtgaacgacctggtcgataaacattttaataagaaacagctagtggcccacttcaagagtctgaactataagtggaatcgccaggacgttagcaaagtggaagtatggatatcgtccgataacaagactcccatggtcgcagtgaggaaacctcttgacacctcttttgataagaaaaagatcgcgagcattacggacaccgggatccagacaattctcctgaattacttggagtcaaagggaggtgatgccagtgtggctttcgccccagagggcatccaagaaatgaactccaacatagagctgtataataacgggaaagcacataagcccattaaaaatgtccgtttatctgaaccgctcggagctaagtaccaggttggcgagcggggtgccaaaactaagaaatacgtggaagcagacaaggggaccaacctgtttttcgccatctatgaggacgaggaaggcaagagatactattacagcgtacctcttagggaggctatcgaacgccagaaacagaagctgtccccagtgcccgagtataatgaaaaaggagtcgcgttgaagttctacctctcacctaacgatctggtgtatgttcccacagaggaggaacgaactatggggacctgccacattgacaaagccagaatctacaagatggtgagcagtacggggtgttcttgctactttgtcccatccacattcgcaaaggtgatagttgataaagtggagctacaaagcctgaataagatggaaaaagctattaccgacgagtgtatcaaggaagtctgctggaaacttaaggtagatcggctcggaaacattatcaatgtgataaagtga

SEQ ID NO: 3409 - RNA, 4485 nt, synthetic construct
  misc_feature 1..4485: note = Cas9 variant
  source 1..4485: mol_type = other RNA
atgaagaacatcctgggcctcgaccttgggaccaatagcattggatgggccctgatagataacgagtcccacagaatcattaaatctggttcaaggatcattcccatggacgctgcaacaatgggcgattacgaaaaggggaatttgaaaagtgccgactggaagcggactagcttccgcggaatgcgacgtttatatgagagagcgaaactgaggcgggaacgcctactcagagtgctgaacatccttggctttctgcctgaggagttcaggcggcagatagattttgaacatcacccaggtcaattcatcgacgggaaggagccgttgattgcttaccatcacgatgaaaatggacagcgcgtcttttcctatatgtctgccttcgaggaaatgctcacggactttcgagcaacccagtcggagctggttagagatggcaggcgggtgccctacgactggacaatctattacctgcgtcataaggccctcactcagcctgtaaccaaagaggaattagcttggattatcctgaacttcaatacaaagcgcggctattaccaacttagatcagagagcgaagaggtgaccactaacaaaaatgaagagtacgcagagttgaaggtcgtgagtgttgaaaagacaggggaggataagaagagggccggatattactggtataccataacgtacgacaacgaagctgagcagaaaattacttccaccatcccaccccggcagattggtgataaggtggaactgatcgtcacaactgcccgagacaaagcgggcgagatcaagaaatctgtgcgcagccctaaggaggacgattggaccctaatgaaaaagagaacagaacacaatattgaggaagaggaatgcaccgtagggtcctatatataccagcacatcctcgcagacccaacggttaaggtgaggggaaaactggtccatactattgagcggaagttttataaaaaggagcttaaacaaatcctgaacaagcagaaggagttcatacccgaattgcaggatgcctcactctacgaggcttgtattaaagaactgtaccgcaataacgaggcccacatccagagtatcgcaaataaggactttacagatttattcgtgaacgacattatcttttatcaaagacctctgaaaagcaagaaatctaccatttccaactgcccatacgaatcatattactataagaataaggagactggcgaactcataaggaaaccgatcaagtgtattgctaaaagcaaccccctttaccaggagttccgtctgtggcagttcgtgcataatttgcggatctataagaaaagtgaagaggtctctggtcgactacaaacagatgttgacgtgaccgatagatttctgacgacccctgacgattacgccaaactcttctcctggctgaacgacaggaaggagatcaaacagaaggaacttctgcgctacgaggcgtttgggttgagcaaatcgtatggagactaccggtggaatttcgtagaagataagccatatccctgcaacgagacactccacgaaattaatagaaggatgaaatctatactgtccgacaagaaattatcaagtgaggcctaccagcagctgtggcacatcctatatagcattgatgaccctatcgagattcgcaaggcactcacttcctttgctcaaaaccaggaaatcaattctgatgacttcgtgaacgccttttaccagtatgtcccagagaagaccaaaagctacggcgcttactcagaaaaggccataaagaagctgcttcccttgatgcgacggggcagttattgggcaatcgggaatattgatgagaaaacacatcgtagactggacaacatcattaatggagtggccgatgactccatcagcacttgtaccagggaaaagctcaacaatctgacagatataaccatgtgccagggtatgccgctttggcaggcttgttacgcggtttatgaccgccactctgaggcagccgatactacgaagtgggagcaacctgacgacattgatacatacctgtcaaccgaattgaaacagcatagtctccggaaccccatcgtggagactgtcattagcgaaaccctgagagtggtaagggacatctggaaggcttatggccgaccagaggagatacacgttgaattagggcgcaacctgaaacaggatgccaagtcccggaaacaagacgcaatcagaatggccgagaatgaacagacaaacctaaggattcgtgctctcctgcaggagctttctaatcctgaatgcggagtggagaacgtccgcccccattcgccaagccagatggagttgctgaagatctacgaaaatgaggtgctccaatccaccgatgacattcccgaagagatctcaaacataattaaggatctgggcaaaactgacagtaagaaacggccttctttaagcgatatcacaaagtatagactgtggcttgaacagaaataccagtccccatacacgggtcacatcattccgttgtcaaaactcttcacccccgcctatcaaatcgagcacgtcattcctcagagcaggtactttgacgattctatatccaataaggtgatctgtgaggcagaagttaacaaagagaaggaccgaatgctggggtatgagttcattatcaataaaggcggaagtattgtgaagggcagctttgggcagcagttcaaaatctttgataaggtacaatacgaagacttcgtcaaacagcggtatgcgcataacaagactaagatgaaaaagctactgatggacgatataccagacggattcatccagcgccagctcaatgattctagatacatgtccaaaaagattatctcaattctgagtaacatcgtgagggaagacggtgagaaagaggctacaagcaagcacataattgttacctcgggcgccatcacagatcggcttaagaaagaatgggggatcaaggacgtgtggaatgatattatagcaccccgatttaaaagattgaacaagctgactgactccaataactatggaatggagaccgaaaaagagggccgccaatacttccagatcaacgtccctacggagttatctaccggtctcattaagaagaggatcgatcatcgtcaccacgccatggacgctattatcatagcctgcacaactcggaatcatgtgaactttctgaataacagcaccgcagcttcagatcagaaagacatcagaagggaccttcagcacacactgtgtactaagaccaaaacggatagtaatgggaactacgtatggcgcttcaataagccatgggacacatttacccaagatactcgacaggaattggagggcattatcgtgtccttcaaacagaacctcagaattatcaataagatgtctaactattaccaacattatgttgacggacggaagacaataagcaggcagaataaaggcgatgggtgggccattcgcaagtccctgcacaaagcgaccgtctcaggaaaggtgaacctaaaacgtagcaagactgtgggttttaaggaagccctgaatgactggagtgctatcaaagataagacctctaaagcaatcctccagaagattatcgcccagtacaaaaactatgaccccaagacaatattcaaatactttaaggatagaaatttcaaggtcgagggcaaagacttttccaagctggaagtttattacaacacgagcgataaagagccgatgtcggctcatcgggtgaacattgacaccactttcgatgagaaggaaatcaggtcaattacagacaccgggatccagaaaataatgcttaagcacttgcacacatacgacgatgcccaaggaaagactcatcctgaggcagcgttttctccagaaggcattgagaaaatgaatcagaacatccgcatgctgaatggtgggaaggaccacaaacccatcttcaaggtgcgaaaagccgaaattttaggcatgaagttcgctgtaggagagagaggccataaggataaaaagtgggtcgaggccgacaaagggaccaacctctttttcgcaatctatgaaagtgaggaaaataagcggtcctacagctctattcctctgaacgaggctatagataggcttaaacgcggagaaaatatcgccgacgagagagatcagaacggcaataagctgctatttgtgctcagccccatggacctggtttatgtgccagatcctgacgatgcacacattgacgaggtcaagggtaacaataacatcttcaaaatggtgtcctgcacggggacagaatgctactttgttcccgagacctatgccaatgtgatctgtaagggaaaagaattggagtcaaagaacaaagtagagagttacgatggcattaatataaagaaaagctgctataagatcactgtcgacaggctgggtaaggtgcggaaaattttcaagggctga

SEQ ID NO: 3410 - RNA, 4491 nt, synthetic construct
  misc_feature 1..4491: note = Cas9 variant
  source 1..4491: mol_type = other RNA
atgaagaccatcctgggcctcgaccttgggacaaacagcattggatgggccaaagtgtgcgtcgatgacaatggtaactacctgagagatataaagttgggctccaggatcattcccatgtctcaggacgttttagggaatttcgataaaggagtgactgagtcacaaacgagtgtacggaccggctttcgcggtgtgcgacgtatcagagaaaggagcctgctacggcgcgagagactccacagggtcctgcatgtgcttgggtatctgcctccacactacgactccgctattggatggaacaagaatgaaccgtctacatatggcaaattcttgaaccatggcgagcccaagctcgcatgggaacacaaggaggatgggtcgatgcggtttctgttcatggagtcatttcatgaaatgatggccgacttcgcgaaaagccagcctagtctggtttccgatggaaagaaaatcccactcgactggactatatactatttacgcaagaaagctctgtctcagcccatccgaaaggaggaacttgcctggttgctgctaaattttaaccagaagagaggttactatcaactcaggggcgaggaggatgacgataatcctaccaaatgtgaagagtactacgaactgaaggtggtcgggattgaggcagacgaagagggaaagaacggcaatacatggtataacgtgaaacttgagaatggttggatctaccggcgtcagagcaaaattccactggacgattggatcgggaaggtacgcgagttcatagttaccactgaatatgaaaaagacggaattacattgaagaaggataaaaacggcgacgtgaagagatcctttaggtcacccagtgaggatgactggggcctccggaaaaagcgaaccgaaaaactgttagatagctctaagatgacggtcggggccttcgtgtacgaccatctgctcgctgagccttccgataagatccgcggaaaatttattagaactatcgagaggaagtattacaaaaaggaactttatgcaatcctgtgcgagcagtcaaaataccacgaagagttgcggagcggtgactacctaaataagtgtgccgaggaactgtataagaacaaccagccacaccgcaatagtctcctgaccaaagatcttgcttacctgttgctcgaggacctgattttctatcaaagaccgttaaagactaaaaagtctctgatagccgaatgcccctacgaggcgtataaatacgtggacaaggaaacaggcgagatcaagaggcaggggattaaatgtatcgcaaagtccaacccttattaccaggagtttcgtctatggcagttcataagcaatctccggctgttcaacaaagccgatgacaaggaagtcaccgctgattaccttccaacacaagacgattatgttcgattgtttgcctacctgaatgacagaaaagagattaaccaggaaaccctcctgaaggagttctttaaacttaagaagatcacggtaaattcggaaaaagtgttccccatcaggtggaactatattgaggataaggagaaaaagtacccttgcaatgaaactcgccacgagctgttgctcgcactggaccgggctagaatcgatcattcttggttagaaaaaccaggacaggagtataggctgtggcacctactctactccgtggaatcaaaggaggagacaaaggaagccctgcgcaaacttaaggacgatgacgcgtttgtcgagagtttcttgaaagtgaagccctttaaacgagaatatggcgcctacagcgagaaggcaattaagaaactgctcgctgttatgcggatgggttccctgtggcgtgaaaccgatatatgtgacactacaaaggggaacatcaccaaaattttacaaggcgagatcgacgagaagctgaaagaaaagatctctgccagcgtgtcaagttacaatcagctttccgatttccagggattgccggtctggctcgcttgctatgtggtatacggcagacacagcgaggccgcagaaattcagcattggaagacgcctgagtctctgctagcctatataaacgggtttaaacaacactcactgaggaatcccatcgttgagcagtgtattctcgaaaccctgcgcacagtgcatgacatctggaaggaggtcggacacattgatgaaatccatgtggagcttggtcggaacatgaaaagtactgctgaccagagagcgaggataagcgaaaatgtcttgcgaaacgagaacaccaatctgcgcatcaagtccttactcctggagcttaaaaacgatccaaatattaaggacgtgcggccttactctcccatgcagcaagaaaaactgagaatctatgaggaaggcgttttgcaggagctcacaaaggatgacaaggatttcactgaaattaccaaaatctcgacaatggcacagccaagcgccaaggagctgcagaggtacaaactatggctggagcaaaagtatcgttccccctacaccgggaaatcaataagtctcactaagctgtttacgtctgcttaccagattgaacacgtgatccctcagagccgctatttcgacgattccttttcaaacaaggtaatttgcgagagcgaagtcaattctcttaaagacaacatgttgggatacgagttcatcaagaatcacggcggtgaaataatccattgtacaatgctgggggatgtgaaagttttatccgagagtgagtataaggccttcgtgaacgaccactacgcacataataaacggaagagagaaaacctcctgcttgaggacattccacaggaatttctgaataggcaaatgaacgatagccgatatatctctaaggtcgtgaaagccctactctccaatattgtacgggctgagggcgaggaagaggccacctcaaagttcgtggttagttgcagcggaggcatcactgaccgcctgaaaaaggattgggggttgaacgacgtctggaataaaatagtgtacccgagatttgaaaggctgaaccggttaaccggaacagaggcattcggtcagtgggaaaacaaggatggcaagcgagtgtttcagaccgcggtccccctcgagctgcaaagagggttcaataaaaagcgcattgaccacaggcaccatgctatggatgcccttgttatcgcatgcacttcgcgtaacatcattaattatctgaacaatgagtccgccaacaatcctaaaaagcgggaagacttgagacagaaactctgtgataagaacaggacaatccgcaagccatgggagacgtttacccaggacgctactgccgcactggaagatgtgattgtgtctttcaaaaattacgtacgaataatcaacaaggctacaaattactatgagagatacgacgtcgaaggcaaaaaggtgattgccgagcagcggggagacgatatgtgggcgatcaggaaacccatgcacgaggccacctattacggtcgcgttaacctacgtagaaagaaaaaggtgaatctgcgggtcgctcttgaaaacattagctcaatctgcgacaataagctcaggatatatatcaacgggctggtggagaaaggctttaacacaaagcaaattttggataaattcaagaatactaacgaccattttagtatgcagaaaatcgataaggttgaaatttggcagttcaccaatgaggaagagaagctggtggcaacgcgcaaacctttagacacctcctttgatacaaagaaaatcgcctctataactgacaccggcattcagacaatcctcctgaactaccttgagactaagggaggggatagcaccatcgctttcacgccagaaggaattgtagagatgaatcaaaacatatccaaatataataacggcaaggaacacatgcccatcctgaaggtccgattgtacacaaaactcggtaagaaaattccggtggggcagaccggatgtaaggccaaacagttcgtgatcgcagaggcgggcactaatctgtactttgccatttatgaggacgaagagggtaagagatcataccggacaatccctctaaacgaagtcgttgagaggctgaagcagggccttagcccagtgcccgagaaaaatgataaggacgtacatctcaaattctatctgagtcctaacgatttggtgtacgtccccatagaagacgagcacgaatctttagctaaggaccacatctataaatttgtggattccagcgggaccactgccaatttcattccacatcgctcggcaaacgttatctttgagctgaataagaaagacgctgaaaagttctgctcaggatctattatccaaaacgagtacggcgtggggagttcccagagcaagaatcagaaagccataaccggagaaatgattaaggcagtctgtagaaaactcgaggtggataggctgggcaacgttatcaaggtgatctga

SEQ ID NO: 3411 - RNA, 4497 nt, synthetic construct
  misc_feature 1..4497: note = Cas9 variant
  source 1..4497: mol_type = other RNA
atgaagcacatcctgggcctcgaccttgggaccaacagcattggatgggccgtgataagagctcatcaggatgcagacggtcacacaactctgcaagatatcttggccgcgggctccaggattatccccatggacgctgccacgttaaccgatttcgacaaagggaatgcacggtctggaacagccgagcgcacttcatttcgaagtatgcgtagaaggcgggaacgccagctgctaagaagggagcggctccatcgcgtcctgatgcttctgggcttcttgcctcagcactacgctaacagcctcacccgatatggtgaatttgcagataatagagagtgcaagctgccatgggttaaagacgaatccgatgggaagtaccatttcctgtttcaggacgccttccacgagatgtgtgaggattttaggcaactcgctccgcagtgggtggccgacggaaagaaggtaccctatgattggacattatactatctgcggtgcaaggcgctttctcgtaaaatttcgaaggaagagttggcatggatcctgctatcattcaaccagaaacgcggctactatcaggccagagacgaagaggacgaggtgaccactaataagctcgaagagtactacgctggcaaagtcgtgagggttgatgacacaggggaacggaagggaaagaacgtgtattacgatataaccctggagaatggttgggtctatcgatacgccgcacgcatctatcctgactgggtgggccaagtaaaagaatttattgttacgactacccttaacccagatgggacacccaagactgacaaagctggagaggtgaagagatcattcaggatgcctaaagatgacgattggaccctgatcaagaaaaagaaggagcgggacattgatcgcagtcaggaaacaatcggccagtacatatatcacgccttgctcaaagacccatcccagaagattagaggtaaactgatcgggaccgtcgagaggaagtactacaaagacgaattacgtcggattctggatcgacaaatccagtttcatcccgagctcagagacagggaactttattacgcgtgtctgcaggagttgtatccttctaatgtggccttccgcaacacgctagtgaatcgggattttacttacctgttcctcgacgatatcctgttctatcaaagaccacttaagagcaagaaatcccagatttcagactgcccgtacgaggaacacttttatacagataaggagaccggagaaaggataagtgtccccgttaaatgtatcgcagtgagccatcctctgtaccaggagtaccgcttgtggcagttcattcaaaacctccgaatctattgccgggaagctcgtatagacggcaatctgatgattgattgggaggtaactaacgagttactgcagacagaagaggacaagaccgccctatttgattggctcaatgacaaagaatctgtgaagcagccagagctggtcgctttccttttgggcgggaaggccaacaaaaagcagatcaaagcatacagatggaactatatggatgacgacacgaagggatacccctgtaatgagaccagggcctccctgctcaaatatctgcgcgaagctcaaacagatagcagctttcttactcgggagagagaagaggcgctgtggcacatcttgtacagtatttctgacaagggtgaactcaagtccgcactgggcaaattcgccgtgaagcacgggttaaacgagaggtttgttaccgtgttcagcaaatttcctccattcaagaaagattatggatcgtactctgctaaggccctgaaaaagctactccccctgatgcgaatgggccatcactggcaggaggcatcctttatcccgtcaacacgccagcggatggaaaagttcattaatggtgagtacgacgatagtatagacaaaagaacttatgaaaaacttgagagcttgaccgaagtctcccagtacagggggctgcctggctggctcgcctgctatgtggtatacgatcgtcattctgagggacgcgacatcgagcggtggacaagcccctcagatattgacagttatctggctcaatttaaacagcactccttacataacccaatcgttgaaagagtggtcctggagacccttaggactgtgcgagatatctggaagcaggtcgaccacattgatgaaatacacatcgagttgggccggaatatgaaactccctgccgacaagcgcagacagatgacggaacaagcatggaagaacgagcagacaaatctgaggattaaagcgctactgctcgagttcgctcggcccgggtacgacatcgaaaacgtgcgaccatatagcccctaccagcaagatcagctgagaatttacgaggaagccgttcttggagcaaatgagtgtcctgacgatatctctgccatattgaagaaattcaacggtctgaatccaccgacctcagctgaggtgttacgctataagtgctggctcgaacagaaatacaggagtccctatactggccgtaccatccctctgagcaaactttttacatccgcctacgagattgaacatatcattccaaagcagcggtatttcgacgattctttttcgaacaaagtaatctgtgagagcgaagtcaataagaaaaagggggcaatgctgggatacgagttcataaaatcctatcacggcgcttcaattaccttgaacagaggtgggactgccagtatcttttctgtggaggcgtacgaaaatttcgttaaggagcattacgcccacaacaggggcaagatgaaaaagctcctgatggacgatgtgcccgacagctttatttcccgccaactaaacgattcacgatatatcagcaaactgatgaagtctatactctccaatctggtcagagaagagggagaaaaagaggctatcagtaagaaccttattgtgtgcacaggcgggatcacggaccggttgaaaaaggattggggtattcacgacgtatggaatgacatcatattccctaggtttaagcgcctggatgagatggacagctctcatacctacattactttaaacacacaccgtcatccaatcccctccatgccgctcgagttccagagaggatttagtaaaaagcggatcgatcacaggcatcacgcaatggacgccattgtgatcgcttgcgccacccgcaatattgttaactatctgaataacgaatcagcacgacacgatgcgaaaacaagcagaatggaccttcagcggctgctatgtactgccaataggaagctcatagataaaccttggaagaccttcacgcaggatacctgcaaggtcctggaagacatgatcgtgtcgtttcaacgcacattgagaattatcaacaaaactaagaattactatctgaggttcgaggacggcaaaaagcggcgtgtgttacagaccaaaggggataactgggctattcgcaagccactccataaggaaacattctacggagagatcaatctgcgaagaatagagactctttccctgaacaaagccttggaaaggatccccgacattgtcgagcgggatctccgcaagaaactgtctgaactactgagccttggctataatgcaaagagaatcaaaggttactttgaggagcacaaggaagagtggtcagacgttaacctcagtaagattaaggcttactatttcaccaagcagaaaaacaagaggtactttgccgcacggacggaactggacacatccttcaataaagataagatcgagaacaagatagccgacaccgctattcagaaaatcttgctgcaacatttagaagcgtatgggaatgatgtggagcaggccttttctcctgagggcatcgacactatgaaccgaaatattagacagctcaacggaggccgcagccaccaacccatatacaaggtgagggtatatgaagaggcaacaaaattcgctgtcgggcggcgtggaaataagtccaccaaatttgtggaagccgccaagggcactaacctgttctttgctatctacgagatttcacaggttgatggtaatgggaacagacagaccagcaggacattcagttctatcccacttaatgtggcagtcgaacgcctgaaacagggattgcctcccgtgccagaggacgaggaaggcaacgccccgaagtatgttctctcccctaatgatctggtgtacctacccacggagaaggaactgaaacggcgagagattgcgatgccaatcgacaagagcagaatatacaaaatggtatcgtgtaccggtaaggattgctttttcatccccgctaacactgccgtccctattgtggacaggtatgaatactcatctatgaataaaatcggccgcgcacttacaggggagatgattaaggagatctgtctcccactgaagatagatcggttgggacaaattatcgaaatcagtaccttctga

SEQ ID NO: 3412 - RNA, 4506 nt, synthetic construct
  misc_feature 1..4506: note = Cas9 variant
  source 1..4506: mol_type = other RNA
atgaagaaaatcctgggcctcgaccttgggaccaacagcattggatgggccgtgataaataaggctgagaacgaaggtaaagatgtcctgtgcggcatcgaggcagccgggtccagaattatccccatggacgcgacaattatgggagatttcgaaaagggcaattctgtttcacagactaaagacaggcgggagcaccgcagtacgcgacgtttgtacgaaagaggtaagttaaggcgggagcgcctgaacagagtgctaagcgtaatggggtttctccctgatcattatgtgtcccaactggacaggtacggaaagttcctttctaataccgagccaaaactggcttgggtccggaacgccgattgtaagtatcactttttgttcatggactcgttttcagaaatgctccaggagttcaaaacaaatagcccgcagtacatcagtgaagagtccaaggtgccctatgattggactctgtactatctgcgcaaaaaggcactcacccataaggttacaaaagaggaattagcctggatactgcttaactttaatcagaagcgaggctacttccaattgagagacgagtctgaagaggagaaaaagcctagcaaaatcaggcagtactttgaacaccagaaggtggtcgatattatcgacaccaacgaggtgtataaaggcctgaaggtactaattgttatcctcgctaatgggatatccggaaagattttcaaaaaggaaatcccagattggattggtgtggagaaagacatcatcgtcaaggtggacattgataaagacggcaaggataagtttaacgaagacgggtcactgagttgccggttcaatatacccactgaggcagaatgggatacagagtgggagcttatcaaacagaagacccaaaacgacctggatgccagcggaaaaacggtgggcgaatacatttttgacactttgctccgtaatcctgagcagaagatccgcggtaaactggtcagaaccatagaaaggcggtattacaaggaggaaattaacgctatcttaaagaaacagaaggagttccatccagagctgtctgatcgagccctctatgaaaaatgtgttgaggaactttaccccaacaatcctgcgcaccgcaacatgatgctgatccacgacttgtcctatttcctagtgaatgatattctgttttaccagagaccactcaagagcaaaaagtcactgatcgacgagtgcccgtacgagagtcatctttatattgacaagaaatctggggaaaggaagcccgtagcagtgaaatgtatagccaagtcccaccctctgtaccaagagttccggttgtggcagtttatcagcaacctccgcatttatcagaaaacaaaggaagtcggaaattcgctgaaagtggatgttgacgtgactaacgagttcttaaagggcgaaaatgattacgtcgagctgtttgactggctaaacaccaagaaagagatcaagcaagaagatttcctcaaatataagccatttggcttcacaaaagggaatatcaacaattacagatggaactatgtggaggacaagatttacccctgcaataagacccattacacgatactgaaaggacttgaaaaggctgatatcacttttgacgagttcatttctcacgattccttggccgaagagaacctgtggcacatcctctattcagtaagtagcaaagaggaactgaagcatgcacttgagtcctttgctgacaaaaggggtctgtctattaagttcgttgatgcctttatcaatacccctgcgttcgaaaagagctacggcgcctattcagcaaaagctataaagaaattgctcccactgatgcgtatggggaagtactggaaagaggaaaacatctgtgacagtacacgggagcgaattgataagatcattactggagagtatgacgaaaacatcagagacagggtgcgcgagaagtccataaatttaacagatattaccctgttccggggcctacccctctggctggcctgctacgtcgtgtatgacagacacagcgaagctggtaacacggagaggtggacctctccgtcagatatcgaccattacattcgcaaatttaagcagcacagtcttcgaaatcctatcgtcgagcagatagtgttggaaacactgcggactgttcgtgatgtgtggaccgaggtagggggcatcgacgaaattcatgtcgagctcggaagagaaatgaaaaaccccagcgataagaggcgcaaaatgtccctgcagatgcaagagaatgagaacacaaatttacggatcaaggccctgcttgcagaatttattaacccagagttgggcatcgaaaatgtgagaccttactctccctcgcagcaggacctcctgaggctatatgaggaaggggcctggaacagcccagagatagatgagaaacaggttgacgaaatgctggctattctcaagaagtttaatgagactgattcctcaaaacgacccaccaagagtgaaatcaaacgctaccggctgtggcttgagcaaaagtatagatctccttacacaggaaccccaatcccgttgagcaaactgttcactacggcgtatgaaattgagcacgtgatccccaggtcccgtttcttcgacgattcattaacaaacaaggtcatttgtgagagcgaagtgaataagctcaaaggtaacatgctgggctacgagtttataaagtctcactatggggaaaaagtacagctttccagtggaagcgaggtgcagatcttctctgttaatgactacgagaagtttgtcaaagaccattactccaagaacaaggcaaaaatgaagaaactgttgatggatgacattcctgaaaagttcaccgagcgccagatgaacgattcacggtatatcagtagactcattgtgagcctgctatcgaatatcgtgagggaaaaaggcgagcaagaatccatatctaagaacgtcctggtttgcactggtggggtgaccgaccgactcaagaatgattggggcgtgaacgacgtatggaataaaatcattctgccacggtttaagcgcatgaacgagatcacagatagcaccgactacacttcagtcaatacaagtggacacattatccccgccatgcctcttcatttgcagaaaggcttcaacaagaaaagaatagatcacaggcaccatgctatggacgccattgtgatcgcatgtgccgggcggaatatcgttaactatctgaataaccagtcctctaagagcgatgtgtcccgacacgacttaagaaatctcctgtgcgagaaggacaaatcagatcgcaaggaacttattataaaaccatgggacacgtttacccaggatgtctacagcgtgctgagttctatcattgtttccatcaagcaaaacctaagggtgattaataaaactaagaacatctatcagcgtaaagaggacggaaaggtaataatcagcaagcaggaaaacaatattaactggtgggctatccggaaacccctccataaggagacagtctcgggtgaagtgaatctgagaaaagagaccacaatttcattgaaggaggccatcgataacccggcaaggataattgacaaagatttcaagaagaaactgcgcgaattaatcctcatgggctacaatgagaagctgatcaaaaagtatttctacgacaacaatgaatcttggcaagatgtgaaccttaaaaagattcctgcgtactattttactaaggacaccaatgatcgatacttcgctagtagatccctgttggacgagaactttgataaaaagaaaatcgaaaataaggtcacggacaccgggatacggacaattctcctgaggcacctagaggttgagggaggcgacagcaaagtggccttctctccagaaggtctggagcgcatgaacaagaatatcgaaattcttaacgggggcaagaaacataagcccatctataaagtacgtgagtacgagaaggcagaaaaatttgccgtgggaatgagaggcaataaggctagcaaattcgtcgaggccgcaaaggggactaacctctttttcgctgtgtatgataatggaaagaaacggtcctttgccaccgttcctctgaacgaagtgataaggttgcagaaggagggcctgccctcagcgccagccaacgaagagggtttactccctaaattcgtcctgagtcccaatgaccttgtgtacgttccaacagaggatgaactgcgcagcgggttgctcccggagaaccctgctcccgaacgaatttataagatggtgtcttgcactggataccagtgctttttcatccacttctccgtctcaggcgtactgtgtgacaaaaaggagtttagtagcctaaataagatggaaagagcaatctccggtgagatgattaaagagatctgtattccactgaaggtgaaccggcttggcaaaataatgtacaatctctga

SEQ ID NO: 3413 - RNA, 4506 nt, synthetic construct
  misc_feature 1..4506: note = Cas9 variant
  source 1..4506: mol_type = other RNA
atgaagaccatcctgggcctcgaccttgggacaaacagcattggatgggccaaaatatccatcgatgacaatggtaactacctgagagatattcagttgggctctaggatcattcccatgtcacaagacgtgttagggaagttcgataatggagtcactgagagtcagacggctgttcggaccggctttcgcggtctgcgacgtatcagagaaaggagcctactccggcgcgagagactgcacagggtgcttcatgtaatggggttcctgcctccacactatgactccgcaataggatggaacaaagaagaaccgtctacatacggcaagtttttgaatcatggcgaacccaaactcgcctgggagcggcagggggatggatcgatgcgcttcctgtttatggactcattccacaagatgatggaggattttgcgcctcatcagccagctctggtggccgacggtcgaaagatccccctcgattggactttatattacctgagaaagaaggcacttacccaacctattaaaaaggaagagttggcctggatcctgctaaacttcaatcagaaaaggggctattaccagctccgaggggaagaggaggaagagaacccaacaaagcgtgaagagtatcacgaactgaaggtcgtgagcgttgaggctgcagaggaaggaaaaggcggtaatacctggtacaacgtgaaacttgagaatgggtggatttaccaccgccccagtaaaatcgacctgtccgattgggtcggaaagactaaacagtttatagtgacaatggaatatgaggccgacggcattaccttgaagaaaaacaaggaaggcgaggtaaagagatctttcagggttcctgacgaggatgactgggggctccggaaaaagcgaacggaaagccaactggaggcttccggaaaaactgtgggtgcctttatctacgatcatttactggcggaaccagcagacaagattcgcggcaatttcatcagaaccatcgagaggaaatattacaagcaggaactcgccgatattcttcgggagcagtcaaagtatcacgaggaactgcagagtaaaaagatattggctgactgcgccgaggaactataccgcagcaaccaaccgcatagagattctctgctcaaaaaggacatggtctatctgcttctgacagatttgatcttttaccagaggcccctcaaatccaagaagtcactgattgcaaattgtccttacgagtattacgagtatgtggacaaagaaactggggagatcaagcgtcagggaataaaatgcgtggctaagagcaacccatactatcaagagttccggttatggcagttcgtcctgaacctacgactctacgatagaaccgaggacaaagaagttacagccgagtatctgcccagtaaggaggactacgcgaggctttttgtgtacttgaatgatcgcaaggaaattaaccaggagaccctgctcaaagacttctttaagctgaaaaaggtaaaacagcggtctgaaaaggagttccctgtgagatggaattatatcgaagataaagagaagaagtacccatgtaacgagacgaggcacgaacttctgatggccttggaccgcgcaggcatggagcgatcctggctcgatgacactgctcggcaatatcgtctgtggcacttactgtacagcatcgaagtcaaagatgaggccgaaagagctctaaggaagctcaaagacgatgacgagtttgtgtcggccttcctgaaggttaaaccctttaagaaggattatggtgcatactctgagaaagccgtgaagaaacttttggctgtcatgcgcatggggtcccattggtgcgaagacgatatttgtaaggagacaaaagaacggatcgagcacattctgcagggcgacgtggaggaaaagataaaggagagaatgaatcataccgcgtattcactcggagaactgagtgacttccagggcttaccggagtggctggcatgctacgtagtttacgggaggcacagcgaagccactgatatcaaacattggaagacacctgagtcccttatggcttatattaacggatttaaacagcactctttgcgaaatcccatcgtggagcaatgtatcctcgaaaccctgcgcacggtccacgacatttggaaggaggccggtcatatagatgaaatccacgtggagctaggccggagcatgaaatcaaccagtgaccagagagcaaggatgacagaaaacattctgcgtaatgagaacactaatctccgcatcaagtccctgcttatggagttgaagaacgatgccgacattaaagatgtccggccatacagccctatgcagcaggaaatcctgagaatatatgaggaaggggctttacaagagctcaccaaggaagacaatgattacgaggagatcttcaaaatttctaagatcccccagccatcagccaaagaactgcttaagtataaactgtggttggagcagaagtacaggagtccctatacaggaaagcctattagcctctccaaactgtttacttctgcataccagatcgaacatataattccacaatcgcgatacttcgacgatagctttaacaataaggtgatctgcgagtccgaggttaacgcgctaaaatcaaacatgctgggctatgagttcattaagaatcacggtggggaaatcgtgcactgtaccctcctgggcgacgtaaaagtccagaacgaaagtgagtacaaggctttcgtgacagaacattatgccaataacaagtacaaaaaggagaaacttttgatggaggatataccgcaggactttctgaatcggcacttaaacgactctcgctatatcagcaaggttgtgaaaaccctcctgtccaatattgtcagaactgaagatgagatggaaacgacatcaaagttcgtggtaagctgcaccggaggcatcactgacaggcttaagaaagattgggggctgaacgacgtgtggaactctattgtttactcccggtttgagcgactaaatgaactcaccaagagtgatgcattcggaagatgggagaataaagagggtaagcgcgtctttcaaacaagcgtgcccctggaattgcagaggggcttcaacaaaaagcgtatcgaccatcggcaccatgccatggatgctctggtgatagcctgtgcatctagaaatattatcaactatttaaataacgagtccgctaactcacctaagaaaagggaagacctccgccagcagctgtgcgataagaatcgaatcattagaaaaccatgggagagttttacccaagacgcccgggcggcccttgaagatgtcgttgtgagcttcaagaactacgtgagggtaatcaataaaactacaaactactatgagcgctacggggctgacggagagaagacgattgcaaagcagaaaaattcggaaatgtgggccgtccgtaagcccatgcacgaggctaaatattacggcagagtgaacctgcagcggaagaccgaagttaggttgaaagccgcactcgaggacataccttccatctgcaataaggagctgcgcgattatattaaccggctagtgaaatctggtctgaatgcgagacagcttctcgcccactttaagagcactgactactgttggaacaagcaaaatgtcgataaagtggaagtttggcggttctcagacgagaaggaaccactggtggctatcagggagagtttggatacatcctttgacgccaaacgcattgataccatcacagacactgggatacagaagatcctgttaaactatctcgaagcaaaaggcggagatcccgctattgccttcaccccggagggcatcgcagagatgaatcagaacatggccctgtacaataacgggaagatgcatcagcctattcttagagtaaggctgtctaagaaacggggaaagaaataccaagtcggccagacgggttgcaaggctaaacagtttgtgatcagcgaatccgggaccaacttgtatttcgcgatatacgaggacgaagatcgtaatcgcacatataacactattccactcaatgaggtggccgaacgactgaagcaaggactatcacccgtccctgagaagaacgagaaagaagttcccctgaagttctaccttagcccaaatgacctcgtgtatgtacctaccgaggaagagatcctgatgaaagaatgtaagttgaacaaaaatagaatctacaagtttattgatagttctggcacaactgcaaacttcgtgccccacaggtccgctagcttaatatataatgtcgacaagaaactggccgaggccttttgcaacgacgagatcattcagaatgaatacggtgtgggctcgccacagtcaaagaaccagaaagctctcaccggggagatgatcaaggcagtttgttggaaactggaagtggatcggcttggaaatattatccgcgtcataaagtga

SEQ ID NO: 3414 - RNA, 4515 nt, synthetic construct
  misc_feature 1..4515: note = Cas9 variant
  source 1..4515: mol_type = other RNA
atgaagaacatcgtgggcctggacctcgggaccaatagcattggatgggccgtcgttaacggtaatataaacgatgacggctccgagcagcttgtgaaaatccaggcttctgggtcaagaattatccccatggatgcagccatgattggagacttcaataagggcaacagtatcagccaaacagcggaaaggactcggctgcgcggtatacgacgtttgtccgagagatacttactgaggcgggaacgcctacacagaatcctcgatattctggggtttcttccttctcatttcgctagggacctggatcggtatggaaaaatcgtaaaggacaaagagccaaagttggcctggcgcaagaatgaagcaggccagtttgagttcatttttcagaactcgttcaaagagatgctcgaagattttaagctgaatcacccgaacctgatcacggacgataaaaaggtgccctacgactggaccatatattacctccgaaagaagggcttaacatcaaagattagcaaagaggaactggcctggatccttttgaatttcaaccaaaagagagggtattaccagctgaggggagaggaggaagaggaaaataaaaacaagcaggtcgagttttatgctctaaaagtgattgcagttgaagatagtggtgagaagaaaggcaaggacacttggtacaatgtgcatctcgagaacgggtggatctaccggcgtacctccaacatgcctctggactgggtcggaaagacaaaagagttcatcgtgaccactgatcttgaaaaggacggcacacccaaaaaggataaagaaggtaatattaagcgctcttttagagccccaaaggaggacgattggagcctggttaaaaagaaaaccgaagctgacatagatcagacgcacaagactgtagggacctatatctacgacacattgctcggaaacccttcccagaaaattaggggccggctggtgcgaactatcgagcgcaagtattacaaggaggaattaaaactgatactcgataagcaaaaagagttccatccagaacttcaggacagagccctgtatgcggcatgcgtcgaggaattgtacaccattaatgaggcccacaggaacaatatcggcaaccgggattttacatatctattcctggaggacatcctcttctaccagcgccccctgaagagtaaaaagtcacttattgacaattgtccttacgaagagaaccactgcctggataaggaaaccggggagatcaaatttttcccagtgaagtgtattgctaaaagccatccgttgtttcaagagttcagactctggcagtttatagtgaatctgaggatctatcgtaagggattagcccaggacgtcgatgttacgaacgaactgctaaaaactgaggaagactacgtggcactcttcgattggctgaatggtaagaaagagattgaccaaaaggcttttcttaagtatccccctttcggcttgaaaaaggaagtagagaactaccggtggaattatgtgcaggataaatcttacccatgcaacgagacacgatccctgatgctcgccagactggaaaagtgtgacatctcaatcgagtttcttaccaaagaaaatgaggaagcgctgtggcacattttgtatagcgtcgaggataagaacgagatagtgaaggccctccagaaattcgcagacaagcataacctgaatgctagttttgttgatgtgttccagaaatttccctctttcaagaaagaatacgggtcctacagcgccaaggctatcaagaaattactgcctctaatgaggatgggaaagtattggtcggaggactctattgataaaggcactcgcgaacggatggacaagatcattacaggtgagtacgacgagaaaatcgaaaacagagtcagggagaaggccatacacctcgcagatatctccgagttcaaggggctgccactttggttggtgtgctatattgtatacggccgccactcagaaagtaaagaaatcgccaagtgggagagccccgctgacattgattcctatctgaaatcttttaagcaacatagcctccgaaatccgatcgttgagcagataattatcgaaaccctgcgggtggtccgtgacatttggaaacaggtgggaaacatcgatgagatacacgtcgaattaggcagagagatgaagaatcctgcggacaaaaggcgcaagatgacgcagcaaatctcagaaaacgagaataccaacctgcggattaagtaccttttgacagagttcctcaatcccgaatatgaggtggaaaacgttagaccatacagtccttcccagcaggatatcctgaggatttacgaggaaggggtgctaaatagcgtatctaacctgcccgaggagatctcagacatactcaaaaagtttactgaaaccgatctgaaaaagcgaccaagtcgcagcgaggtccttcggtataaattgtggctggaacagaagtacagatccccctatacaggagaggtgattcctttaggtaaactcttcactccagcatacgaaatcgagcatgttatcccgcaatctaggtattttgacgattcgttcagcaataaagtgatttgtgaggccgaagtcaacaagctgaaatccaatcttctgggccacgagtttatcgtgaagcatcacggggaaattgtagagttgcccttcggcaaaaaggtgaagatatttaccgttgacgagtacgaacagttcgtcaaagataactattcacgtacacgcggaaagatgaaaaagctcctggtggacgacatccctgaggaatttgtggctcggcagctaaacgatagtagatacatttctaaagtcgttaagagcctgctctccaatatcgtgagggagaagggtgaagaggaggccattagcaaaaacgtgatcccatgcaccgggggcgtaactgaccgactgaagaaagattggggagtcaatgacgtgtggaacaagataatccttccccggttccagcgcttgaatgaactgacgggcacaaacaaatttaccactatgtcattaaataaccacgagattcctgcaatgccactcgaactgcaaaaggggttcaataagaaaagaatcgatcataggcaccatgccatggacgctattatcatagcctgtgcaaaccggaatattatcaactaccttaataacgagtctgcgaccgctaaggccgaactgtcccgatatgatctacagagactcctgtgcgacaaagcaaagacagatgacaatggaaactacaaatgggttatccgcaagccctgggccagtttcacccaggatgtgcacggtgtcttggaggacattatagtgagctttaaacaaaacctgagggttatcaataaggctactaaccacttcttacattataatgaggaaggcaagaaaatttttgtgaagcaggagaaaggggactcttgggccatccgtaagtccatgcacaaagatacagtattcggagaagtcaacctccggagaattaagacggtggcactgaatgaggctatgaagaacccgcagtcaatcgtggtcaaagactttaagaggaaacttctggaattgctcaatctgggcttcgatgccaagcgcatcaaaaagtactttgaggacaaccgagagacctggagtgatataaatctaagcaagattactgtttattacttctcgaaagacacaaaggatagatttttcgcgacccggaaacctctggacacatcctttgataggaagaaaatcgaaaacaatattactgacaccggtatccagaagatacttctccgccatctggagttgaaggataacaatccagacattgccttctctcccgatgggatcgacgaaatgaaccgtaatatcattcaactgaacaatggcaaatatcaccagcctatcataaaggtgagatggtacgagcaggctgacaaattcgcagtaggacagacgggcaacaagagctcaaaatttgtggaggccgctaaggggaccaacttattctttgccgtctacgaaagtaatattctcgatgagaaaacaaacactatcattaagaagcggaattatgcaaccatccccctgaacgtggcgatagaaaggcaaaaacagggactttccgttgccccagaggaagagaatggcaacgaccctattttcgtgctgtctcccaatgatttggtctacctcccaacaactgacgagctggctaacggtgtggttgcccagccgctagataaggaacgcatctataaaatggtgagctgtaccgggaatgagggacattttatccctgcacgaattgctaaccccatcctgcagacgattgaacttggctccaataacaaggcccaaaaagcatggacagacgagatgataaaggaaatctgcatgccaattaaggtcgatagactcggtaatatcctggagtcaagcagtttgcacaaaaagtga

SEQ ID NO: 3415 - RNA, 4515 nt, synthetic construct
  misc_feature 1..4515: note = Cas9 variant
  source 1..4515: mol_type = other RNA
atgaagaacatcgtgggcctggacctcgggaccaatagcattggatgggccgtcgttaacggttccgtgaatgatgacggctctgagcagcttgtaaaaatacaggcttcagggagtagaatcattcccatggatgcagccatgatcggagacttcaacaagggcaatagcatttcccaaacagcggaaaggactcggctgcgcggtgtgcgacgtttgtctgagagatacttactgaggcgggaacgcctacacagaatcctcgatatactggggtttcttcctttccattttgctcaggacctggataggcacggaaaaatcgtcaagggcaaagagccaaagttggcctggcggaagaacgaagcaggccagttcgagtttattttccaagactcgtttaaagagatgctcgaagatttcaagctgaattatccgaacctgatcacggacgataaaaaggtgccctacgactggaccatttattacctccgcaaaaaggggttaacatcaaagatcagcaaagaggaactggcctggatacttttgaattttaaccagaagcgaggatattaccagctgagaggtgaggaggaagaggaaaataaagataagctagttgagttctatgctctcaaagtggtcgcagtggaagacagtggcgagaagaaagggaaggacatttggtacaacgtacatctggagaatggatgggtttacaggcggacttccaacatgtctcttgattgggtgggcaagaccaaagaatttatcgtcacaaccgacctggagaaggatggtactcctaaaaaggacaaagaagggaatgtgaagcgtagcttccgcgccccaaaggaggatgactggtccttggtgaaaaagaaaacagaagctgatattgaccagacccacaagacggtcggagcctatatctacgatactctcctgggcaacccctcacaaaagatcagaggcaggttagttcggaccattgagcgaaagtattacaaggaggaactgaaactcatacttgagaagcagaaagaatttcatctggagttgcaggaccgcgcgctatatgcagcctgcatcgaggaactgtaccctattaacgaggctcacagaaataacgtggggaatagggatttcacatatctcttcctggaagacatccttttctaccagcggccactgaagagtaaaaagagcttgatagacaactgtccctacgaggaaaatcaaggactcgataaggagactggtgagattaaatctttccctgtaaagtgcatcgccaaatcccacccactgtttcaggaatttcgcttatggcagtttatcattaacctgagaatctataggaaggacctagcacaagatgtggacgtcaccaatgagctcctgaaaacagaagaggattacgtggctcttttcgactggttgaacggcaagaaagaaattgatcagaaggcctttctgaagtatccggttttcgggctcaaaaaggagatagagaattaccgttggaactatgtgcaggacaaaccctacccttgtaatgaaacccggtcactgatgcttgcgcgactggagaagtgcgatatcagcattgaatttttgacgaaagagaacgaagaggccctctggcatatcctgtatagtgtcgaggacaagaatgaaatcgtgaaggcattacagaaattcgctgataagcacgacctgaacgcctcttttgtagatgttttccaaaaatttccacccttcaagaaagagtacggatcctacagcgctaaggccattaagaaactactccctctgatgagaatgggcaagtattggtcggaaaattctatagacaaaggtactagggagcgcatcgacaagattatcacaggggaatacgatgagaaaattgagaaccgggtgagagaaaaggcaatccatcttgccgacgtctccgatttcaagggcttgccactgtggctcgtgtgttatatagtctacggaaggcactcagaggctaaagaaatcattcagtggaagagtcccgcggacatcgatagctatctgcgctcctttaaacagcactctttacgaaacccgattgtggagcagatcataattgagaccctgcgggttgtgcgtgacatctggaagcaagtaggcaatattgatgaaatccatgtcgagcttgggagagaaatgaaaaaccctgcagacaagaggaaaaagatgactcagcagatgagcgagaatgaaaacacaaatttgcgcataaagtacctcctgaccgagttcctaaaccccgagtatgaagtggagaatgttcggccatactcacctagtcagcaagatatcctgagaatttacgaagagggagtgctcaactccgtcagcgacctgcccgaagagatctctgatattcttaaaaagtttacggagaccgacttgaaaaagaggccatcacgaagtgaagtgctgcgctataaattatggctcgagcagaagtaccggagcccctatacaggtgaagtaatccctctgggcaaacttttcactccagcctacgagatagaacacgtgattccgcagtcctgctattttgatgactctttctcgaataaagttatctgtgaggctgaggtcaacaagctgaaaagcaatttgctcgggcatgaatttatcgtgaagcaccatggagagattgtggaactgcccttcggcaaaaaggtcagaatctttaccgttgacgagtacgagcagttcgtgaaggataactattccaggacacgttcaaaaatgaagaaactactgatggacgatattcctgaagagtttgtgactcgccaactcaatgacagtcggtacatatctaaggtagtcaaaagcctgctttccaacatcgtgagagaaaagggtgaggaagaggccatttcaaagaatgttatcccatgcaccgggggcgtgacagataggttgaaaaaggactggggaattaacgaggtctggaacaaaatcatactgccccgattccagcggttaaatgaactcaccggcactaacaagtttacgaccaaaaatgtggggatccaggagattcctacaatgccactggaacttcaaaagggattcaacaagaaacgcatcgatcacagacaccatgcaatggacgccattatcatagcttgtgccaataggaacattatcaattacctgaacaatgagagcgcaactgcgaaggctgaactatctcggtatgatctccagaaaatgctgtgcgacaaggccaaaaccgataacaatggtaactacaagtgggttatccgaaaaccctgggcatccttcacacaggacacctatttggccctggagaatattatagtgagttttaagcagaacttaagagtaatcaataaggctactaaccgcttcctccactacaacgaggaaggcaaaaagatttttgtcaaacaagggaagggagacaattgggccatcaggaaaagcatgcataaggatacagtgttcggcgaggtgaacctgcgtcggattaagacggtcgcacttaatgaagctatgaaaaacccgcagtctatcgttgtgaaggactttaaaagaaagctgttggagctctggaatctgggtttcgatgccaaaaggataaagaagtattttgaagacaaccgcgagacctggtccgatatcaatctatcaaaaattgaggtatactatttcagtaaggacactaaagatcgatttttcgcgacaagaaagcctctggacaccagctttgatcggaaaaagatcgaaaacaatattacagacactgggatccagaagatacttctcaggcacctggagttgaaagataacaatccagacattgccttctcgcccgatggcatcgacgaaatgaaccgcaatatcattcagctgaacaatggaaagtaccaccaacctatcataaaaattcgttggtacgagcaggctgacaagttcgcagtgggccagaccgggaacaaatcctctaagtttgtcgaggccgctaaaggaacgaatttattctttgccgtgtatgaaagcaacatcctcgataagaagaccaacacaattatcaaaaagagaaattacgcaactatacccctgaacgttgcgattgagcggcagaaacaaggccttccagtggcccctgaagacgagaatggtaacgatcccatcttcgtcctgtcaccaaatgacttggtgtatctcccgaccgatgacgaactggctaacgggatcattgcccagcctctagataggggacgcatctacaagatggttagttcctctggcgagcagtgctttttcattaaacatatagtggcaaatgtcctggtagacaagtttgagttcagcccccttaacaagatggaacgagctctcacaggtgagatgatcaaaatgatttgtatcccaatcaaggtggatagactgggcaatgttttggaatcctcaagcagttataaaaagtga

SEQ ID NO: 3416 - RNA, 4515 nt, synthetic construct
  misc_feature 1..4515: note = Cas9 variant
  source 1..4515: mol_type = other RNA
atgaagaacatcgtgggcctggacctcgggaccaatagcattggatgggccgtcgttaacggttccgtgaatgatgacggctctgagcagcttgtaaaaatacaggcttcagggagtagaatcattcccatggatgcagccatgatcggagacttcaacaagggcaatagcatttcccaaacagcggaaaggactcggctgcgcggtgtgcgacgtttgtctgagagatacttactgaggcgggaacgcctacacagaatcctcgatatactggggtttcttcctttccattttgctcaggacctggataggcacggaaaaatcgtcaagggcaaagagccaaagttggcctggcggaagaacgaagcaggccagttcgagtttattttccaagactcgtttaaagagatgctcgaagatttcaagctgaatcatccgaacctgatcacggacgataaaaaggtgccctatgactggaccatttactatctccgcaaaaaggggttaacatcaaagatcagcaaagaggaactggcctggatacttttgaattttaaccagaagcgaggatactatcagctgagaggtgaggaggaagaggaaaataaaaacaagctagttgagttctacgctctcaaagtggtcgcagtggaagatagtggcgagaagaaagggaaggacatttggtataatgtacacctggagaacggatgggtttacaggcggacttccaatatgcctcttgactgggtgggcaagaccaaagaatttatcgtcacaaccgatctggagaaggacggtactccaaagaaggataaagaagggaacgtgaagcgttctttccgcgcccccaaggaggacgattggagcttggtgaaaaagaaaacagaagctgacattgatcagacccataagacggtcggagcctacatctatgacactctcctgggcaacccttcccagaaaatcagaggcaggttagttcggaccattgagcgaaagtactataaggaggaactgaaacaaatactcgagaagcagaaagaatttcaccttgagctgcaggatcgcgcgttgtacgcagcctgcatcgaggaactatatccaattaatgaggctcacagaaacaatgtggggaacagggacttcacatacctgttcctcgaagatatcctgttttatcaacggccccttaagagcaaaaagagtctgatagacaattgtccttacgaggaaaaccagggattggacaaggagactggtgagattaaatcattcccagtaaagtgcatcgccaaatctcatccgctctttcaggagttccgcctgtggcaatttatcattaatttaagaatctacaggaaggatctggcacaggacgtggatgtcaccaacgaactactcaaaacagaagaggactatgtggctctgttcgattggcttaatggcaagaaagaaattgaccagaaggcctttttgaagtaccccgttttccgtctgaaaaaggagatagagaactatcggtggaattacgtgcaggataaaccttatccatgtaacgaaacccgatccctcatgctggcgagacttgagaagtgcgacatctcaattgaatttctgacgaaagagaatgaagaggccttgtggcacatcctctacagcgtcgaggataagaacgaaatcgtgaaggcactgcaaaaattcgctgacaagcatgatttaaatgccagttttgtagacgttttccagaaatttccccctttcaagaaagagtatgggtcttactccgctaaggccattaagaaactgctaccactcatgaggatgggaaagtactggagcgaaaactcgatagataaaggcactcgcgcacggatcgacaagattatcacaggtgagtatgacgagaaaattgaaaacagagtgagggagaaggccatccacctggctgatgtctctgacttcaaggggcttcccttgtggctggtgtgttacatagtctatggccgccactccgaagcgaaagagatcattcagtggaagtcaccggcagatatcgacagttacctccggagctttaaacagcattccctgcgaaatcctattgtggaacaaatcataattgagaccttacgtgttgtgagagatatctggaagcaggtaggaaacattgacgagatccacgtcgaactgggcagggagatgaaaaatcccgccgataagcgcaaaaagatgactcagcagatgtctgaaaacgagaatacaaaccttcggataaagtatttgctcaccgagttcctgaatccagaatacgaggtggaaaacgttagaccttatagcccctcacaacaggacatcctaaggatttacgaggaaggggtgctgaatagtgtctccgatctcccagaggaaatcagcgacattctgaaaaagtttacggagaccgatcttaaaaagcgaccctctcgctcagagatcttgcggtacaaactgtggttagaacagaagtatagaagtccttacacaggagaggtgataccactcggtaagctgttcactccggcttatgaaattgagcatgtaatcccccagagctgctactttgacgattccttctctaacaaagtgatctgtgaagccgaggttaataaacttaaatcgaacctgttgggccacgagtttattgtcaagcatcacggggaaatcgtggagctccctttcggcaaaaaggtgaggatttttaccgtcgacgaatatgagcaattcgttaaggacaattacagccgtacacgctccaaaatgaagaaactgctaatggatgacataccagaggaatttgtgactcggcagctgaacgattcaagatatatcagtaaggtggtaaaatctctcctgagcaatattgtcagggagaagggagaagaggaagcaatctccaagaacgtgattccctgcaccggtggggttacagaccgacttaaaaaggattggggcatcaacgaggtgtggaataaaataatcttgcctcggttccagcgcctgaacgagttaaccggaactaataagtttacgaccaaaaacgtcggcctccaagaaattccaacaatgcccctggagcttcagaaggggttcaataagaaaagaatcgaccacaggcatcacgccatggatgctattatcatagcctgtgcaaaccggaatattatcaactacctgaataacgaatcagcgactgctaaggccgagctaagccgatacgacctccagaaaatgctgtgcgataaggcaaaaaccgacaataacggaaattataagtgggtgatcagaaaaccgtgggcctctttcacacaggatacctacttggctctggaaaacattatagtttcctttaagcaaaatttacgcgtgatcaacaaggccactaacaggttcctccattataatgaggagggtaaaaagatttttgtaaaacagggcaagggggacaactgggcaatccgtaaaagtatgcacaaggacacagtcttcggagaagtgaatctgcggagaattaagacggtggctcttaacgaggccatgaaaaatcctcagagcatcgtcgttaaggattttaaaaggaagctgttggaactctggaacctgggcttcgacgcgaaacgcataaagaagtactttgaggataatcgagaaacctggtctgacatcaacctatccaaaattgaggtgtattacttctcaaaggatactaaagacagatttttcgccacacggaagccactggataccagttttgacaggaaaaagatcgagaataacattacagatactggtatccagaagatacttctccgccacctggaattgaaagacaataaccccgatattgctttcagccctgacgggatcgatgagatgaatcgtaacatcattcaactgaataacggcaagtatcatcagcccatcataaaagtaagatggtacgaacaggcagacaagttcgccgtgggacagaccggcaataaattttcgaagttcgtcgaggctgccaaagggacgaacttatttttcgcagtgtacgagtccaacattctcgacaagaagaccaatacaatcattaaaaagcggaactatgcgactatcccactgaatgttgccatagaaaggcaaaaacagggacttcctgtggctcccgaggatgaaaacggcaatgacccaatttttgtcctgtctccgaacgatttggtgtacctccctaccgacgatgagctggccaatggtatcatcgcacagcccctagaccgcgggcgaatttataagatggttagctcaagtggagaacaatgtttctttatcaaacacattgtggctaacgtcctggtagataagttcgagttttccccacttaataagatggagagagccctcacaggcgaaatgataaaaatgatctgcattcccatcaaggtggaccggctgggtaacgttttggagtctagctcctcacataaaaagtga

SEQ ID NO: 3417 - RNA, 4515 nt, synthetic construct
  misc_feature 1..4515: note = Cas9 variant
  source 1..4515: mol_type = other RNA
atgaagagaatcctgggcctcgaccttgggaccaacagcattggatgggccctgatagagaatgatttcaacaggaaagaaggtaagatcgaggctttgggctcccggattatccccatgtctcaggacattttagggaaatttgattcaggagtgacagtcagtcaaactgcagcccgcacgaattaccgaggcatccgtagactgtatcagagggacaacctacggcgcgaaagactccacagggttctgaatatacttggtttcctgcctaagcattacgcggagagcatcgattttgaagaccggttggggcagttcaaaccagagaccgaggtgaagctcccgtatcgcaaggattccgacgataactaccactttattttccaggaatcttttaatgagatggtagaagagttccaatttaaaaacccctcgctgttctatacaaaggctaatggagagcagtcaaaaatcccttacgactggactctgtattacctccgaaagaaagccttaagcaagaagattagtaaagaggaactggcatggatccttttgaactttaatcagaagagaggctactatcagctgaggggcgaagaggaagccgattccaaagacaagctagaggagtaccatgctctcaaagtgtctgatgtccaagcaaccgaagacacaaacgccaaggggacctggtataatgtgatactggagaacggatggatttaccggcgtcagagcaaagactcccttttcgattggaagggtaagactcgcgaatttatcgttacaacctcactggagaaaggcggggctgtgaagattgacaaagaaggaaatgagaagagaagtttcagggccgtcgatagcgagaaagactggatcgcgatcaagaagaaaacggaaaacgatttggcaaacgccggcactaccgtgggtgtatatatttacgagacactcctgcggaatccagaccagaagatacgagggaaattaatcaagactattgaacgcaaatattacctggaggaactcaaggctatccttgccaagcagatacaagagcacgcagagctgcagaacagatctttgtacaaagattgcattgaggaactatatcagggaaatgaagctcataagaacaatatcaaagagaacggcttcgactacctgtttctcgaggatatcattttctatcaaaggcccctgaagtccaaaaagtcaaccatcagcaattgtccttacgaaagtcgggtttttattaaggacggcaaaaaggagatacagccaatcaaatgcatttctaagtccaaccccatctatcaggagttccgcctttggcagtttatccacaatctgaaaatttacgaaaaggaagccatagatgacgggaaaacagtgatcaacaaggacgtcaccacggagttcttgaatactcaagaggcgtatgccgcactctttgagttcctgaacgataaggctgaaattagccagaatgccttactgaaatactttaagctatcgacaaacacccacagatggaataacgtggaagacaaaaagtacccttgtaacgagactaggtctgaatttatcaaacgtctctccaagatggatggaattgacctgggtaagacactttcaccagcttttgagaaaagtttgtggcatatcatatatagcgtgaaggataaaaagcagtacgtccgggccctggagaccttcgcaatgaaaaatggcctcgacatcaaccagtttcgagaaaatttcgagaagttcaagccgtatgattccgcctacggggcttattctgaaaaagcgctgaagaaagttcttcccctgattagaaggggaacgtactggaagaaagacgcaatccctgccgctgtgcaagagcgcattgtaaacatcatgaagcggatagaaagcgtggattttaatttggagaagattgagaacttcgccgacgatgacatcccaaaacagctcctgaagtcatttgcaaaaggcaaggatcccatgcagggtttaaatacctatcaggcctgctacgctgtctacaacagacacagtgaagtgtccgacattcaactgtggaaaagccctgaggacatcacaaagtatctagattctttcaaacagcattcactcaggaatccaatagttgaacaggtggtcatggagactctgcgcgtggtacgagacatctggcagtactatgggaacggcgccaaggatttcttcagtgagattcacgttgaacttggacgggagatgaagaatgacaaaaagacccgtgaaagaatcagcaaatccattacagagaacgaaaatactaacgagaggatcaagaatatattgaaagagctgatgggcgatgaagcactccaaggggacattcgcccctactctaagggacaccaggatatcctgaagttatatgaggaaggtgtgtttgcgaacgctccggagacctacaaaaacatcaagattgacgatatcgaaaagattcggaagaataactcgcctagcaaatccgacatagtcaagtataagctgtggcttgagcagggctacatctcaccctacacagggagtccaattcctttgtctagactcttcaccactgattatcaaatcgagcatattatccccaggagccgatactttgacgattccatgggaaataaaataatctgtgaatcagccgtgaacgaggaaaagacgaataaaacagcatatgagttcattaaggaaaacgccggccgcatcattgacctgggtcaggggaaacaggtcccactatttgacctggaggcttacgagagccactgccggggctatttcaagggaaataccaagaaactcaagtttctgctttctgaagatatccccgagggcttcataaacagacagttgaatgactccaggtacattagtaaagtggttactagcctgttatctaacgtggtacgtgaagagggggagcaagaagccacctccaagaatctcgtccctctggtgggaacaatcacctcaaaacttaagaaggattggggtctggaggcaatctgggacgatttgattgctccacgcttcgaacggatgaaccagctcactaaaagtacagactttagaaaggaggttatagatggccatgggaataggtatttcatcaacacggtgccggacgatattaaaaagggatttagcaaaaagcgaatcgaccaccggcatcacgccctggatgcgctagtcattgcctgtaccactaaagaccacgtgaattacatcacatcgctgaacacccagcgcaacaatagatccctcgtatctaagctgaggaagatagaagagaaaacaatcaaggacaaacggactggccagcccaagaccattaaaatcgctaaggcataccataagccttggccaaacttcacgaaagagacctttgaaaaacttagcaaaacagtggtttcattcaagcaaaatcagcgaattatcaacaaaactaataacaagacctggggttgggagaaggtcgatggggtgatgaaaaaggtgttgaaaaagcaggagaaaagaaattgggccatacgcaagcccattcacaaggaaacatattacggcaaagtcaagggatttgacagtcctaaaggcaagatcactaccgctacgaggaaatccctgcgtgaaatcacaaacgagcggcagttaaataccattactgattctgggatcaagaaaatactcaacaatcatctgaagacattcattgacgagagcggaaagatcaactttgaaccagccttcaatcaagatggcattgaccttctgaacaaaaatatccagcagctaaacgagggtaagaatcaccaacccatatataaagttagaatgtacacccacaacactatgttttccgtgggggatgaaggaaacaagtcaaccaaatatgtgattccggagagcggcacaaatctcttcttcaacgtatactgggacgaagagaataacaagaggaattttgagacggtccctctgaaccgcgtgatcgcattccagaagcagaccagtcatatcccacgaaaagatagaactgacgttcccattgataatacattgggtcggtttctgttcaccttatctcctgacgatctcgtgtatctgcccacagacgaagagtccgagagctttactaccttcgaaatcgactcgcttaactcaaagcaggtcgcgaatatttacaaatttgtggatggctctgggacgacaggaaacttcgttccagccgaggctgccagggtgatagcaaatatcaaggacaaaaaggtacgcagtaacttttgcaagcgtaataacctgtccgataaacaattgattaagaatgagttcggcctcgggagccctcagctgaaaaaccagaactctctagacggaagacagatcaagagcatctgttggaaactggaaattaatcggcttggcaagataatcaaggtcattaaatga

SEQ ID NO: 3418 - RNA, 4515 nt, synthetic construct
  misc_feature 1..4515: note = Cas9 variant
  source 1..4515: mol_type = other RNA
atgaagaaagtgctgggcctcgacatcgggaccaacagcgtcggatgggccgttgtgaatcagaacgataagggtgagttcctttccattgaaaagataggctctagaatcattcccatgtcacaagacgtaatggataagtttggggctggacagacagagagtagcactgcacagaggacgcagtaccggggcgtgcgccgactgcgtgaaagatccttgttaaggcgggagcgcctgcacagagtcctacatatcctccacttcctgcctcaacattatgacgccgcgattggttggaataaaaaggaaaacaagacctacgggaaatttcttccaggagtggaggttaatatcccgtgggtggctacagatcagggccaccagttcatatttatggactcttatgccgagatgctgaaggatttgaaacagcatcaaccccacctcttcgaaaagtcgtcaactcctgtcccactggactggaccatctactatctgaggaaaaaggcactcacacaggccattagcaaggaggaattagcttggatcctgcttaactttaatcagaaacggggctactatcagttgcgcggggaggaggtggaagataacaccaagcgagaggagttctacgcactgaaagtagttaaggtggaactagacaaagataatacaagtgccaagacatggtacaaagtccacctcgaaaacggatttatttatccctgcccttccgacaccccaatcgattcttgggtgggtatggtgaaggacttcatagtcacgactaccctggagaaggacggcagcgagaaaagaacagctgatggggaaattaagaggtcctttcgggcccccaaagaggacgattggactcttctgaagaaaaagaccgaatcagagttggaaaagagtggaaaacaagttggcgcgttcatctacgacacactcctgagcaatcctgatcagaagattatcggtgggttaatcaaaaccattgagcgtaagtattacaaaaaggagctggaacagatactcgagacgcaacagaagtttatcgcagaactttctgacaaaaagctgttccaggcctgtgctgaggaattgtatccactaaacgattcccatcgcgagaatctgctcgagagagacttcaaacacctgtttgtgcaggatattatcttctaccataggccgcttaagactaaaaagtcactgataagcaactgcacatatgaataccggaccttttacaagaatggagagaaacaaattagtcccatcaagtgtatcgccaaatctaaccctttgttccaggaatttcgagtatggcagttcgtgcagaacctccgcattctgcaaagacagaggtccgagggcgacagcatcaagtataatgtcgatgtgactgcagagtttttaaaagacgaaaacgacattgctaatctgttcacatggctaaacgagcggaaggttataaaacaggatcagctcctgaagtcgtactttaaacttaaagtgaataaggaaaccaaagagttggactatcgctggaactacgtcgatgacaagaataaagaatatccatgcaacgccacgagaacccacatcctgtctttcctcgagaagtgtaaggaggaaaagaggattgaggatgaccgttttgtgtactccctgtggcaccttctgtattcagtagttgaacccatcgagttgcggggcgcgctcgccaagttcgcagaacgagagcatctgcaccctagttttgtggatgtcttcgctcaattcccacccttagagaaagaatacgggagctactccgagaaggccatcaaaagactgctaccgctcatgaggatgggagactattggcatgaagataagattgacgtgaagacaaaacagcgcatacagcggatcattgatggtgaggctgacgatgacatcactcacagatctagggaaaaggtcgagaatctgcgcagcattaccgactttaaaggccttcctttgtggaaggccgggtacgtggtttataaccgacattcagagagtggagaactgacaaaatggaagactccccacgagctctccaattacatccagaacgagttcaagcaatatagcctgcggaatccaatagtggaacagatcgtattagagaccctgcgtgtcgtgcacgatctttgggttaaacatggcgacttttctgaaattcacttggagctcggtagagatatcaagaactcaagtgacaaaaggaagcgcatggcagaacggcagcaagagaatgaaaacagcagacagagggtgctggagatgctaattgatctgaaaaaggaggccgctttcgcggacctcaacccttactccccctctcagcaggaaaaactgcgaatcgtcgaggatggggtgcttcgctcgaatatagaaattccaaaggacatcgagaagattacaaaaagcgcaaagcccacctcccgggaattgactaaatatagactgtggttagatcaaaagtacaggtcaccttacacgggccagccaatcagtctcgcccagctgtttacatctaaatatgagatagagcatgtaatcccgcaggctaagtacttcgacgatagctttaccaacaaggtgatttgcgaatccgaggttaataaagaaaagggatcaatgcttgcccacgagttcatcctgaaaaacggcgggagcactgtcaatgtgggaggtcgtcaagtgcaggtcttgaagaacgacgcatatgttgaactcattaatcgcctgtacggcaaaaacaatcccgtgaaggccaagaaactactggctgaggatatcgacgaggtggtaggggacttttctgaacggcagctcaacgataccagatatatatccagggtcgtgcagaagctgcttagtaatattgttcgagaggaagacgagcaagagagcacatctaaacacgtgatcggatgttccggccaggtcaccactgccttgaagaaagattggggtctgaacgacatctggaataagattatccagcctcggttcgaacgcttaaacgagatgacagcaacggaagattacggggtgtggcaatcaccaaatcattttcagattagagttcccgaggaaatacagaagggcttcaccaaaaagaggatcgaccaccggcatcacgcgatggatgctctcgtgattgcctgcgcaactcgaagtcatatcaactatattagcaacagatcgggacaggaccgcaatgccaaatttgagacaaccaggacagatctgcgttccaaactttgttacaaagagaactctagcggcaataactacaattatatcttcaacaagccttgggacactttcacccaagatgctcaccgggccctggaaaatatagtagtctcacacaagcagaacctaagagtgctcacgaaaaccaataactacacacagtttatcaataaggacgggaaaaaggacctgcagaaacaagtgaagggagatcatttcgcagtcaggaaaccaatgcaccaggagactatttatggtcgcgttagtatccgatccattaaggaagtggctttgaagaaagccctggagaactggaagcagatcgtagacagaaccttaaaagataagatacgggaactcattggcgcgtacgggaaatatgacgcccagacaatcctgaagtactttaaggatagggactataaattcaataaccttaagatcaatcgcgtggaggtctacgagtacgatcataactgcgctgcagtgcgtaaatctattggagacgatctgactataaagcaaatcgaaagaattaccgacgagagcatccggaaaattttgatgaaccacctctccaattatgatgacaacctgaaggaagccttttcacccgagggcctaatggaaatgaataagaacatcaaagagctgaatggtgggaagaaccatcagccgatatacaaagttaggcttttcgaggatctcggcagcaagtttcctctgggagtgagtcacaataacccagacaaatatgctatcgccgcaaagggcacgaatttgttctttgggatttacgaagaccaggagggaaagcgcatgttcgattctatccccctgaacattgtcatcgaccgattaaaagaaaagaaatcccctgtgcccgagacatataatgagagcaagctcaaatttcacctgtcgccaaacgatcttgtttacgtgcctaccgacgaggaacagaagcaacccgaactggtcgatgtagaccatttgtcagatgagcagaaaggcagagtgtataaggcggtttctttcactggtaatcgggccttctttgtgaaccacagggtcagtaaggtgatacatgactacgtagagttcgggactaaaaataagattgaaaacgatgacgataaacgctccctcaagcacatctgttggaaactgaaggtgaatagactaggagagatcaccgacgtcaagaggtga

SEQ ID NO: 3419 - RNA, 4515 nt, synthetic construct
  misc_feature 1..4515: note = Cas9 variant
  source 1..4515: mol_type = other RNA
atgaagaacatcgtgggcctggacctcgggaccaatagcattggatgggccgtcgttaacggttccgtgaatgatgacggctctgagcagcttgtaaaaatacaggcttcagggagtagaatcattcccatggatgcagccatgatcggagacttcaacaagggcaatagcatttcccaaacagcggaaaggactcggctgcgcggtgtgcgacgtttgtctgagagatacttactgaggcgggaacgcctacacagaatcctcgatatactggggtttcttcctttccattttgctcaggacctggataggcacggaaaaatcgtcaagggcaaagagccaaagttggcctggcggaagaacgaagcaggccagttcgagtttattttccaagactcgtttaaagagatgctcgaagatttcaagctgaattatccgaacctgatcacggacgataaaaaggtgccctacgactggaccatttattacctccgcaaaaaggggttaacatcaaagatcagcaaagaggaactggcctggatacttttgaattttaaccagaagcgaggatattaccagctgagaggtgaggaggaagaggaaaataaagataagctagttgagttctatgctctcaaagtggtcgcagtggaagacagtggcgagaagaaagggaaggacatttggtacaacgtacatctggagaatggatgggtttacaggcggacttccaacatgtctcttgattgggtgggcaagaccaaagaatttatcgtcacaaccgacctggagaaggatggtactcctaaaaaggacaaagaagggaatgtgaagcgtagcttccgcgccccaaaggaggatgactggtccttggtgaaaaagaaaacagaagctgatattgaccagacccacaagacggtcggagcctatatctacgatactctcctgggcaacccctcacaaaagatcagaggcaggttagttcggaccattgagcgaaagtattacaaggaggaactgaaactcatacttgagaagcagaaagaatttcatctggagttgcaggaccgcgcgctatatgcagcctgcatcgaggaactgtaccctattaacgaggctcacagaaataacgtggggaatagggatttcacatatctcttcctggaagacatccttttctaccagcggccactgaagagtaaaaagagcttgatagacaactgtccctacgaggaaaatcaaggactcgataaggagactggtgagattaaatctttccctgtaaagtgcatcgccaaatcccacccactgtttcaggaatttcgcttatggcagtttatcattaacctgagaatctataggaaggacctagcacaagatgtggacgtcaccaatgagctcctgaaaacagaagaggattacgtggctcttttcgactggttgaacggcaagaaagaaattgatcagaaggcctttctgaagtatccggttttcgggctcaaaaaggagatagagaattaccgttggaactatgtgcaggacaaaccctacccttgtaatgaaacccggtcactgatgcttgcgcgactggagaagtgcgatatcagcattgaatttttgacgaaagagaacgaagaggccctctggcatatcctgtatagtgtcgaggacaagaatgaaatcgtgaaggcattacagaaattcgctgataagcacgacctgaacgcctcttttgtagatgttttccaaaaatttccacccttcaagaaagagtacggatcctacagcgctaaggccattaagaaactactccctctgatgagaatgggcaagtattggtcggaaaattctatagacaaaggtactagggagcgcatcgacaagattatcacaggggaatacgatgagaaaattgagaaccgggtgagagaaaaggcaatccatcttgccgacgtctccgatttcaagggcttgccactgtggctcgtgtgttatatagtctacggaaggcactcagaggctaaagaaatcattcagtggaagagtcccgcggacatcgatagctatctgcgctcctttaaacagcactctttacgaaacccgattgtggagcagatcataattgagaccctgcgggttgtgcgtgacatctggaagcaagtaggcaatattgatgaaatccatgtcgagcttgggagagaaatgaaaaaccctgcagacaagaggaaaaagatgactcagcagatgagcgagaatgaaaacacaaatttgcgcataaagtacctcctgaccgagttcctaaaccccgagtatgaagtggagaatgttcggccatactcacctagtcagcaagatatcctgagaatttacgaagagggagtgctcaactccgtcagcgacctgcccgaagagatctctgatattcttaaaaagtttacggagaccgacttgaaaaagaggccatcacgaagtgaagtgctgcgctataaattatggctcgagcagaagtaccggagcccctatacaggtgaagtaatccctctgggcaaacttttcactccagcctacgagatagaacacgtgattccgcagtcctattactttgatgactctttctcgaataaagttatctgcgaggctgaggtcaacaagctgaaaagcaatttgctcgggcatgaatttatcgtgaagcaccatggagagattgtggaactgcccttcggcaaaaaggtcagaatctttaccgttgacgagtatgagcagttcgtgaaggataactactccaggacacgttcaaaaatgaagaaactactgatggacgatattcctgaagagtttgtgactcgccaactcaatgacagtcggtacatatctaaggtagtcaaaagcctgctttccaacatcgtgagagaaaagggtgaggaagaggccatttcaaagaatgttatcccatgtaccgggggcgtgacagataggttgaaaaaggactggggaattaacgaggtctggaacaaaatcatactgccccgattccagcggttaaatgaactcaccggcactaacaagtttacgacaaagaatgtggggatccaggagattcctaccatgccactggaacttcaaaagggattcaacaagaaacgcatcgatcacagacaccatgcaatggacgccattatcatagcttgcgccaataggaacattatcaattatctgaacaataagagcgcaactgcgaaagctgagctatctcggtacgatctccagaagatgctgtgtgacaaagccaagaccgataacaatggtaactataaatgggttatccgaaagccctgggcatccttcacacaggacacctacttggccctggaaaatattatagtgagttttaagcagaacttaagagtaatcaataaagctactaaccgcttcctccactataacgaggagggcaagaaaatttttgtcaagcaagggaaaggagacaattgggccatcaggaaaagcatgcataaggatacagtgttcggcgaagtgaacctgcgtcggattaaaacggtcgcacttaatgaggctatgaagaacccgcagtctatcgttgtgaaagactttaagagaaaactgttggaactctggaatctgggtttcgatgccaagaggataaagaaatactttgaggacaaccgcgaaacctggtccgatatcaatctatcaaagattgaggtatattacttcagtaaagacactaaggatcgatttttcgcgacaagaaaacctctggacaccagctttgatcggaagaagatcgagaacaatattacagacactgggatccagaaaatacttctcaggcacctggaattgaaggataacaatccagacattgccttctcgcccgatggcatcgacgagatgaaccgcaatatcattcagctgaacaatggaaaataccaccaacctatcataaagattcgttggtatgaacaggctgacaaattcgcagtgggccagaccgggaacaagtcctctaaatttgtcgaggccgctaagggaacgaatttattctttgccgtgtacgagagcaacatcctcgataagaaaaccaacacaattatcaagaaaagaaattatgcaactatacccctgaacgttgcgattgaacggcagaagcaaggccttccagtggcccctgaggacgaaaatggtaacgatcccatcttcgtcctgtcaccaaatgacttggtgtacctcccgaccgatgacgagctggctaacgggatcattgcccagcctctagataggggacgcatctataaaatggttagttcctctggcgaacagtgctttttcattaagcatatagtggcaaatgtcctggtagacaagtttgagttcagcccccttaacaaaatggagcgagctctcacaggtgaaatgatcaagatgatttgtatcccaatcaaagtggatagactgggcaatgttttggagtcctcaagcagttacaagaaatga

SEQ ID NO: 3420 - RNA, 4515 nt, synthetic construct
  misc_feature 1..4515: note = Cas9 variant
  source 1..4515: mol_type = other RNA
atgaagaacatcgtgggcctggacctcgggaccaatagcattggatgggccgtcgttaacggttccgtgaatgatgacggctctgagcagcttgtaaaaatacaagctagcgggagtagaatcattcccatggatgcagccatgatcggagacttcaacaagggcaatagcatttcccagacagcggaaaggactcggctgcgcggtgtgcgacgtttgtctgagagatacttactgaggcgggaacgcctacacagaatcctcgatatactggggtttcttcctttccattttgctcaggacctggataggcacggaaaaatcgtcaagggcaaagagccaaagttggcctggcggaagaacgaagcaggccagttcgagtttattttccaagactcgtttaaagagatgctcgaagatttcaagctgaatcatccgaacctgatcacggacgataaaaaggtgccctatgactggaccatttactatctccgcaaaaaggggttaacatcaaagatcagcaaagaggaactggcctggatacttttgaattttaaccagaagcgaggatactatcagctgagaggtgaggaggaagaggaaaataaaaacaagctagttgagttctacgctctcaaagtggtcgcagtggaagatagtggcgagaagaaagggaaggacatttggtataatgtacacctggagaacggatgggtttacaggcggacttccaatatgcctcttgactgggtgggcaagaccaaagaatttatcgtcacaaccgatctggagaaggacggtactccaaagaaggataaagaagggaacgtgaagcgttctttccgcgcccccaaggaggacgattggagcttgctcaaaaagaaaacagaagctgacattgatcagacccataagacggtgggagtctacatctatgacactctgttaggcaacccttcccagaaaatcagaggcaggctggttcggaccattgagcgaaagtactataaggaggaactcaaacaaatacttgagaagcagaaagaatttcacctggagttgcaggatcgcgccctatacgcggcatgcatcgaggaactgtatccaattaatgaggcccacagaaacaatgtggggaacagggacttcacatacctcttcctggaagatatccttttctatcaacggcccctgaagagtaaaaagtcattgatagacaattgtccttacgaggaaaaccagggactcgacaaggagactggtgagattaaatcattcccagtaaagtgcatcgctaaatctcatccgctgtttcaggaatttcgcttatggcaatttatcgtgaatctgagaatttacaggaaggatctagcccaggacgtcgatgtgaccaacgagctcctgaaaacagaagaggactatgttgcacttttcgattggttgaatggcaagaaagaaatcgaccagaaggcttttctgaagtaccccgtgttcgggctcaaaaaggagattgagaactatcgttggaattacgtccaggataaaccttatccatgtaacgaaacccggtccctgatgcttgcccgactggagaagtgcgacatatcaatcgaatttttgacgaaagagaatgaagaggcgctctggcacattctgtacagcgtggaggataagaacgaaatcgtaaaggccttacaaaaattcgcagacaagcatgatctgaatgctagttttgttgacgtgttccagaaatttccccctttcaagaaagagtatggatcttactccgccaaggctatcaagaaactactcccactgatgagaatgggcaagtactggagcgaaaactcgattgataaaggtactagggagcgcatagacaagatcattacaggggaatatgacgagaaaatcgagaaccgggtcagagaaaaggccattcaccttgcagatgtgtctgacttcaagggcttgcccctgtggctcgtctgttacatcgtgtatggaaggcactccgaggccaaagaaataacccagtggaagtcaccggctgatatcgacagttacctgcgcagctttaaacagcattccttacgaaatcctattgttgagcaaatcattatcgagactctgcgggtggtacgtgatatatggaagcaggtcggcaacattgacgaaatccacgtggagcttgggagagaaatgaaaaatcccgcggataagaggaaaaagatgacacagcagatgtctgagaacgaaaataccaacttgcgcattaagtatctcctgacggagttcctaaatccagagtacgaagttgagaacgtgcggccttatagcccctcacaacaggacatcctgagaatatacgaagagggagtcctcaatagtgtgtccgatctgccagaagagatcagcgacattcttaaaaagtttaccgagacagatttgaaaaagaggccctctcgatcagaaatcctgcgctacaaattatggctcgagcagaagtatcggagtccttacactggtgaagtaattccactgggcaaacttttcaccccggcatatgagatcgaacatgtgataccccagagctgctactttgacgattccttctctaacaaagttatttgtgaggccgaggtcaataagctgaaatcgaacttgctcgggcacgaatttatcgtgaagcatcacggagagatcgtggaactgcctttcggcaaaaaggtcagaatttttacagttgacgagtatgagcaattcgtgaaggacaattacagcaggactcgttccaaaatgaagaaactactgatggatgacatcccagaagagtttgtgacccgccagctcaacgattcacggtatattagtaaggtagtcaaatctctgcttagcaatatagtgagagaaaagggtgaggaagaggctatctccaagaacgttattccctgcacagggggcgtgaccgacaggttgaaaaaggattggggaatcaacgaggtctggaataaaattatcctgcctcgattccagcggttaaacgaactcactggcacgaataagtttacaaccaaaaacgtggggatacaagagatcccaactatgcccctggaacttcagaagggattcaataagaaacgcattgaccacagacatcacgccatggatgcaatcattatcgcctgtgctaacaggaatataattaactacctgaataacgagtcagccaccgcaaaggcggaactaagccggtacgacctccagaaaatgctgtgcgataaggctaaaacagacaataacggtaattataagtgggttatccgaaaaccgtgggcctctttcacccaggatacttacttggcactggagaacatcattgtgtcctttaagcaaaatttaagagtaataaacaaggccacaaaccgcttcctccattataatgaggaaggcaaaaagatctttgtcaaacaggggaagggagacaactgggctattaggaaaagtatgcacaaggacacggtgttcggcgaggtgaatctgcgtcggatcaagaccgtcgcccttaacgaagcaatgaaaaatcctcagagcattgttgtgaaggattttaaaagaaagctgttggagctctggaacctgggtttcgacgctaaaaggatcaagaagtactttgaagataatcgcgagacttggtctgacataaacctatccaaaatcgaggtatattacttctcaaaggatacaaaagaccgatttttcgccaccagaaagccactggatacaagttttgaccggaaaaagattgaaaataacatcactgataccgggattcagaagatccttctcaggcacctggagttgaaagacaataaccccgatatagcgttcagccctgacggcattgatgaaatgaatcgcaacatcatccaactgaataacggaaagtatcatcagcccattatcaaaatacgttggtacgagcaggccgacaagttcgctgtgggccagacggggaataaattttcgaagttcgtcgaggcagccaaaggaaccaacttatttttcgctgtgtacgaatccaacattctcgacaagaagacaaatactatcattaaaaagagaaactatgccaccatcccactgaatgttgcaatagagcggcaaaaacagggccttcctgtggcgcccgaagatgagaacggtaatgacccaatttttgtcctgtctccgaacgatttggtgtacctccctacagacgatgaactggccaatgggatcatcgctcagcccctagacaggggacgcatttataagatggttagctgtactggcaacgagggtcacttcatcccagcccgaattgcaaatcccatactgcaaaccatcgagcttggctcaaacaataaagctcagaaggcctggacggatgaaatgattaaggagatctgcatgcctatcaaagtggacagactcgggaacgtcctggaaagttcctctagctacaagaaatga

SEQ ID NO: 3421 - RNA, 4521 nt, synthetic construct
  misc_feature 1..4521: note = Cas9 variant
  source 1..4521: mol_type = other RNA
atgaagaccatcctgggcctcgaccttgggcccaacagcattggatgggccaaagtggaggtcgatgacgaaggtaattacctgagaaacataaagttgggctccaggatcattcctatgacacaggatatgttaggggacttcgataaaggagttaaggtgtctcaaactgctatccggacggactttcgcggcaatcgacgtctgattgagagacacctactcaggcgggaacgcctgcatagagtacttcacgcactgaaattcttgccaaagcattatgaggatgccatcggttgggacaggaacgaaccggcgacctacgggaagtttgtgaataactcagagcccaaactcgcttgggagcggcaggaagatggaagtatgcgcttcctgtttatggagagcttcaatgaaatggtcgccgactttgcacagaaccagccttccctggtgtctgatggcaagaaaataccactcgactggacaatctattacttacgaaagaaagccctgactagacccattaagaaggaggagcttgcttggatcttgctgaatttcaaccaaaaacggggctattaccagctacggggagaagaggaagaggataatctcaccaagcgtaaagaatattacaagctgaaagttgtgggagtcgaggcagacggtgcccctaagggcgggaaaacatggtacaacattcaccttgagaatggatggaccgctcgctgccagtcgaagatcccactggacgattgggtgggcaaggtaaaagaatatatagttactacagagtacgaagacgatggtaagacccccaaatgtgacaaggaggggaaagtgaagagatcatttaagagccctgaaaaagatgactggcagttgattaagacgaggactgagaaattcatcgatgacagtaacaagaccgtcggagcctttatttatgattacctcctggagaaaccattcgacaagatccggggcaagtatatccgaacaattgaacgcaaatactataagaatgagttaagagaaatactgagggagcaaactaaataccatgaaggcctccactcccttgaggcgctgaagatctgcgcagaggaattgtacaaaaacaaccagcagcaccaggagtatctactgaagaaggatatgacctttctcctgcttaatgacctgattttctaccaacggccgttgaaatctaagaaaagcctcatcgccgactgtccctatgaagtgtacaagtatgatgacaaactgacagggaagaaaggacagaagaagataaaatgcattgctaagtccaacccttactatcaggagttccgcttatggcaatttatcgccaatctgagactattctcagtgaccgatggtaaagaggtcacggcagaatacctcaagactgaggaagactacgttaggctgtttagtttccttaacgatcgtaaagacatcaagcaggagacatttttgcggagcttcctgaagctcaaaaaggaatctattggctccgagaaaatctatccaattcgatggaattacatagaggatgctaacaagtcatatccctgtaatgccaccagacatgaactgcttctggcgtttgacagggccgatatccctcgcgagttgctcgacgtggaagagagggaatacagactgtggcacttactgtatagcattgaggcaaaagaggaaactgagagtgctctaaggaagctcaaggccaacaaggctttcggggatctgaatatcgacgatgcctttgtaaactctttccttaaaatcaaaccatttgaaaaggagtacggagcatattccgaaaaagccattaagaagttgctggctgtgatgcgccgaggcagcctctggaaagaggcggacatatgcgaggcaacaaagcagaatatcgccaaaattctgcagaacgacatcgatgaaaagctgaaaaagaaaattgaggctgccgtctcgtctttcaataagttatccgactttcaaggtcttcccacctggttggcatgttacgtggtttacgggcggcattcagaagccgctcagatccagtgctggcagagtccggaggatctcaagacgtatataaacaaattcaagcaacacagcctgcgtaatcctatcgtggagcagtgtctactggaaaccctcagaacagtctacgacatttggaaagatgccggccagatcgacgagattcacatcgaactgggaaggaacatgaagtccactgcagagcagcgcgcgcggaaaaccaaggatatacttagaaacgaaaatacaaacttgaggattaagaatctgttagtggagctcaaaaacgacgataagatcgagaatgtacgaccctattctccaagccaacaggaaattctgcgcatctacgaggaaggcgcccttcaggagctgtcaaaagaagacgagatgttcgaggatataagtaagatctccaaaatggctcagcctagccccactgaattgtctcggtataagctctggctggagcaaaagtacagatcaccatataccgggagggttattcccctaagtaaactgtttacaaccgcataccagatcgaacatattatccctcagagccgttacttcgacgattcctttaacaataaggtgatatgcgagtctgaagtcaactcgctcaaagacaatatgctgggatatgagttcattaaggagtgtggtggccgcatcgtgcactgcactcttttgggggacgtcaaaatctttacgaaggaagagtacaaggatttcgtgacaaaacattatattgacaacacctacaagcgggataaactgttactcgaagacatcccacaagagtttagcgccagacagctgaatgattccaggtatatttcaaagatggttcagactgtgcttagtaacatagtacgagctgagaatgaacaggaggccacctctaaattcgtcgtgagctgcaacggagcaatcacaaatcggctgaagaaggactggggcctaaacgatgtttggtcctcaattgtgtgtccgcgctttaaaagactcaacgaaatcaccaagactaatgctttcggtcactgggaggacaaagccgggaagcatgtctttcaaacaacggtgcccctggaattgcagaggggcttcagcaaaaagcggattgatcaccgacaccatgcgatggacgccctggtaatcgcttgcgcatctagaaacatagtgaattacttaaacaatgagtccgccaacagtcctgagaaacgcgaagatctcaggaagaagctgtgtgacgagaaacgtaagatccggaaaccatggaagacctttactcaggacgctagagaagcccttagcgatgttgtcgtgtctttcaaaaattatgtgagggtcattaacaaggcaacaaattactacgagcactattcctcaagtggaaacaaggttatgatcagccagaaaggcaatgacatgtgggcgattcgcaagcccctgcataaagaatcggtgttcgggcgagtgaacttgtgcagaaaggtaatcgtctccctcaaaaaggccctggagaatatacctgctatttgtgataagaccctacgggactacatcaacgccctggtggagaaacactttaatacaaggcaacttctcgcacacttcaagtctatcaactatcgcctgaaccgtcagtgcgttgaaaaagtggaggtctggcagtttagcgatgaaaagattgagatggtggctagacggaaatcattggacaccagtttcgatgacaagcagatatcctctatcactgatacggggattcaaaagatcctgttaaattacctccagaccaaagacggtaacgccgaaattgcatttacaccagagggcatcgaggaaatgaataagaacataagcctgtataatgatgggaaagcccatcagcccatccttaaggttagggtggctactccgaaaggaatgaagtaccctgtaggccaaaccggtaacaaagcgacaaagttcgtcgtggccgagaaggggactaatctgtattttgcaatttacgaaaacgagttgggcgtgcgctcctacgacaccatcccactcaatattgtcgttgagcgactgaaagaaggactatcacccgtgcctcaggctaacgaggccgatatccccctgaagttctatcttagcccaaatgacctcgtatacgtgcctacgaaagaaaacgaggacgaactgtgtagagatcggatatataagtttgtcgacagttctggcacaaccgccaatttcgtgccccacacttccgctaacacaatttacaatgttgataaagagtatgcagagaagtgctgtaacggggccgtgtttttgaatgaatacggattaggcagcccacagtcgaagaaccagagggcgctgaccggtgagatgatcaaagaaatctgctggaagctcaaagtcgaccgcctggggaacattatcaaggtgataaaatga

SEQ ID NO: 3422 - RNA, 4530 nt, synthetic construct
  misc_feature 1..4530: note = Cas9 variant
  source 1..4530: mol_type = other RNA
atgaagaacatcgtgggcctggacctcgggaccaatagcattggatgggccgtcgttaacggttccgtgaatgatgacggctctgagcagcttgtaaaaatacaagcatcagggagtagaatcattcccatggatgcagccatgatcggagacttcaacaagggcaatagcatttcccagacagcggaaaggactcggctgcgcggtgtgcgacgtttgtctgagagatacttactgaggcgggaacgcctacacagaatcctcgatatactggggtttcttcctttccattttgctcaggacctggataggcacggaaaaatcgtcaagggcaaagagccaaagttggcctggcggaagaacgaagcaggccagttcgagtttattttccaagactcgtttaaagagatgctcgaagatttcaagctgaatcatccgaacctgatcacggacgataaaaaggtgccctatgactggaccatttactatctccgcaaaaaggggttaacatcaaagatcagcaaagaggaactggcctggatacttttgaattttaaccagaagcgaggatactatcagctgagaggtgaggaggaaaagaagaatgataacgttatgattatcaatagtaaagtgattgacgtcgtgaaggctgagaaagacaagaagtacgaaaaatattggtacaacgtactactcgagaatggcctgctttacagggcagccttctataacgatatctccttttggaaggggcacactaaagagttcgttctgaagaccatcaaattgaagtctggaggcacaaagcaggaactcagctttctgccttccttcgacgagattgagaaaatggaaaagaaacaaaaggataaaatgtacttcaagataaagttaaaaaccgaagctgacatcgatcaggcccataagactgtgggtacatatatttacgacaccctgctcgggaacccatcacagaaaatccggggacgtcttgtccgcacgatagagagaaagtattacaaagaggaactgaagttgattctagataagcagaaagagtttcaccccgaactgcaagacagggcgctctatgcagcctgcatcgaggaactgtaccctatcaatgaggctcaccggaacaatgtgggcaaccgagatttcacttacctttttctggaagacattttgttctatcagcgcccactcaagagtaaaaagagcctgatcgataattgtccctacgaggagaaccagggcttagacaaagaaaccggggagattaagtcttttcctgtgaaatgcatagccaagtcccatccactgttccaagaatttagactatggcagttcatcgtcaatctcaggatttatcggaaggacctggcacaggatgttgacgtgacaaacgagcttttgaaaactgaggaagattacgtagctctgtttgactggctcaatggaaagaaagagatcgatcagaaggccttcctgaaatatccggtgtttggtcttaagaaggaaatcgagaactaccgctggaattatgtccaagacaaaccctacccttgtaacgaaaccagactgttgatgctcgcgaggctggagaagtgcgatatttcaatagagttcttaacaaaagaaaatgaggaagccctgtggcacatcctatacagcgtggaggacaagaacgaaattgttaaagcactccagaagtttgctgataagcatgacctgaatgccagtttcgtggatgtcttccgtaaatttccacccttcaagaaagagtatggctcttactccgctaaggccatcaaaaagttgcttcctctgatgcggatggggaagtattggagcgaggactcgattgataaaggaacccgaaagagaatggacaaaatcataacgggcgaatacgacgagaagatcgaaaacagggtgcgcgagaaagtaattcacctcgcagatgtttctgactttcggggtctgccattatggctggtgtgttatatcgtctacgggagacactccgaagccaaggagattactcagtggaaatcacccgctgatatcgacagttatcttaagagcttcaagcagcattccttgaggaacccgatagtggagcaaattatcattgaaacactccgcgtcgtgcgagatatctggaaacaggttggcaatatagacgagatccacgtggaactgggacgggagatgaagaaccctgcggataaacgtaagaaaatgacccagcagatgtctgagaatgaaaacactaatctaagaattaagtacctgctcacagagtttctgaaccccgaatacgaggtagaaaatgtcaggccatatagcccttcacaacaggacatccttcgcatttacgaggagggcgtgttgaacagtgtttccgatctgcccgaagagatcagcgacatattaaagaaattcaccgaaacggatctcaagaaacggccatctagatcagagattctgaggtataaactttggctggaacagaaataccgaagtccctataccggggaggtgatccctttgggaaagctctttacaccagcatacgagatcgaacatgtcattccgcagagctgctatttcgacgattccttttctaataaggtgatctgtgaggccgaagtaaacaaactgaagtcgaatctactgggtcacgagttcattgtgaaacatcacggcgaaatagttgagctcccctttgggaagaaagtccgcatcttcactgtggacgagtacgaacaatttgtgaaggacaactacagccggaccagaggaaagatgaaaaagctgcttatggatgacattcctgaggagttcgtcgctaggcagttgaatgattcccgttatatctcaaaagttgtgaagagtctgttatctaacattgtgcgcgaaaaaggcgaggaagaggccatcagcaagaatgtaataccatgcacaggtggggtcactgaccggctcaagaaagattggggcatcaacgaagtgtggaacaagattatcctgcccagattccagaggcttaatgagctgaccggaacaaacaaatttaccactaagaatgttggcattcaagaaatccctacgatgccactagagctccagaaagggttcaacaagaaacgaatagaccaccggcatcacgcaatggatgccattatcatcgcttgtgccaatcgcaacattataaattacctgaacaatgagtccgcaacagcgaaggctgaattgtcaagatatgacctgcagaagttactctgcgataaagccaagaccgacaacaatggaaactacaaatgggtgatcaggaagccctgggctagctttactcaggatacctatctggcccttgagaatattatcgtctctttcaaacaaaacctgcgggtgattaataaggctacaaaccgatttttgcattacaacgaagagggtaagaaaatcttcgttaagcagggcaaaggggacaattgggccataagaaagtccatgcacaaagacaccgtgtttggagaagtaaacctccgcaggatcaagactgtcgcactgaatgaggctatgaagaacccgcagagtattgtggtgaaagatttcaagcgtaaactactggagctttggaatctcggctttgacgccaagcggatcaaaaagtatttcgaagataacagagagacatggagcgacattaatctgtctaagatcgaagtctactacttttccaaagatacgaaggacaggttcttcgcgacccgcaaacctttggatacttcatttgaccgaaagaaaatagagaacaatattacagataccggtatccagaagatcctgttaagacacctcgaactgaaagacaacaatccagatattgccttcagtcccgacgggatcgatgagatgaaccggaatataattcaacttaacaatggcaagtatcatcagcctatcattaagatcaggtggtacgagcaggctgacaaatttgcagttggacagacaggcaacaagttcagcaaatttgtggaagccgctaaggggactaatctgttctttgccgtatatgagtcgaacatattggacaaaaagaccaacacgattatcaagaaacgcaattacgcaaccatccccctcaacgtggcgattgaacgtcaaaagcagggactgccagtcgcccctgaggatgagaatggcaacgaccccatcttcgtgctatccccaaatgatctggtttatcttccgacagacgatgaactcgctaacggtattatagcccagcctctggacagagggcggatctacaaaatggtgtcttgtactggaaatgagggccactttattcccgcaaggatcgctaacccaatcttgcaaaccattgaattaggtagcaataacaaggcccagaaagcatggacagatgagatgataaaggaaatctgcatgcccattaaggtcgaccgcctgggcaatgtgctcgagtcaagttcctcttataaaaagtga

SEQ ID NO: 3423 - RNA, 4530 nt, synthetic construct
  misc_feature 1..4530: note = Cas9 variant
  source 1..4530: mol_type = other RNA
atgaagagaatcctgggcctcgaccttgggaccaacagcattggatggtccctgatagagcacgatttcaaaaataagcagggtcagatcgaaggcttgggggtgaggattatccccatgtctcaggagattttaggaaaatttgacgccggccagtcaatcagtcagacagctgatcggactaagtaccgcggtgtccgacgtctgtatcaaagagacaacctaaggcgggaacgcctccatagagttctgaaaatacttgatttcctgcctaagcactacagcgagtccatcgactttcaggataaggtggggcagttcaaaccaaagcaggaagtaaaattgaattataggaagaacgagaaaaataagcatgagtttgtgttcatgaactcttttattgaaatggtctcggagttcaagaatgcacaaccggaactcttttacaacaaaggaaatggcgaggagacgaagatcccctatgactggaccctgtactatctgcggaaaaaggccctcacacagcagattactaaagaagagttagcgtggctgatccttaacttcaatcagaagcgcggctactaccaattgcgaggggaagatatagacgaggataaaaacaagaagtatatgcagctgaaagtgaataacctaattgactcaggagctaaggttaaaggtaaggtgctctacaatgtcatctttgataacggctggaaatatgaaaagcagattgtgaacaaggacgagtgggaggggagaaccaaagaatttatcatcacaaccaagactctgaaaaatggaaacattaagaggacatacaaagccgtagacagcgagatagattgggcagccatcaaggctaagaccgaacaagacattaataaagcaaacaagacggttggcgagtatatctacgaaagtcttctggataatccttcccagaaaatacggggtaagttggtgaaaactattgagcgtaagttctataaggaggaatttgagaaactcctgtctaagcagatcgaattacagccagagctgttcaacgaaagcctctacaaagcctgcatcaaggagctttacccccgcaatgagaaccaccaatccaataacaaaaagcaggggttcgaatatctgttcaccgaggacattatcttttaccagagacctttgaaatcacagaagagtaatattagcggatgtcaattcgaacataagatatataaacagaagaacaaaaagacaggcaaactagagctgatcaaggagccaattaagactatctctaggtcccaccccctctttcaggagttccggatctggcagtggctgcaaaatcttaaaatttacaacaaggagaaaatagaaaatggcaagctggaggatgtcaccacacagttgctccctaacaacgaggcttatgtgaccctgtttgacttcttaaatacgaaaaaggaactggagcagaagcagtttatcgaatacttcgtgaaaaagaaactaattgataagaaagagaaggaacactttcgatggaacttcgtcgaggacaagaaatatccattttcagaaactcgcgcccaattcctcagcagactggcgaaggttaaagggatcaagaatacagaggatttccttaacaaaaatacccaggtgggaagtaaggagaactctccgtttattaaaaggatcgaacagttgtggcatataatctactccgtaagcgacctgaaggagtacgaaaaggcactcgagaaattcgccgaaaagcacaatctggagaaagattcgtttcttaagaacttcaaaaagtttccccctttcgtgtctgactatgcttcctactcaaagaaagccattagtaagctgttgccaatcatgcggatgggtaaatattggagcgagtccgcagtccccactcaagtgaaggaacgctctctcagcattatggagagagttaaagtgctgcctttaaaggaaggctactcagacaaggatctggctgacctactcagtagggtctccgatgacgatatcccaaaacagctgataaagagctttatttctttcaaagacaagaatccccttaaagggttgaacacatatcaggccaattacctggtgtatggacgtcattcagagaccggcgatatccagcactggaagacgccggaggacattgatcggtacctcaacaattttaagcaacacagtctgcgaaaccctatcgtagaacaggttgtgatggagaccttaagagtcgtgagggacatatgggaacattacggtaataacgagaaagatttctttaaggaaatccacgtcgagctggggcgcgagatgaaaagccccgcgggcaagcgggaaaaactttcccagagaaacacagagaatgaaaacactaatcataggattcgcgaggtgttgaaggaactcatgaacgacgcctctgttgagggaggcgtgcgagattattcgccaagccagcaagagatcctgaagctatacgaagaggggatttatcagaatcctaacaccaattacctgaaagtagacgaagacgagatcctcaagatacggaaaaagaacaatcccacacagaaagaaattcagcgttataagctgtggcttgagcaaggatacatctccccatatactggtaaaatcattcccttgaccaagctgttcacacacgagtaccagatcgaacatattatacctcagtcaagatactatgataacagtttaggcaataagatcatttgcgagtctgaagtcaacgaggacaaagataataagaccgcatacgagtatctcaaagtggaaaaggggagcatcgtttttggacacaaactgcttaacctggacgagtacgaagctcacgtgaataagtatttcaagaaaaacaagactaaattgaagaacctcctgtccgaggatattccagaaggcttcatcaataggcaactaaacgactcacgctacataagcaaactggtcaagggtctcctgtctaatatcgtgcgggagaacggggagcaggaagccacgtccaagaatcttattccggtaacaggcgtggttaccagtaaattgaagcaggattggggactgaacgacaaatggaatgagatcattgctcccagatttaagaggttaaacaaactcactaatagcaacgatttcggcttttgggacaatgatatcaacgccttccgaatacaggtccctgactctctgattaaggggttttccaagaaacgcatcgatcatcggcaccatgcacttgacgccctggtggtggcttgtacctcaagaaatcacacacactatctaagtgcgctcaacgcagaaaataagaactacagcctgagggacaaattggtcatcaagaatgagaacggagattacaccaaaactttccaaattccatggcagggttttacaatagaagccaagaacaatctggagaaaacggttgtgtcgttcaagaagaacttacgtgtgatcaataaaaccaacaataagttttggtcctataaagacgagaacggcaatctcaacctggggaaggatggaaaacccaagaagaaacttcgcaagcagactaaaggctacaattgggctattcggaagcctctgcataaagaaacagtatctggtatctataacattaatgccccaaagaacaagatcgcaaccagcgtcagaacattgctcactgagataaagaatgaaaagcacctggccaaaatcaccgacctaaggattcgagagacgatcctgcccaaccatcttaagcactacctcaataacaaaggggaagctaacttctcagaggcctttagtcagggcggaattgaggatctgaataagaagatcaccacattgaacgaaggcaaaaagcatcaaccgatatatcgggtgaaaattttcgaggttgggtccaagttctctatcagcgaagacgaaaattccgcaaaatcaaagaaatacgtggaggcggctaagggaactaacctgtttttcgccatctatttagatgaagagaataagaaacgcaactacgaaaccattcctctcaatgaggtcatcacacaccagaaacaggtggcaggctttccaaaaagcgaaagactgagtgttcagcccgactctcaaaagggtactttcctttttaccctgtcccctaacgatttggtgtacgtacccaataacgaggagctcgaaaatagggacctgttcaacctagggaatctgaacgtcgagcagataagccggatttataaatttacggattcgtcagacaagacatgcaatttcatcccatttcaggtgtctaaacttattttcaacctcaagaagaaagaacagaagaaactggacgtggattttatcatacaaaacgagttcggattgggcagtcctcagtccaagaatcaaaagagcattgacgatgtcatgatcaaagaaaagtgtatcaaattaaagattgaccgactgggtaacatctctaaagcctga

SEQ ID NO: 3424 - RNA, 4530 nt, synthetic construct
  misc_feature 1..4530: note = Cas9 variant
  source 1..4530: mol_type = other RNA
atgaagaccatcctgggcctcgaccttgggacaaacagcgtgggatgggccgtcattaattccgttataaaagagcaggctgaaagaatctggattgagatggcaggttctaggatcattcccatggatgccgcggtgctgggcgacttcgataaggggaactcaatcagtcaaactagcgaacggacgcgcttgcgaggagtacgtagattaagggagcggcagctgctacgcagagaaaggctccacaaagtgctgaatatacttggctttctgcctaaccattacttggagtatatcgacttcgagaagcacccaggtaaatttctctccgatgctgaaccgaagctgccctgggtcaaggacgagcaggggaaatacaccttcctgtttcaggccgcattcgatgaaatgctcgccgactttgctattcatcaaccttctttagtgtcgggagataagaaaatcccatatgactggacaatttactatctgcggaagaaagcacttactgagatgatctcaaaggaggaattggcctggatactgctaaatttcaaccagaagcgcggctactatcagctccgaggcgaggaagaggaagataatgctgggaaaagcgttgagttttacgccctgaaggtgcttaccgtcgaggcgacagacgaaaagaagggaagagatgtgtggtacaacgtacacctggagaatggttggatttataggcggagttcctctgttcccttggactgggaaggccagatcaaagagttcattgtgaccactgacctcaaccctgatagcacaccaaagctggacaaatacggggaagtcaagcgttcctttcgcgcacccaaggaggatgactggatgttaatcaaaaagagaaccgaggccgatatcgctaatacgcataaaactgtgggagcctatatttacgacaccctgctccaaaagcctcagcagaaaataatcggcaaacttgtgaagacagtcgaaaggaaactgtatcgggatgagttgtcactaattctgcagaagcaatgcgcattccacgctgaactccaggaccgaactctgtacgcccgctgtgttgaggcgctttatccaaacaatgaagtgcagagaaggaacatcgccaatcgggattttgtatacctgttgatggacgatgtcctcttctaccaacgcccgctgaaaaccaagaaaagtttaatagcaaactgcccctatgaggagaacgaatacgtggacagagagacaggtgaaattaagaaggctcctctgaaatgtatcgccaagagccacccactattccaggagtttaggctctggaatttcctgtctaacatccgtatttatcagaaagagaaggaaatcaatgggacccttcatttggacgtggatgttacggctgagtttctgaaaactgaagacgattacgtggccctcttcgactggctgaactcccggaaggagattgaacagaagacatttcttaaatatcccaagttcggactgaaaaaggagatatcaaattaccgatggaactatgtcgaggataaacaatacccttgcaatgaaaccagacacgcaatcttgagcaggctcgagaaggccaacgtgtgtattgactttctgagtaatgaaaaagaggtagctttatggcatatcctgtactctgtttccgataagcaggaaatcgagaaggcgctacgcactttcgcagccaaaaacggcctcgacgagagctttgtggaagcattcaagaaatttccacccttcaagtcggagtatggcgcctactctgcaaaagccattaagaagctgcttccgttgatgcggtgcgggaaatattgggatgtctcctcaatagacgatacaaccaaggaaagaatcaaaaagattgtggctggagagtacgacgaaaggatcgccgtcaaagtgcgcgataaggttatgaatctgagtgacattagctgttttaagcgactccctctgtggttagcatgctatatcgtgtacaaccggcactccgaggacaaagaggcggtaaagtgggaatctcccgctgatatagacgcctatctggctagcttcaaacagcactcacttcgtaatccaatcgtcgaacaggtgattacggaaaccttgagagttgtgagggatatctggaagcaagtcggtcgcattgacgagatccatatagagctcggccgggaaatgaaaaaccctgccgataagagaaagaggatgacagctcagattctggagaatgaaaacgccaacctacgaatcaaagcactgctcgctgagttcatgaatcccgaatacgagattgagaacgtgcgcccatacagtccctcccagcaggaaatcctgcggatatatgaggacatggtacttcacgccgaagatcaattgcctgaggaaatcgacgcgattctgaagaaatttaatagctctaaggtgccaactaaatcagagttcttaagatacaagctctggctggagcagaaatataggagtccgtacaccggggaacttatccccctgggaaagttgtttacagccgcttatgagattgaacatgttatccctcagagccgttacttcgatgactccttttctaacaaggtcatatgtgagtcggcagtgaataaactcaaggataaccagctgggctatgagttcattaaaaatcaccatggtcaaaaggtggaggtcgggtttggcaaaagcgttgagatcttctccgtggactcatacgaacgctttgtgaaggagcagtacgccaagagtgctgtaaaaatgaagaaaatgctaatggatgacatcccagaacagttcattgagcggcaactgaacgactctagatatatcagcaaggtcattaaaggactcctgtccaatatagtgagggagaagaacgattcaggcgaatacgagcccgaagccgttagcaagaatatcgtggtctgcactgggtctgtgaccgaccgacttaaacgggattggggaatgaacgacgtttggaactccattgtgtatcctcgctttgagagattgaatagtctgacagatacccagagcttcggtcactgggaaaataagtctggcaaaaaggtatttcagactgagttaccactcgagtaccagaaagggttctccaagaagaggatcgaccaccggcatcacgcaatggatgcgattgtcatcgcctgtgctacgcgaaaccatgtgaactatctgtcaaatgaaagtgccagcagaaacgcaaaaatatcgcgctacgaccttcaaaggctgctatgcgataagtcccgtacagacgataatggaaactataaatgggtgatcaagaaaccctgggacaccttcactcaggacgctcgggaggtcctctctaagattgttgtgagcctgaagcagaatttgagaatcattaacaaaaccacaaatgtatacaggcacctggatgccaccggcaaccgcgtgtacgaaaagcagaaaactggtgactcatgggcaatccgaaagccgatgcacaaagatacagtctttggggccgtgaatttaagaaaggttaaagtggtccggctcagtgtggctctggacgcgcctacgatgatagttgataagagggtgaagaacaaagtcttcgagcttctgtcctataagtacgacaaaaagcgcattgaaaaatattttaaggagaatgccgtattgtggaaggagctcgatctggcacgtgtggctgtttactatttcaccgaagccactacagagcccctagtggccgtcagaaaaccactggactctacctttaacgaaaagaaaatcaaggagagcgtgacagatactggcatccagaaaattcttctcaatcatctgtgcaccaaggaaggaaagcctgacttggctttctccgcagagggcatagaggaaatgaaccggaatctgttacaactcaacaacgggaaaaggcaccagcccatctacaaggtacgcgtgtatgagccacgaggaaataaattttcagtcggtgttctgggcaacaaggggacgaaatgggtggaagccgcgaagggaaccaatcttttctttgctatttacatcacagaggatggcaagagaacttacgagaccattcctctgaacatggtgatcgaacgggagaaacagggtttggcccccgtcccagacaagaatgaaaaaggggataagctcctgttctggctaagcccgaacgacctggtgtatcttcctacagaggaggaactcgagtttggcaggataaatgaacccatcgaccgcggaagaatttacaaaatggttagttcttccggcaaccaatgtttcttcatcccacagagcatttcgaatgcaatcatacccactaaggagctgggggccaacaataaagctgaaaggtcatgggatggagcaatgattaagaacatctgcatccctgtaaaggtggaccggttgggccgtattatcgaggtcaaatatcgcataaatgaatga

SEQ ID NO: 3425 - RNA, 4530 nt, synthetic construct
  misc_feature 1..4530: note = Cas9 variant
  source 1..4530: mol_type = other RNA
atgaagaccatcctgggcctcgaccttgggacaaacagcgtgggatgggccgtcattaattccgttataaaagagcaggctgaaagaatctggattgagatggcaggttctaggatcattcccatggatgccgcggtgctgggcgacttcgataaggggaactcaatcagtcaaactagcgaacggacgcgcttgcgaggagctcgtagattaagggagcggcagctgctacgcagagaaaggctccacaaagtactgaatatacttggctttctgcctaaccattacttggagtatatcgacttcgagaagcacccaggtaaatttctcgccgatgcagaaccgaagctggcctgggtgaaggacgagcaggggaaatacaccttcctgtttcaggctgcattcgatgaaatgctcgccgactttgctattcatcaaccctccttagtctctggagataagaaaatcccttatgactggacaatttactatctgcggaagaaagcccttactgagatgatctcgaaggaggaattggcgtggatactgctaaatttcaaccagaagcgcggctactatcagctccgaggcgaggaagaggaagataatgcagggaaatcagtggagttttacgccctgaaggttcttaccgtggaggctacagacgaaaagaagggaagagatgtctggtacaacgtgcacctggagaatggttggatttataggcggagcagttccgtaccattggactgggaaggccaggttaaagagttcatcgtgaccactgacctcaaccccgatgggacacctaagctggacaaatacggagaagtcaagcgttcttttcgcgccccaaaggaggatgactggatgttaattaaaaagagaaccgaggcagatatcgctaatacgcataaaactgtgggcgcctatatctacgacaccctgctccaaaagccccagcagaaaattataggtaaacttgtgaagacagtcgaaaggaaactgtatcgggatgagttgagcctaatcctgcagaagcaatgcgcgttccacgccgaactccaggaccgagcactgtacgctcgctgtgttgaggccctttatccttccaacgaagtgagaaggaaaaatattgctaaccgggattttgtatacctgttgatggacgatatcctcttctaccagcgcccactgaagactaaaaagtcattaatagccaattgcccgtatgaggagaacgaatacgtggacagagagaccggggaaattaagaaaacacccctgaagtgtatcgcaaaaagtcaccctctattccaagagtttaggctctggaacttcctgagcaatatccgtatttatcagaaggagaaagaaatcaacggaacccttcatttggacgtcgatgtgacggccgagtttctgaagactgaagacgattacgttgctctcttcgactggcttaattctcggaaggagattgaacagaaaacatttcttaagtatccaaaattcggcctgaagaaagagatatccaactaccgatggaattatgtggaggataagcagtacccctgcaacgaaaccagacacgcgatcttgtcaagcctcgagaaagcaaatgtctgtattgactttctgagtaacgaaaaggaggtggccttatggcatatcctgtactctgtatccgataagcaagaaatcgagaaagctctaaggactttcgccgcaaagaatggcctcgacgagagctttgttgaagccttcaaaaagtttcctccattcaaatcggagtatggggcttactctgccaaggcaattaagaaaatgctgccccttatgcgctgcggaaagtattgggatgtgtcctcaatagacgatacaaccaaagaacggatcaagaaaattgtcacgggtgagtacgacgaaagaatcagtgtgaaggtcagggataaggtgatgaacttgagcgacatttcctgttttcgccgactgccgctctggctggcgtgctatatcgtttacaatcggcactctgaggacaaagaggctgtgaagtgggaaagccctgccgatatagacgcatatttagcctcattcaaacagcacagtctgcgtaaccccatcgtagagcaggtcattaccgaaacacttagagtggttagggatatctggaaacaggtgggccgcattgacgagatccatatagagttggggcgggaaatgaaaaatccagctgataagagaaagaggatgactgcccaaattctcgagaacgaaaatgcaaacctgcgaatcaaagctctactggccgagttcatgaaccctgaatacgagattgagaatgtccgcccctactccccaagccagcaggaaatcctccggatatatgaggacaccgtgctgcacgcggaagatcagcttcccgaggaaatcgacgccattttgaagaaatttaactcttcaaaggtacctacaaaaagtgagttcctgagatacaagttatggctcgagcaaaaatataggagcccatacactggagaactgatcccgcttggcaagctgtttaccgctgcatatgagattgaacatgtgatcccccagtcccgttacttcgatgactctttttcgaataaggttatatgtgagagcgccgtcaacaaattgaaggataatcagctcggttatgagttcattaaaaaccaccatgggcagaaggtggaagtgggctttggaaaatccgtcgagatcttctcagttgacagttacgaacgctttgtgaaggagcaatacgctaagtctgccgtgaaaatgaagaaactgctaatggatgacatccctgaacagttcattgagcggcagctgaatgacagcagatatatctccaaggtaattaaaggcctcctgtcaaacatagtcagggagaagaatgatagcggggaatacgagccagaagcagtgtctaagaacatcgttgtgtgcacaggatccgtcaccgaccgacttaaacgggattggggtatgaatgacgtgtggaacagtattgtttatccccgctttgagagattgaatagcctgactgatacgcaatctttcggccactgggaaaacaagtccgggaaaaaggtgtttcagacagagttacctctcgagtaccagaaaggattctcaaagaagaggatcgaccaccggcatcacgcgatggatgccattgtaatcgcttgtgccacccgaaatcatgtcaactatctgagtaacgaaagcgcatcgagaaatgctaaaatatcccgctacgaccttcagaggctgctatgcgataagaaccgtactgacgataatggcaactataaatgggtgatcaagaaaccatgggacaccttcacacaagacgcccgggaggtgctctctaagattgtcgttagcctgaagcagaatttgagaatcattaacaaaaccactaatgtgtacaggcacctggatgcaacaggtaaccgcgtatacgaaaagcagaaaacgggggactcatgggccatccgaaagcccatgcacaaagataccgtgtttggcgctgtcaatttaagaaaggtgaaagttgtgcggctcagtgtcgcgctggacactccggccatgatagtggataagagggttaagaacaaagtgttcgagcttctgtcctataagtacgacaaaaagcgcattgaaaaatattttaaggagaatgcattcttgtggaaggagctcgatctggctaaagtcgccgtatactattttacagaagccaccacagagcctctagtggctgttcgtaagccactggactctactttcaacgaaaagaagatcaaagagagcgtgaccgatacgggaatccagaagattcttctcaatcatctgtgcaccaaggaaggcaaacccgacttggcattttccgccgaggggatagaggaaatgaacagaaatctgttacaactcaacaacggaaagtcacaccagcctatctacaaagtccgggtgtatgagcccaggggtaataagttcagcgtaggcgtgctggggaacaaaggaacaaagtgggtcgaagcggctaagggcactaatctgtttttcgccatttacatcaccgaggatggtaaacgcacatacgagactattccactgaacgttgtgatcgaacgagagaagcaggggttggtgcctgtccccgacagaaataaaaagggcgataaactcctgttttggctaagtccaaacgacctggtgtatcttccgaccgaagaggaacgggagttcggaaggataaatgagcctatcgaccgcggcagaatttacaagatggtttcttgtacggggaacgaaggacatttcatccccgcaaatgtagccaacccaattgtgcccgtcatcgagctcggctccaataacaaagctcagagggcatggacaaatgaaatgataaaggatatttgcatccctatcaaggtggaccggctgggtcacattatcgaggttaaatatcgtatagatgaatga

SEQ ID NO: 3426 - RNA, 4530 nt, synthetic construct
  misc_feature 1..4530: note = Cas9 variant
  source 1..4530: mol_type = other RNA
atgaagaaaatcctgggcctcgaccttgggaccaacagcgtgggatgggccgtcattaattccgttgtgaacgatgagggtaaggaacagctggtaaatatatcttcatgcggcagtagaatcattcccatggacgctgcaacattgggggatttcgacaaaggaaacagcaagtcccctgtggccgagaggactcggttacgcggcgtccgacgtctgctagaaagatctctcctgaggcgggagcgccttcacagagtgctgtcggttatggggtttttgccagaacattacgcggctcaactcgataggtatgggaaattcctgccggagacggagcccaagctggcctggtacaaggacgaaaccggaaaatatcggtttctcttccaggattcatttaatgagatgttagaagacttccacgagcatcaccctgagctggtggcagaaggcaagaaaatccattacgattggacaatttattaccttcgcaagaaagccttgagccagaagatcactaaggaggaactggcttggatactactcaactttaatcagaaacgaggctattaccaactgagaggggaggaggaacaggaggacaacaagaaaagtgtcgaatactatgcacttaaggtggtagccgttgaggattccggagacaggaaaggtaaggatatctggtacaatgtgaaactggaaaacggctgggtctatcggcgtgcttctggggtgccattggactgggtgggaaaggtcaaggagttcattgttaccacagacctcgatgaaaaaggcaatcccaagaaagacaaggatggtaacgtgaaacgcagctttagagcccctaaggaggacgattgggggctgttaaagaccaggactcaggcgcagatcgacgagtccggacaaacagtaggcacctacatttatgaatcactgctccggatgccagatcagaaaatccgaggcaaacttgtgcgcacgatagagagaaaatactataaggacgaactgaggaaaattttgatcaagcagagtgagttccacactgcactacaggatcacaatctgctcctggcctgtattgaggaactttaccccaacaatgaggctcatcggcgcctgttgagcacctctgactttacatacttcctcgtcgaagatatcctgttttatcaaagacctttaaagtcccagaaagggcagatcgacgactgcccatacgagtcacacgtgtatagggataagaaagacggaagcctgcaacatgttccgctaaagtgtgtgagtaaatctcaccccctcttccaggagttccgtctgtggcactttctttccttcttgcggatttaccagcgagaaagaatgatagatggtagcctgaagctcgacgtcgatgtgactaacgagtttctgcagaacgaagacgattatgtaaaacttttcgactggctgaatgagaggaaggaaatcgatcaaaagaccattttggcctacaaaccttttggcctcaagaaaaacgagcagtcgaagtatcgctggaattacgttgaagacaaatcttacccatgcaactccacacgggcagatatgatcttcagactgtcaaaggctggggtgcccgaggagtttttaaccagggaaaaggaggaagccctgtggcatatactatatagtattagcgacaaaaaggagctcacgaaagcgctgggaactttcgccgaaaagaatggccttaacgagacatttgtcgagatcttctccaaaatgcctccatttgaatctgattacgcagcttatagcttgaaggccatccgcaagctgctcgctctgatgcgaatgggtaaatactgggacgagcaggccattgacgaacacacccggtcacgtatcgagaagattttaactggggaatatgatgagacaataagaaccagggtgcgcgagaaagcaatgcatctgacggacatcagttccttccggggccttcccttgtggctcgcctgttacgtcgtgtatgatagacacagcgaagctaaggagctggttaaatgggaaaccccggacgatattgaccattttctaaggaagttcaagcagcactctctgcgaaatcctatcgtggagcaaatcattatggagacactccgcactgtacgggatatatggaaacaggaaggaaagatcgacgagattcacgtcgaactgggcagagagatgaaaaaccccgcgaaggaaagggcacgtatcaccgcccaggtgcttgagaatgagaacacaaatttgcgcattaaagctctgttagccgagttcatgaacccagaatttgaaatcgagaatgttcggccttactcacccgcacagcaagaaatactcagaatctacgaggagggggtgctgagtggagtcgccgaaaaggatcttccagacgatattgctagcatcctgaagaaattcagggagaacgacgtgaagaaacgacccactacctccgaagtattgcggtataagctctggctggagcagcgctacagatctccttatacaggtaggattatcccactaggcaaactgtttaccccggcctacgaaatagagcatgtgattccccagtcgcggtatttcgatgacagctttactaataaggttatctgcgagtccgcagtcaacaaactcaaggacaactgtctggggtacgagttcgtgaagaaacactcaggagaaaaggtggaacttggcaatggtgagacggcgacaatttttagtgtcgaggaatatgagcgattcgttaaagattcttactttaacaatagcaagaaaatcaagaagttgctgttagaagacatacctgataacttcatcgagagacagctcaatgactcccgctacatttcaaaagtggtaaagagcctgctttctaacatcgtatgcgaagagggggagcaagaaggcatgtccaaaaatgtcattgtgtgtaccggaggcgttactgataggctgaagaaagactggggtgtgcaggatgtctggaaccgtatcatactaccacggtttctcagactgaataagatgaccgacaggacagatttcaccgctgtgagtactaacggacatttgctgcccgccgttcctttacacctccagaagggttttaataaaaagcgcattgaccaccgacatcacgcaatggatgccatcgtgatcgcttgcgccggcagaaacattgtaaattatctgaacaatgcaagcgctcggaaagggtctgagatctccaggtacgaccttcaacatctgttgtgtgacaaggtcaaaacagatgccaacggaaactataagtggattctccgcaagccatgggaaacgttcacccaggacctgtacgcggccctaactaatatagtggtgtcattcaaacagaacctgcgtgtcatcaatagaacaaccaaccactatcagcattacaatgaggatggcgaaaagaaaatgattccccaaacaaagggtgaccggcttgctatcaggaaaccgatgcacaaggatactgtttatggggaggtgaacctccgcaaggagaaaaccctgcctttgaaggacgtagtgaaaaatccaagtgcagtcgtggataagagcctgaaaaacaagttatacgaactcctgaaatcgcagtacgaccttaaggccattacgaagtattttgagacccaccaggatgtttgggctgacgtgaatctgaaaaagatcaaagtctactatttcacaaaggaaactaacgagcgatttttcgccaccagaaaatccttggattctagcttttcacagaagaagatagaagaggaggtgacagacactggcatccaaaagattctcctgcggcatctacagcagaatggaaacaatcccgatatcgcattcagtcctgacggcgttgaaaggatgaaccagaatatgaccattctgaacgacgggaagtggcaccaacccatctacaaagtgcgcacgtatgagaaggcggataaatttgccgtcggagaaaagggcaacaaggtgaaaaagttcgtggaggctgccaaaggtacaaatctctttttcgcagtttacgagtccatacaggaagacgaggctaccgggaaacaggtgagaaagaggacttttgccacaattccacttaacgaagtcatcaagcggaagaaacaaggactgcctgcagcccccgaggattctaagggcaatttgccaatcttcgtgttaagcccgaacgacctggtatatctccctaccgaagaggagcgtaattccggtaaaattatacagcccctggatcgcgaacgaatctacaagatggtgtcatgcactgagggcgaatgccattgtattccagagtacgtcgctaaccccatccttcagaccattgaactggggagcaataacaaagcgcagagagcctggagtggagagatgatcaaggagatatgcgttcctgtgaaagtggacaggttgggcaatgtctctctaatcaagatttga

SEQ ID NO: 3427 - RNA, 4530 nt, synthetic construct
  misc_feature 1..4530: note = Cas9 variant
  source 1..4530: mol_type = other RNA
atgaagaccatcctgggcctcgaccttgggacaaacagcgtgggatgggccgtcattaattccgttataaaagagcaggctgaaagaatctggattgagactgcaggttctaggatcattcccatggatgccgcggtgctgggcgacttcgataaggggaactcaatcagtcaaacgagcgaacggacccgcttgcgaggagctcgtagattaagggagcggcagctgctacgcagagaaaggctccacaaagtactgaatatacttggctttctgcctaaccattacttggagtatatcgacttcgagaagcacccaggtaaatttctcgccgatgcagaaccgaagctggcctgggtgaaggacgagcaggggaaatacacattcctgtttcaggctgcattcgatgaaatgctcgccgactttgctattcatcaaccctccttagtctctggagataagaaaatcccttatgactggactatttactatctgcggaagaaagcccttaccgagatgatctcgaaggaggaattggcgtggatactgctaaatttcaaccagaagcgcggctactatcagctccgaggcgaggaagaggaagataatgcagggaaatcagtggagttttacgccctgaaggttcttacagtggaggctaccgacgaaaagaagggaagagatgtctggtacaacgtgcacctggagaatggttggatttataggcggagcagttccgtaccattggactgggaaggccaggttaaagagttcatcgtgactacagacctcaaccccgatgggacccctaagctggacaaatacggagaagtcaagcgttcttttcgcgccccaaaggaggatgactggatgttaattaaaaagagaacggaggcagatatcgctaatactcataaaaccgtgggcgcctatatctacgacacactgctccaaaagccccagcagaaaattataggtaaacttgtgaagactgtcgaaaggaaactgtatcgggatgagttgagcctaatcctgcagaagcaatgcgcgttccacgccgaactccaggaccgagcactgtacgctcgctgtgttgaggccctttatccttccaacgaagtgagaaggaaaaatattgctaaccgggattttgtatacctgttgatggacgatatcctcttctaccagcgcccactgaagaccaaaaagtcattaatagccaattgcccgtatgaggagaacgaatacgtggacagagagacaggggaaattaagaaagcacccctgaagtgtatcgccaaaagtcaccctctattccaagagtttaggctctggaacttcctgagcaatatccgtatttatcagaaggagaaagaaatcaacggaacccttcatttggacgtcgatgtgacggctgagtttctgaagactgaagacgattacgttgctctcttcgactggctgaatagccggaaggagattgaacagaaaacatttcttaagtatccaaaattcggcctgaagaaagagatatccaactaccgatggaattatgtggaggataagcagtacccctgcaacgaaaccagacacgcaatcttgtcaagcctcgagaaagccaatgtctgtattgactttctgagtaacgaaaaggaggtggctttatggcatatcctgtactctgtatccgataagcaagaaatcgagaaagccctaaggactttcgcagccaagaatggcctcgacgagagctttgttgaagcgttcaaaaagtttcctccattcaaatcggagtatggggcctactctgcaaaggcgattaagaaaatgctgccccttatgcgctgcggaaagtattgggatgtgtcctcaatagacgatacaaccaaagaacggatcaagaaaattgtcacgggtgagtacgacgaaagaatcgctgtgaaggtcagggataaggtgatgaacttgagtgacattagctgttttcgccgactgccgctctggctggcctgctatatcgtttacaatcggcactccgaggacaaagaggcagtgaagtgggaatctcctgccgatatagacgcttatttagccagcttcaaacagcactcactgcgtaaccccatcgtagagcaggtcattaccgaaacacttagagtggttagggatatctggaaacaggtgggccgcattgacgagatccatatagagttggggcgggaaatgaaaaatccagcagataagagaaagaggatgactgctcaaattctcgagaacgaaaatgccaacctgcgaatcaaagcgctactggccgagttcatgaaccctgaatacgagattgagaatgtccgcccctacagtccatcccagcaggaaatcctccggatatatgaggacaccgtgctgcacgctgaagatcagcttcccgaggaaatcgacgcaattttgaagaaatttaacagctctaaggtacctacaaaatcagagttcctgagatacaagttatggctcgagcaaaaatataggagtccatacactggagaactgatcccgcttggcaagctgtttaccgccgcttatgagattgaacatgtgatcccccagagccgttacttcgatgactccttttctaataaggttatatgtgagtcggccgtcaacaaattgaaggataatcagctcggttatgagttcattaaaaaccaccatgggcagaaggtggaagtgggctttggaaaaagcgtcgagatcttctccgttgactcatacgaacgctttgtgaaggagcaatacgcaaagagtgcggtgaaaatgaagaaactgctaatggatgacatccctgaacagttcattgagcggcagctgaatgactctagatatatcagcaaggtaattaaaggcctcctgtccaacatagtcagggagaagaatgattcaggggaatacgagccagaagccgtgagcaagaacatcgttgtgtgcacaggatctgtcaccgaccgacttaaacgggattggggtatgaatgacgtgtggaactccattgtttatccccgctttgagagattgaatagtctgactgatacgcaatctttcggccactgggaaaacaagtctgggaaaaaggtgtttcagacagagttacctctcgagtaccagaaaggattctccaagaagaggatcgaccaccggcatcacgctatggatgccattgtaatcgcatgtgctacccgaaatcatgtcaactatctgtcaaacgaaagtgccagcagaaatgcaaaaatatcgcgctacgaccttcagaggctgctatgcgataagaaccgtactgacgataatggcaactataaatgggtgatcaagaaaccatgggacaccttcacacaagacgcccgggaggtgctctccaagattgtcgtttctctgaagcagaatttgagaatcattaacaaaaccactaatgtgtacaggcactttgatgctacagtaaaccgcgtgtacgaaaagcagaaaacgggtgacagctgggcgatccgaaagcccatgcacaaagataccgtcttcggggccgtgaatctgagaaaggttaaagtggtccggttatcagtggcactcgacactccggctatgatagttgataagagggtgaagaacaaagtctttgagctgcttagttataagtacgacaaaaagcgcattgaaaaatatttcaaggagaatgcctttctgtggaaggagttggatctcgccaaagtagctgtgtactatttcacagaagcaaccacagagcctctggttgccgtgcgtaagccactagactccacttttaacgaaaagaagatcaaagagtctgtcaccgatacgggcatccagaagattctgcttaatcatctctgcaccaaggaaggaaaacccgacctggcgttcagcgctgagggcatagaggaaatgaacagaaatttgctgcaattaaacaacgggaagtcccaccagcctatctacaaagtgcgggtatatgagcccaggggaaataagttttcagtgggtgtcctcggcaacaaagggacaaagtgggttgaagccgcaaagggaactaatctgttctttgccatttacatcaccgaggatggcaaacgcacatacgagactattccacttaacgtggtgatcgaacgagagaagcagggtctggtccctgtgcccgacagaaatgaaaaaggggataagctcttgttctggctgagcccaaacgacctagtttatctgccgaccgaggaggaacgggagttcggcaggataaatgaacctatcgaccgcggaagaatttacaaaatggtaagttgtacgggcaacgaggggcattttatccccgctaatgtggcaaacccaattgtccccgtgatcgaacttggatctaataacaaggcccagagggcgtggacaaatgagatgataaaagatatttgcatccctatcaaggttgaccggctcggccacattatcgaagtgaagtatcgtatagatgagtga

SEQ ID NO: 3428 - RNA, 4530 nt, synthetic construct
  misc_feature 1..4530: note = Cas9 variant
  source 1..4530: mol_type = other RNA
atgaagaaaaccctgggcctcgaccttgggacaaacagcatcggatgggccgtgattaattccaacatagattctgagggtaaggaaaaactggtcggcatctcaagttgcgggagcagaattatccccatggacgctactacgttgggagatttcggcaagggtaataccaaatcccctgttgcagagaggacacggttacgcgggattcgacgtctgctagaaagatctctcctgaggcgggagcgccttcacagagtgctgtcggtaatgggatttttgccagaacattacgcctcacagctcgacaggtatggcaagttcctgccggagactgagcccaagctggcgtggtacaaagatgacagcggccggtatcaatttctcttccagaagagttttcacgaaatgttagaggatttccgccagcatcagcctgaactggtggctggggagaaaaagatcccatacgactggaccatatattaccttcgaaagaaggccttgtcccaagagatcacaaaggaagaactggcatggattctactcaactttaatcagaaaagaggatattaccagctgaggggtgaagaggaacaggaggagaacaataagtctgtcgaataccacgcccttaaagtggttagcgtggaggattccggcgaacggaaggggaaagacatctggtataacgtcaccctggagaatggatgggtgtaccgtcgcgcttcaaacattcccttggattggactggcaaggtaaaagaatttgttgtgacaaccgagctcgacgatgcaggtaatcctaagaaggacaaagaggggaacgtcaagagaagttttagggccccaaaagaagacgattggggactgttaaagacgcggactcaagctcagatcgacgagagcggcaaaaccgtgggcacatatatatacgaatctctgctctgtatgcccaatcagaagattcgagggaaacttgtgcgcactatcgagagaaaatattacaaggatgaactgaggcagattttggtcaaacaatccgagttccatgccgcgctacaggaccacaacctgctcctgtcatgcatcgaggaactttatcctaataacgaggcacaccggcgcctgttgagcgccagttcttttatctacttcctcattgaagatatactgttttaccagagaccattaaagtcccaaaaaggactgatcgacaactgtccgtatgagagccatatttacaaggataagaaagacggttcgctacaccatgttcccctcaagtgcgtgtctaaatcccaccctctgttccaggagttcaggctttggcagtttttgtcaaatctgcgtatctatcagcgggaacgaatgatggatggcagtctcaagctggacgtagatgtgaccagagagttccttccaagcgaagaggactacgtcaaactgtttgactggttgaacgaaaggaaggagatatcccaaaagttcctcctggcttataaaccctttgggttaaagaaaaatgagcaggccaactaccgctggaattatgtggaagataagtcttacccttgtaacgagacacgggcagaaattaaaagcagactgtcaaaggctggagttccagaggaatttctaaccgaggagaaagaagaggccctctggcacatcctgtacagtatctccgacaagaaggaacttacgaaagcgttgggcactttcgccgcaaagaattgcctgaacgagagcttcgtggaagtctttgctaaaattcccccgttcgagtctaattatgccgcttactcactcaaggccatcaggaaactgttagcactgatgcgcatgggtaagtattggaacgagcaggccattgatcgacagacacgggaccgtatagaaaagatccttaccggggagtacgatgaaactattagaagtagggtgcgcgagaaagctatgttgctcacagacatcagctcctttcggggcctgcctctatggctggcgtgttatatcgtatacgatagacattctgagtcgaaggaactcgttaaatgggagacccccgcagacattgatcacttcctgagcaagtttaaacaaaattcccttaggaacccaatagtggaacaggtcatcacggagtcattgcgaaccgtgcgcgacatttggaagcaggaaggaaagatcgatgagattcatgtcgagctgggccgggaaatgaaaaatcctgccaaggagagagctaggatcacagcccaggtgcaagaaaacgagaatactaacttacgtataaaagcactcctggccgagttcatgaaccccgagttcgagatcgaaaatgttcacccatatagtcccgggcagcaggagattcttcgcatctacgaagacggagtgctgtctggtattgctgagaaggatttgcctgacgacatcaccgccatactcaaaaagtttcgggaaaacgatgtaaagaaaagaccaacaactagcgaggtcctgaggtacaagctatggctggagcagcgatatcggtccccgtacaccggccgcgtgattcccctcgggaaactgttcacgcctgcatatgaaatcgagcatgttattccacaatcaagatactttgacgatagcatctctaataaggtgatatgcgaatccgcggtcaacaaacttaaggacaattgtttgggatatgagttcatcaaaaagcacagtggcgagatggtggaactgggtaacggggagaccgtacccgtgtttagcgttgaagagtacgaaaggttcgtcaaggagtcttattttggcaattccaaaaagatgaaaaagttactcctggaggatattcctgactcattcatcgaacggcagcttaacgatagtcgatacattagcagagtggtgacttcgctgctatccaatctcgtctgcgaggaaggagagcaggacggcctgtctaaaaacgttatcgtgtgtacagggggaataacagatcgcttgaagaaggactggggtgtgcaagaagtatggaataggattatcctgccacgtttcttacggctcaacgagatcaccggcagaactgatttcaccagcacatcagtcaatgggcatctgcttcccgctctgccgttgtacctccagaaaggatttaacaagaaaaggattgaccaccgccaccatgccatggatgcaatcgtgattgcctgcgctaatcgaaacatagttaactatctgaataacagttccgccagaaagaactctgagatcagccggtacgacctacagaggctgctttgcgaaaaagtgaagaccgacgcaaatggcaattataagtggattctccgcaaaccttgggagactttcacacaggatgtctacgctgccctgacgaacatcgtggtttcctttaagcaaaatttgcgtgtgattaacagaaccactaattattaccagcactataacgaagcgggtgagaaacggatgatcccacagacaaagggggacaggtgggccatacgcaaacccatgcacaaggataccgtatacggcgaagtcaatctgcgaaaggagaaaacattacctctcagagacgtggtgaagaacccctcaatcgtcgttgataaaagcctgaagaataaactttacgagctgttgaagagtcagtatgacctcaaggctattgcaaaatacttcgaaactcatcaagatgtgtgggccgacgtaaacctgaagaaaatcaaggtgtattacttcaccaaagagacgaatgaacggtttttcgctaccaggaagtctctagatccatcctttgaccagaaaaagattgaggaggaagtcacagatactggagtgcagaagatcctgcttcaccatctccagcaaaacaacaatgaccctgacatggccttcagccccgatggcatagaccgcatgaaccagaatatgaccattctgaacgatgggaaatggcaccagccaatctataaggttagaacatacgagaaagcagacaagtttgcggtgggagaatcgggcaataaagccaagaagttcgtcgaggctgccaaaggtactaacttgtttttcgcagtgtatgaatcagttcaagaggatgaggctatcgggaaacaggtgtgtaagaggacctttgccacgattccgttaaatgaagtcataaagcggaaaaagcagggactgcctgcagcccccgaggacctcaacggcaatctgccaaagttcgtactttctcccaacgatctggtgtacttgcctacagaagaggaacgtaatagttcccgcatcattcagccactagaccgagagagaatctacaaaatggttagctctagcggttcccaatgctttttcattaaggtgttcgtcgctaactcaatctgggataaaaatgagtatagtagcctgaacaagatggaaagggcgataaccaatgagatgatcaaagaaatttgtgtgcccatcaagattgaccggctcggcaacgtatctctgatccagatatga

SEQ ID NO: 3429 - RNA, 4533 nt, synthetic construct
  misc_feature 1..4533: note = Cas9 variant
  source 1..4533: mol_type = other RNA
atgaagagaatcctgggcctcgaccttgggaccaacagcattggatgggccctggtggattccgaggaacagaggatattgggtatgggctctcggatcattcccatggaccaaggggtcttagatacattctcaggaggcaatcctgttgagactcagacggctgcacgcaccgtgtaccgaggtacacgtagactgagggaacgggccctactccgcagagagaggctgatccgggtacttaacatgatgaaatttctgccagaacactatgcgagtcagattgacttcgagaagcgcttggggcagtttttcgatgagaaagaaccgaagctcgcttggaaacaaaatgacgagggacgatttgaatttatctttcagcagagcttcaacgagatgatagaggaatttaagaataagggcgtggtcagagaggataaaaagatcccctacgactggactatttattacctgaggaaaaaggccctgtcccaggaaatcgagaaagaagaactcgcatggattttactgaacttcaatcaaaagcggggctattaccagcttcgtggggaggaagaggaagagaaccctaataagttggtggaatattactctctgaaaatcgttgatgtgatagccgacgagaagccaaactcgaaatcagatatttggtacagcctacatctcgagaatggatggatctatcgcagaagttccaagattcccctgtttggttggaaagacaagaccagggatttcatcgtcacaaccgaccttaacgacgatggcactgtgaaaaaggacaaggaagggatcgagaaacggtcttttcgagctcctagcgaaaatgattgggtactgttgaagaaaaagacagagtccgacattgaaaaatcacacaagaccgttggagcatacgtgtatgagacgctcctgcagaacccaatgcagaaggtccgcggcaaattagtgagaactatagagaggaagttctacaaagatgaactgaagcaaatcctcgagaaacagcgggagttccatcccgagcttcgcgacgaggatctgtataatgactgcgtgagagaattgtacaggagtaacgagacctatcagtttattctaagcaagcgtgatttcgtccacctgtttctcgacgatatcctgttctaccaacggcctcttcgatctcagaagtccgccataggtgactgtattctggaatttaaaacatacaaggacaaagatgggaacaatatcaaggagtatttgaaagttatctcaaagagcaacccactctaccaggagttcagaatttggcagtggctgtataatttaaagatctacaggaaagaggacgatgaggacgtgactctgcaatttattgctaacatagaagataaggagcagctattcgactttctcagtaatcgcaaatctatcgaacagaagccgctgcttgagtatttgattaaagccaagggactgaaaaagcaggtaaagaccgaagcgtaccggtggaactatgtggaggataaaatctacccctgctccgagacaaagaccatgatcagcacgagactcgcaaaagtcgaaaatattcctgacaacttctttactaaggagatagaacaaaaactgtggcatatcatttactcggtgacagataagaatgagttcgaaaaggcccttaggacctttgctaaaaagtatgacctggatatcgcctctttcgttgacaacttcaaaaagattccaccctttaaaaatgagtacggctccttctcagagaaggcaatcaagaaattgctccctctgatgcgcttaggcaagtattggaaatggaacgatatagacaataacactcagaatcgaatcagtaagattatcacaggggaatacgacgaggaaattaaagatatcgtgcgggaaaagagcatagctctgaccaacgagaacgactttcagggactacagctctggctggcccaatatcttgtctacggtcgtcactccgaagcggatattgccggcaagtggcactctgtggcagacttggagaaatatctgaatgagttcaagcagcatagcctcagaaacccaatcgtagaacagattatcacggaaaccctgagggttgtgcgcgatatatggcggaaatacgggcagggagctgagaatttcttctcagagatccacgtcgaattaggcagagacatgaagaacacagccgatgagaggaaaaagattgtgaatgtcgtgactgaaaacgagaataccaacctgcgaatcaaagctcttttgatggaactcaagaataacagtgacggtaagctggaggttgagaatgtgcgcccctactccccgacacaacaggatattctaaaaatctatgaagagtacgccataagcactgggctggacaacgaaaaggatgagaaagtaaaggaagacattaaaaagatctctcgggtcgcacagcctaccacaaccgagctccaaagatataagctgtggcttgagcagaaatactgttcaccctatactggcaaggtgatcccattgggaaaactgtttacggaagagtaccagattgaacatatcattcctaagagtaggtattacgatgacagcttctccaataaagttatatgcgaggccgctgtgaacaagttaaaggacaaatgtctcggcctggagtttatcaagaattaccacgggcagattgtcgaaacaggattcggtcaaaaagtgaccatctttgatgaggaagcgtatcagaacttcgtaaagcagcactacgcatataaccattctaaacgtactaaacttctgttggaggaaattcccgagaagatgatcgagcgccagatgaatgacacccggtacatatcgaagtttgtgctcccactgctaagcaacctggttagagccaaggaaaatgataacggcgtcaattccaaaaacgtgctccccgtgaatgggaagatcacaaccatgctgaaacaagactggggacttaacgatgtctggaatgacttgattctgcctaggttcgttcgaatgaacgagttagctaagactatcgccttcacatcatggaatgaacagcaccagaagtatctcccaacggtgccgctggagcttagtaaaggctttcagaagaaacggattgatcatcgccaccatgcaatggacgccctggtgatcgcttgcgccaccagagatcacgtaaacctactcaataacaagcacgcaaatactgacacaataaggtacgatctgcaacggaaattgcgactgttcgaaagagtcacctatattgacccccagacaaagaacaacgtgactaaagacatccctaaggagtttaagaaaccatgggataatttcaccgttgacgcgcgcaacgagttagaaaagatcattgtgtcttttaaacagaatctcaggataatcaacaaggctacgaatatttacaccaaatacgagaacggtaagaagatcaaagtcgggcaaaagggcctgaattgggccattcgtaaaccccttcataaggaaacagtgttcgcaaaagttagcctgcggaagagaaagactgtgaggttgtccgaggccctcaaagattggaagaaaatcgtagacaagaaactgaagcaggaaataaagcgcctaacctgtcagtatggaaaatttgatgtcgacacaatcctgcgatacttcaaggatagaaaatatcagtttggcgaggtggacgtgtcaaaggtcaaaatgtactatttcgatgaggaaaacgctgccgttcggaagaatgtggacactagctttaccgagaaattcattcaagggtctgtaacggatacaggaatccagaagattcttctcaaccacctggaagcaaagggtaataaagtggagatcgctttctcccctgagggcatagaagagatgaacaagaatattatccagttgaacgaagggaaactgcatttaccaatctttaaggtcagggtgtacgagaccattggaaataaattcagtgttggcgtgaagggtaacaagaaagacaagtatgtcgaagccgcgaaagggactaatctctttttcgccatctacgtggatgagaacggcatacgcagctacgagacaattcccctgaacatcgttattgaacgtcttaagcagggactgtctgtggtcccggagaaaaatagaaaggaacactccttgctcttttatctgtcacctaacgacctagtatacgtgccaatcgaggacgaacgggagaatatacacgctgttaacctggatcaacttaataacgagcagaggaagcgcatttataaaatggtgagttgcaccggcagcgaatgtcatttcgtcccctactatgtggcatcgcctatcgtaaataaggtggagtactcctctctcaacaaaatcgggcgaagcctgactggagaaatgattaaggacgtctgcatcaaattgaaggttgatagattaggcaatattaagggtatatcagggctgtga

SEQ ID NO: 3430 - RNA, 4533 nt, synthetic construct
  misc_feature 1..4533: note = Cas9 variant
  source 1..4533: mol_type = other RNA
atgaagagaatcctgggcctcgaccttgggaccaacagcattggatgggccctggtggattccgaggaacagaggatattgggtatgggctctcggatcattcccatggaccaaggggtcttagatacattctcaggaggcaatcctgttgagactcagacggctgcacgcaccgcctaccgaggtacacgtagactgagggaacgggcgctactccgcagagagaggctgatccgggtgcttaacatgatgaaatttctgccagaacactatgctagtcagattgacttcgagaagcgcttggggcagtttttcgatgagaaagaaccgaagctcgcctggaaacaaaatgacgagggacgatttgaatttatctttcagcagagcttcaacgagatgatagaggaatttaagaataagggcgtagtgagagaggataaaaagatcccctacgactggactatttattacctgaggaaaaaggcactgtcccaggaaatcgagaaagaagaactcgcctggattttactgaacttcaatcaaaagcggggctattaccagcttcgtggggaggaagaggaagagaaccctaataagttggtcgaatattactctctgaaaatcgtggatgttatagctgacgagaagccaaactcgaaaggagatatttggtactcactacatctcgagaatggttggatctatcgcagaagcagtaagattcccctgtttggctggaaagacaagaccagggatttcatcgtgacaaccgaccttaacgacgatgggactgtcaaaaaggacaaggaaggaatcgagaaacggtcctttcgagcaccttctgaaaatgattgggtgctgttgaagaaaaagacagagagcgacattgaaaaatcccacaagaccgtaggcgcctacgtttatgagacgctcctgcagaacccaatgcagaaggtgcgcggtaaattagtcagaactatagagaggaagttctacaaagatgaactgaagcaaatcctcgagaaacagcgggagttccatcccgagcttcgcgacgaggatctgtataatgactgcgtgagagaattgtacaggtcaaacgagacctatcagtttattctaagtaagcgtgatttcgtgcacctgtttctcgacgatatcctgttctaccaacggcctcttcgaagccagaagtctgctataggggactgtattctggaatttaaaacatacaaggacaaagatggaaacaatatcaaggagtatttgaaagtcatctccaagtcaaacccactctaccaggagttcagaatttggcagtggctgtataatttaaagatctacaggaaagaagacgatgaggacgttactctgcaatttattgccaacatagaagataaggagcagctattcgactttctcagcaatcgcaaaagtatcgaacagaagccgctgcttgagtatttgattaaagcgaagggcctgaaaaagcaagtgaagaccgaagcataccggtggaactatgtagaggataaaatctacccctgctctgagacaaagaccatgatctccacgagactcgccaaagtggaaaatattcctgacaacttctttactaaggagatagaacagaaactgtggcatatcatttacagcgtcacagataagaatgagttcgaaaaggctcttaggacctttgccaaaaagtatgacctggatatcgcatcgttcgtggacaacttcaaaaagattccaccctttaaaaatgagtacggctctttctccgagaaggctatcaagaaattgctccctctgatgcgcttagggaagtattggaaatggaacgatatagacaataacactcagaatcgaatctcaaagattatcacaggagaatacgacgaggaaattaaagatatcgttcgggagaagagtatagccctgaccaacgagaacgactttcagggtctacagctctggctggcgcaatatcttgtgtacggccgtcacagcgaagccgatattgcagggaagtggcactccgtcgctgacttggagaaatatctgaatgagttcaagcagcattctctcagaaacccaatcgtggaacagattatcacggaaaccctgagggtagttcgcgatatatggcggaaatacggacagggcgccgagaatttcttcagcgagatccacgtggaattaggtagagacatgaagaacacagctgatgagaggaaaaagattgtcaatgtggtcactgaaaacgagaataccaacctgcgaatcaaagcccttttgatggaactcaagaataactcagacgggaagctggaggtggagaatgttcgcccctacagtccgacacaacaggatattctaaaaatctatgaagagtacgcaatatccactggcctggacaacgaaaaggatgagaaagtgaaggaagacattaaaaagatcagccgggtagcccagcctaccacaaccgagctccaaagatataagctgtggcttgagcagaaatactgttctccctatactggaaaggtcatcccattgggcaaactgtttacggaagagtaccagattgaacatatcattcctaagtcaaggtattacgatgacagtttcagcaataaagtgatatgcgaggctgcggttaacaagttaaaggacaaatgtctcgggctggagtttatcaagaattaccacggacagattgtggaaacaggtttcggccaaaaagtcaccatctttgatgaggaagcatatcagaacttcgtgaagcagcactacgcctataaccgttccaaacgcactaaacttctgttggaggaaattcccgagaagatgatcgagcggcagatgaatgacaccagatacatatctaaatttgtactcccactgctatcgaacctggtgagggctgaagagaatgataacggggttaatagcaagaacgtcctccccgtgaatggaaaaatcacaaccatgctgaagcaagactggggccttaacgatgtgtggaatgacttgattctgcctcgattcgtccggatgaacgaattagccaaaactatcgcattcacatcctggaatgagcagcatcagaagtatctcccaacggttccgctggaactttcaaagggttttcagaaaaagcgcattgatcacagacatcacgccatggacgctctggtgatcgcctgcgcaaccagggatcatgtgaacctactcaataacaaacacgcgaatactgacacaatacggtacgatctgcaacgaaagttgagactgttcgagcgcgtaacctatattgacccccagacaaagaacaacgtcactaaggacatccctaaagagtttaagaagccatgggataatttcaccgtggacgctaggaacgaattagagaaaatcattgttagttttaagcagaatctccgtataatcaacaaagccacgaatatttacaccaagtacgaaaacgggaaaaagatcaaggtgggccaaaaaggactgaattgggcaattcggaagccccttcacaaagagacagtcttcgccaaggtgtctctgagaaaaaggaagactgttcgcttgagcgaagctctcaaggattggaaaaagatcgtggacaaaaagctgaaacaggagataaagcgactaacctgtcagtatggcaagtttgatgtagacacaatcctgagatacttcaaagatcggaagtatcagtttggggaggtcgacgtgtccaaagtgaagatgtactatttcgatgaagagaacgccgcagtcaggaaaaatgttgacacttcatttaccgaaaagttcattcaaggaagcgtgacggatacaggtatccagaaaattcttctcaaccatctggaggctaagggcaataaggtagagatcgccttctctcctgaagggatagaggaaatgaacaaaaatattatccagttgaacgagggaaagctgcacttaccaatctttaaagtgcgcgtctacgaaaccattggcaataagttctccgtgggtgttaaagggaacaagaaggacaaatatgtggaggcggccaagggcactaatctctttttcgctatctacgtcgatgagaacggaatacgtagttacgaaacaattcccctgaacatcgtgattgagagacttaaacagggcctgagcgttgtgccggaaaagaatcggaaagagcattctttgctcttttatctgtcccctaacgacctagtctacgtaccaatcgaagacgagagggagaatatacacgcagtgaacctggatcaacttaataacgaacagcgcaagcgaatttataagatggtttcatgcaccgggagtgagtgtcacttcgtgccctactatgtcgccagccctatcgtgaataaagtagaatactcgtccctcaacaagatcggaagatctctgactggcgagatgattaaagacgtgtgcatcaagttgaaagtcgatcggttaggtaatgttaaggggattagcggactgtga

SEQ ID NO: 3431 - RNA, 4536 nt, synthetic construct
  misc_feature 1..4536: note = Cas9 variant
  source 1..4536: mol_type = other RNA
atgaagaaaatcctgggcctcgaccttgggaccaacagcattggatgggccgtgataaattccgtcgctgatgagtctgttgaaaagagaaacatcgagctggcaggttcaaggattatccccatggacgccgcggtgttgggcaatttcgataacggggtaacaaaaagtcagactgctgaacggacgagctaccgctccattcgacgtttaagagagaggcaactgctacggcgcgaaagactccacaaggtgctgcagatccttggatttctgcctgagcattatgtcaatgacatagatttcgagaaccacccaggcaaaatcaagaagaataccgaaccgaaattgccctggaggaagaactctatgggtcagtttgagttcatttttcaggcctcgttcgaagcaatgctcacagactttgccactcatcaacctgtgttcgtttcagaggggaaaaaggtgcactacgattggaccctgtattacctgcggaaaaaggctctcacagaggaaatcagcaaggaggaattagcatggattatcctgaattttaaccagaaacgcggatattaccagcttcgaggcgaggaagaggaggaacagagtaataagttggtcgagttctatgccctgagagtggtaaaagttgaagctaccgacgataagaaaggcaaggacacttggtacaacgtgcatctagagaatgggtggatatacaggcggacatccaacattccactcgattgggaaggaaaagtcaaggagtttatcgtgaccacggacctgaatgaggatggtactcccaaacttgacaaatatggcgaagtgaagcgttctttccgcgcccctaaagaggacgattggaccctgattaagaaaaagacagaaagcgacatcgcgaactcccacaagactttggggtgctacatctatgatgcactcctgcaaaacccaaatcagaaaattaagggaagattagtcaggaccgttgagcggaaattttacaaggaggagctgcgactcatacttgagaaacagctgtcattccaccccgaattgcaggaccgcgatctatatagagcctgtatcgacgctctgtacgtgagtaacgaggcccataagaataacattagcggcagggatttcgtatatctctttatcgacgatataattttctaccaacggcctctgaagacaaagaagtctcttatcgacaattgcccatacgagaaaaaccagtatatggatcgcgaaaccggtgaggtgaagcaggcaccgatcaaatgtattgctaagtcccaccccctgtttcaagaatttagattgtggcagtttatctcaaatattaggatataccagcgtgagcgggtcatggacgacgggaagctcgaaacggatgtggacgttactcctgatttcctgaaaacagaggacgattataccactttatttgaatggctgaacgaccgaaaggaggtggatcagaaagccttcctaaagaatccacaatttggactcaaaaagacattcaccgagtacagatggaactatgtcgaagacaaaagctacccctgcaatgagacgaggaacgcgatcctgaatggccttcagaaggccggcgtgagtgcagatttcttgtctcgcgaagtagaggaagctctgtggcatattctctattccgttgaggacaagatcgagatcgaaagcgccctgcggaaattcgcttcgaagcacgatcttgacgatagatttgccgacgtgttcaaaaagctgcctccattcaggaaagagtacggggcatactctgccaaggctattaagaaattgctccccctgatgcgcatgggaaagtattgggaattatccaacatagacgataaaaccaaggagcgaatcgacaaaattatcacaggtgaatgggatgagaatattcacaaccgggtccgtgagaaggcgatcaagctgtcagacataactgattttaaaggcctaccgctctggctgagttgttacgtggtctataacagacatagcgaagcaagggccatcgctaagtgggagtcccctgaagacattgattcttaccttcgcttgttccggcagcacagcctgagaaatcccgtggttgaacaggtgatcaccgagacactcaggactgtacgagacatttggaaacgcatcgggcaaatagatgaaattcatgtcgagctgggacgggaaatcaagaacccagccgacaaaagagcaaagatgaccgcccagattgtggagaatgaaaacacaaatttaaggatcaaggctctgcttgccgagtttataaactcagagtatgaaatcgagaatgttcgtccttacagtcccggccagcaggaaattttgcgcatctatgaggataccgtgctcaactccgtcgaagagattccagaggacatcagcgcagtgctgaaaaagttccgggaatctgatctgaaaaagagacccactaaatcagagtttctgaggtacaagctctggctggaacaaaaataccgaagtccttatacgggtgacataattccacttgggaagttgttcacaagcgcgtacgagatcgaacacatcattccgcagtcccggtattttgacgattctttctcgaataaggtaatctgcgaggctgaggtgaacaaactaaagagcaatgaattaggctacgagtttattaaaaaccatcacggacagtatgttgaaataggcttcgggaaggtcgtgcagatcttttccattgaggcctacgagaaattcgtgaaggcaaattattcaggaatcggtagtaagatgaaacgcctcctgatggacgatattcccgaaacctttatcgagagacaacttaacgactctaggtacataagcaaggtcgttaaatccctgttgtcaaatatcgtgcgggaaaaggatagcaacggcgagtacgaacctgaggccatttctaaaaacgtgatcgtatgtactgggtccgtcaccgaccgactcaagagagattggggagtgaatgacgtttggaacagtattatctatccacgcttcgagaggctgaatgaactaacaggcagccagcagttcggttgctgggagaacaaggaagggaaacgtgtgtttcaaaccgctgtccccctggagatgcagaagggcttctctaaaaagcggatagatcacagacatcacgccatggacgcaattgtgatcgcttgtgccatcaggaatcatattaactacctctccaatgaatcagcgagtaaaaaggccaagataagccgcatcgatctgcagcgacttttgtgcactaaatgtagaacagacgacaacggaaattataagtggattgttaaaaagccttggccagcttttacgcaggatatccggaaagcactggagaacattaccgtgtcgttcaagcaaaatttaagggtaatcaacaagactacaaattactatgtccactttgacgagtccggcaaaaaggtgctcgaaaaacagataaacggggattcttgggccatccgcaagcccatgcacaaagacaccgtgttcggaaaggtcaatctgcagaaagttaaggaggtgcgtcttagcctggctctagatacaccgaagatgattgtagacaaaaagctcaaagaaaaggtgctgcagttgtactcatataaatacgataagaagagaatcgacaaatactttaaggagaacgccagtctgtggaaagatttaaacctctccaaggtcgcagtgtattacttcactaatgactctaccgaacctctggttgcggtgcggaaaccacttgatacgagctttaacgccaagaagattaaagagtccgtcaccgacacaggtatccaaaagatactgttgaatcatctctcaaacaatcaggataaccccaatctggctttcagccctgacggcattgacgagatgaacaggaatctaactaccctgaacgatgggaaatatcaccagcccatctacaaggtgcgcgtttgcgaaccacagggaaataaatttagtgtgggcacatctggtaacaagacttccaagtatgtcgaggccgcaaaagggaccaatcttttcttcgctgtataccaaacggaagacggcaagcgaaactatgagacaatccctctcaatgtggttattgagagagaaaaactggagtgggcccccgtgccagaaaacaataacaacggagataagttgctgttttggttaagcccgaatgacctcgtctacgtgcctaccgcagatgagctgaacaatggcatgcggcttgacaacatggataaagggaggatctacaagatgatatcgtgctcaggaccccagtgtttctttattccacagaatgtatctaaccccatcattcctgtgatcgaactgggcgtcaataacaaagccgagaagagttggaataacgagatgataaaggttgtgtgcgtgccaattcgcgtcgacagattgggttgtatcactcaaatcaataaccagaaatga

SEQ ID NO: 3432 - RNA, 4539 nt, synthetic construct
  misc_feature 1..4539: note = Cas9 variant
  source 1..4539: mol_type = other RNA
atgaagaaaatcctgggcctcgaccttgggaccaacagcattggatgggccctgatagaaaattccttcacagaaaaggagggtaaaatcaacgatatgggcgtgagaattatccccatgtctgctgacattttggggaagtttgatgcaggacagtcacacagtcaaactgccgaaaggacgggctaccggggtacccgccgattatatcagcgtgacaatctgagaagggagcggctacatcgcgtcctccacatcctggggttccttcctaaacattacgatgaacacatagactttgagaagagactgggacagttcaaggagggcaaagaaatcaagttgaactataggtgcaatgttgagaacaaacatgaatttattttcatcagctcctttaatgagatgctcacagagttcaagaaagcgcagccagaactgttttacctgaagtctaacggcgaggaaactaagattccgtatgattggaccctctactatttacggaaaaaggctctgtcgcaaccccttacaaaacaggagttggcctggatcatactgaatttcaaccagaagcgcgggtactaccagctacgaggagaagagattgacgatgacaaaaataagcaatttgtgaaactcaaggtaaaggaggtgatcaactcaggtgaagcagtcaaaggcaagcctctgttcgatgtgatttttgagaatgggtggaaatatgacaagcaggttgtgaaaaccgaagattggatcgacagaactaaggagttcatcgtcacaaccaaggtgcttaaaaacggagacctgaagaggagctacaaaacggtagatagtgaaaaggactgggccgctattaaagcaaagactgagcaggatatagagcggtccaataagaccgttggcgagttcatctatgagacattgctcgaaaacccaactcagaaaattcgtggtaagctggtgaaaaccatcgagcgcaagttttacaaagaagagttaaagaacatactgattaagcaaatcgagctccagcccacacttttctctgaagaactgtataaagcctgtatcgaagagttgtaccctagaaatgaggctcaccagaacgccattaagaatagggactttatctatctactgatggatgacattatattctaccaacggccactcaaaagccagaagtccaacatctcagggtgccagctggaacagcgagtctactataaagcgaataaggatagtggagagaacgaagaggtgaaacaagcagtgaaggccattcccaagagccaccctctttttcaggagttccgcaattggcagtggctgcagaacttgaaaatctacaataaggtcgacaccgagaaaggcgagctcacggatgttactaagcaactgttaccatctgaagactcctgggtgaacctgtttaatttcctacagtgtaaaaaggagctcgaacagaagcagtttatcaaatatttcattgataagaaactgataaacaagacagagaaagaccattacagatggaattatgtagaagacaagaagtacccgtttaccgagactagggctcaattcatctcacggcttacaaaagtggagggcattgaagagatcaacacctttttggataagaaaacgcagattgggaccaaggacaatagccccttcgtcagtcgcatcgaacagctgtggcacataatctattctgtgtccgatattaaagagtacgaaagcgccctcgagaagttcgcaatcaagcatcacctgaacgaggaatcgtttgttgctaacttcattaaatttcctccattcaagtctgactacggatcctatagtaaaaaggcccttaataaactgttgcccctcatgagaaggggtaactactggacagagaatgatatctcagaaaaggtgaaactgcgtgtcagcgagataatggagcgggtgaacgcgttaaatctgaaggaagactattcctctaaggagctagccgaaactctcgtaaacgttagcgatgacgatgtgaaaaagcagctgattaaatcatttgtcagtttcaaggaccgaaatcctcttatgggcttgaacacctttcaagcaacatacctggtgtatgggagacactccgaggtcggagatatccagaattggaaaactccagacgatattgacacctacctcaagaacttcaagcagcatagcctgaggaatcccatcgtggaacaagttgtgacagagaccttacgcgtagtccgggacatatggaaacaccatggcaagtctcagactaactttttcaatgagatccacgtggaactgggtagagagatgaaaaacccggctgataagaggaaacgcatttcagaacgaaatacggagaacgaaaacacaaataaccggatccgtgagattcttaaggacttgatgaatgatgccagtatccagggggacgttagagattatagcccttcccagcaaggcatactcaagatttacgaggaaggagtgtaccagaaccccaaagtcgactattctaaggtgtcggaggatgaaatcaccaaaatcaggcgcagcaataacccaactcagaaggagattcagcggtacagactgtggctagaacaaggctatatctccccttatacctgcaaacccattccactgtcaaagctctttacacatcactaccagatagagcacatcattccccagagtaggtacttcgacaattctagctccaacaagatcatttgtgagtcagaagtaaatgaggataaagacaacaagaccgcttttgaatatctgaaagataagggggagaatgtgatcaacggacataaacttttgagcctggccgcatacgaggcccacgttaataagtacttcaagaacaatcgacagaaattaaagaacctcctgtctgaagacatacctgagggtttcatcaaccgccaaatgaatgattcccggtatattagtaaacttgtcaagggcctgttgagcaacatcgtgagagaagagggggaacaggaggtgacttctaaaaatctcattccagtcacaggatccgttacgtcaaagctgaaaaacgactggggcctaaatgacaagtggaacgagctgatcctcccgaggtttaagcgtctgaatcagcttacccaaactaacgatttcacaaccgctaatacaaacggtaatactatacccaccgtgcctgacgaattgctgaaagggtttagtaagaaacgcattgatcatcggcaccacgcgttagacgcactcgtggtagcctgctgtacgagaaaccatagcaattacctgtcggctcttaacaccgagaataagaactatggcctgagggataaactactcatcaagaatgacaacgatcactacacaaagtccttccagatgccatggcatggatttactaccgaagccaaaaaccagctggaggaaacagtcatctctttcaagcagaatttgcgagtgattaacaaagcaaataacaagttttggagctataaagacgagaatggcaagctgaacttagataagaatgggaaacccataaagaaactccggaagcaaactaaaggagacaactgggccgttcgccagcctctgcacgaggaaaccatctcaggtattgtgaatcttccatgggtcaaggctgagaaggaaaaattcacgtacgccacaagaaagagtctggataaatcctttgacttgaagaaaatcgagaagattaccgacactggcatccagaaaatactcaggaactatctgatgcaggaaaagttcaaggagctagataaaaaggacaaagaggtgtacaattctgaactggcatttagccaagaggggcttgaagatctcaactccaatatcgagcagttcaacgaccagaagccccataaaccgatttacaaggttcggctgttcgagaagggatcaggccgatttgcgttgggtttcaaagggatcaatgctaagaaatatgcccagggcagccctaacctgtactttaacatttatagaaatgaagatggacaatactatgagacagtgccattaaacaaggtaatcatacaccagaaaaatgcagccaacatgcccaagaagaatcgcacccctgtccccattagtaacactgctatcaataggtctaaagaagtgctcgtggactacaagatgaccctgtccccacttgatctggtctatatccctacagaggaagagttgaacaatattaacagcctcgacttcaataacctgtcgaaatcacagcgtaagcggctatacaatgttaacgatttttctggctacacgatctatttcagtcccaataccctggccaaatccatatgcccaaaggaggtggacatgaagtttgatgagaaaaagcagaaaccgactgggagcttcgactctaagacagcaagccttgatggaatgtccattaaagaaagatgtatcaagctcattatcgacaggctgggcaacatatcaaaagcttga

SEQ ID NO: 3433 - RNA, 4539 nt, synthetic construct
  misc_feature 1..4539: note = Cas9 variant
  source 1..4539: mol_type = other RNA
atgaagaaaatcctgggcctcgaccttgggaccaacagcattggatgggccgtggtcaatgctgatgagataacaagagacgatggttccaggtacctgaagcccaacggcatctctgcagccgggtcacggattatccctatgagtgcggacattttgggagatttcgaaaaaggcaatagcatctcccagactgctgagcgcacgcgaatgcgtatggccagaaggttacacgaacgggcactgctacgcagagagaggctcctgcgggttcttaacctgttggactttctcccaaagcatttcgccgataaaatagaccgctatggtaagtttaccgatgactctgaaccgaagctggcttggcgaaagaatacagaggggaagtacgagttcatctttcaagatgcattcaacgaaatgctggccgagtttaaagacaagcagcccgaaattgtggaggagggcaaaaagatcccttatgattggactatttactatctcagaaagaaagccttagaaaaggccctgtcgaaagaggaactttcatggatcttgctgcagttcaatcagaagaggggatactatcaactacggggcgaggaagaggagataccacaggacaaaaagattgaatacctcgcgcagaaagtagtgaaggtcgaggcaaccgaccagaagaaaggggatgacgtgtggtacaacgtttatctggaaaatggaatgatctaccgtcgcacaagcaaggctccccttgattgggagggtaaagtgaaggaatttattgtcaccactgaggtggagaacgacggcgaaacacctaaaaaggataaggaggggaatatcaaaagaagtttcagggctccaaaggaagacgattggaccctgttgaaaaagaaaacggaggccgacatcgaaaactcccacaagactgtaggatgctatatttacgattctctcctgaataaccccaagcagaaaataatcggcaagttagttcggaccgtggagcgaaaattttataaggaggaactgacacaaattctcaaaaagcaggtcgagcttatccctgaactgcgcgacgataatttgtacaagcagtgtatagaggagctatatccaattaacgaagcacatagaaacactatcgctaaaaccgacttcgccaatctgtttatcaacgacattctcttctaccaaaggccgttaaagagcaaaaagtcccagatcgataattgcccctacgaggaacggattttcatagactcaaaaacaggtgagaagaaaaaggtgcctgtgaagtgtatcgcgaaaagtaacccactttttcaggagttccgcctgtggcaatttattcagaatttgagaatctatcagagggaaaaggagatcgatgggaaactcctgaccgacattgatataacgagcgaatgcttaaagtctgaggaagactacgtccgtctgttcgattggctaaacgaccgggagactatcgaacaggaggatctcctgaaacacctttttaatacaaagaagtccaaaaacaaggagaatccctatcgatggaactacgttgaagacaaagtgtatccttgtaatgagaccagagccactattttgaagggattctcaaaatgcggcatcaacgcaagcgtactgagtccagaactcgagatggctctgtggcatattctttactctgtggaagataagaaggagatcgagacagccctgacccactttgctcaaaaacagggctggaatgacgatttcgccaaggtcttttccaaagcaaagcccttcaaaaaggactatgggagctactcggaaaaggccatcaaaaagttgctctctctgatgaggatgggaaaatactggaaccaggacaatatagataagaacacgttagaccgcattgataaaatcattaacggtgagtatgacgaaaagatctccaatcgggtgagagataacgctataaatctgaaagacatttcagattttaggggcctaccggtttggctcgcgtgttacatcgtgtatgaccgccacagtgaggcaaaggattgcaccaagtggaacagccctgaggaaattgactcctacctgaaaaagttcaaacagcattctcttcgaaatcccatcgtcgagcaagtggtaacagaaactttgcggaccgttcgtgatatatggatccaggaggaacagattgacgagatccacctggagctcgggagagatctgaagaacccagccgacaaaaggaagaagatgagcgaaaatattctgaaaaacgagaatacaaacctgcgcatcaaggctatgcttatggaatttatgaatccttcaatgggaatagagaacgtgcggccctatagtccatcccagcaagacattttgagaatctacgaagagaatgccctcgataacctgactaaagacgataaggacttcgatttcatcagcaaaatttctaagcaggcacagccctcaaagaccgacatcattaggtataaatgttggctagagcagaagtaccgaagtccttacacaggcaaaaccataagcctgtccaagctctttactccagcctatgaaatcgagcatgtcattccgcaatctctgtacttcgatgactcgtttagcaataaagtgatctgcgaagctgaggtcaacaaacttaaggatcgccagttgggttataaattcattgccgaacaccacggggagaaggtgcagctgtcccaaggcgaggttgtggaaatcttatcagtagacgcatacgagaaatttgtcaaggaaaactatgcgaataaccggataaaaatgaagaagctcctgatggagagtatccccgatgagttcattgaaagacagcttaatgactctaggtacatcagcaaagtggttaagggactgttgtccaacattgtgcgtgagaaaatcgacgatgaaaattatgagcctgaagctgtctcaaagaacctcataagctgtaatggcgccattacggaccgcctgaaaaaggattgggggatgaacgacgtgtggaactctatcatcctaccacggtttattagaatgaatcagataacaggaaaagattgcttcaccactaccaatgcagagggtcatctgatcccccagatgcctctcgagctgcaaaagggctttaacaagaaaaggattgaccaccgacatcacgccatggatgctatcgtaattgcctgcacaacccgggaccatgtgaatcttttgaacaatgaagcagctcactccaagttcaacgccactcgctaccagctgcagagaaaattaaggcggtttgagaaggcggttatcgatgggaaagaacgagaggtcgccaaggagttcctcaagccatgggacagttttagctctgattccaaaaacatactggaaaatatcattgtgtcattcaagcagaaccaaagagtgatcaataaaacaacgaacgctttccttcactttgacgagaatggaaagaaaaccttcattaagcagggcaagggtgatagttgggcaatccgcaaaagcatgcataaggacactgtctttggggaaataaacctgaggaaagttcgttcggtgtccctaaatgaggccattaaggtgcccgaacgggtactcaacaaaaagatcaaggagaaaatcctggaattgaagaataacaaaattgacgctaagaatatcaaaaagtacatagaggagaaccacacaggcggatatggcattgattctagcaaaatcgacgtcttctactttaccaaggaaacaaaggagagattctttgccactaggaaaaccctggatacgtcattcaatcaggcaaagattaaagacagtatcgcggattccgggatacagaagattttactcgcccatctgaaatctaagaacggagacgctgaacaagcctttagcccggatggtatcgacgagatgaataagaacatcgtggagcttaataacggcaaattccaccagcctattctgaaggttcgcgtgtatgaaaaagcagataagtttgctgtcgggcagaaaggaaacaagaaggtgaaattcgttgaggccgcaaagggcaccaatttgttctttgccatcttcgaaaaagacggtaagcgatcctacctcacaattccactgaacgtgatgatagattgtcaaaaacagtatgggaatcagtggaagaacaatatcgaggcttacctaaaggaaaaagagctggtagagaaggacgtcaaacttcagtttattctctcacccaacgatctggtgtatttgcctactgaaggcagcatcgacaagaaaagaatctacaaggtggtcagtttcaccaataaccggctgtacgcgattccctatgccatagcaaaatctatcgttgacaagaatgagtttacacaattaaacaagattgagttcactgataataaagaatccatcaaggacgcttgcgtgccagtaattatcgataggctcggaaacgtgatagaatttaatggcaaacgcctgtga

SEQ ID NO: 3434 - RNA, 4539 nt, synthetic construct
  misc_feature 1..4539: note = Cas9 variant
  source 1..4539: mol_type = other RNA
atgaagaacatcctgggcctcgaccttgggaccaatagcattggatgggccgtgataaactccgaggaagatggtcccatcgtcaaaaagagaattgagctggctggctctaggatcattcctatggacgcagccgttttggggaatttcgattcaggagtgacaaaaagtcagactgcggaacggacgagctttcgctccatccgacgtttaagagagaggcaactgctacggcgcgaaagactccacaaggtactgcagatacttggcttcctgccagagcattacgtgaacgacatcgattttgagaatcacccgggtaaaattaagaggaacaccgaacccaagttgccttggcggaaaaattctatggggcagttcgagtttatcttccaggactcgtttgaagctatgctcacagatttcgccactcatcaaccagtctttgtgtcagagggaaagaaagttccctatgactggaccctgtactatctgcgcaagaaagcactcacagagggcattagcaaggaagagttagcctggctgatccttaacttcaatcagaagcgaggctactatcagttgagaggggaagaggaagaggagcagagtaacaaactggtggaattttacgctctaagggtcgtgaaggtagaggcaaccgatgacaaaaagggaaaagatacttggtataatgttcacctcgaaaacggttggatataccggcgtacatccaatattcctctggactgggagggcaaggtgaaagaatttatcgtcaccacggatcttaacgaggacgggactccaaagctggacaagtacggagaggtgaaacgctcttttagagcccccaaggaagatgactggaccttgattaaaaagaaaacagagagcgatatcgctaattcccataagactgtgggctgctatatctacgacgccctcctgcaaaaccctcaccagaagattaaaggtaggttagtccggaccgttgaacgaaagttctataaagaggaactgcgcctcatacttgagaagcagctgtcattccacccagagttgcaggatagagacctatacagggcgtgtatcgatgcactgtatgtgagtaacgaagcccataaaaataacattagcgggcgggactttgtatacctcttcatcgatgacataattttctatcaacgcccgctgaagacaaagaaatctcttatcgataattgcccctacgaggaaaaccagtacatggacagagagaccggagaggtgaagcaggctcctatcaaatgtattgccaagtcccacccactgttccaagaatttaggttgtggcagttcatctcaaatattcgtatatatcagcgggagcgagtcctcgacgatggcaaactggaaacggacgtggatgttactcccgactttttaaagacagaggatgactacaccactctgttcgaatggtttaacgatagaaaggaggtggaccagaaagcattcctaaagaatcctcaatttggcctcaaaaagacattcaccgagtataggtggaactacgtcgaagataaaagctatccatgcaatgagacgcgcaacgctatcctgaatgggcttcagaaggccggagtgagtgcggactttttgtctcgggaagtagaggaagccctgtggcatattctctactccgttgaggataaaatcgagatcgaaagcgcactgagaaagttcgcttcgaagcacgaccttgatgacaggttcgccgacgtgtttaaaaagctgcccccgttcaaaaaggagtatggtgcttactctgccaaagcaattaagaagttgctccctctgatgcgcataggcaaatactgggaattatccaacatcgatgacaagaccaaagagcgaattgataagatcattacaggggaatgggacgagaatatccacgatcgggtccgtgagaaagccataaagctgtcagacatcactgattttaagggactacccctctggctgagttgttatgtggtctacaacagacatagcgaagctagggcgattgcaaaatgggagtccccagaagacatcgattcttatcttcgcttgttccggcagcacagcctgagaaatcctattgtggagcaggttatcaccgagacactcaggactgtgcgagacatatggaagcgcgtaggccaaattgatgaaatccatgtcgagctgggtcgggaaattaaaaaccccgccgacaagagagctaaaatgaccgcccagatcgtggagaacgaaaatacaaacttaaggataaaggcactgcttgccgagtttatcaattcagagtacgaaattgagaacgttcgtccatatagttccaatcagcaggaaaagttgaaaatctacgaggataccgtgctcaacggggtcaaggaaattcccgaggacatcaatactatactgaaaaagttccgcgagagcgaccttaaaaagcggcctacgaaatctgattttctgcactataagctctggctggaacaaaagtactgctcaccatacacaggcagaattatcccgcttggaaaattgttcaccagtgcttatgagatcgaacatattatcccccaggcccactactttgacgatagcttctccaacaaggtgatttgtgaggcagaagtaaatggcctgaaagacaagaaattagggtatgagtttataaagcacaaccctggaaagatggtggagatcggtttcggcaaaccacccgttaggatcttttctgtcgaagagtacgaacgattcgtgaaggagaattattcggggattaaaaacaagatgaataaactcctgatggatgacattcctgagactttcatcgaacggcagcttaacgatagccgctacatatccaaggtggtcaagtcactgttgagtaatatcgttagagagaaagactctaacggagaatatgagccagaagcgattagcaagaacgtgatcgtgtgcaccggctccgtaacagataggctcaaacgggactggggtgtcaatgatgtgtggaactcaattatctacccccgatttgagagactgaatgagctaaccgggagccagcaattcggctgttgggaaaacaaggagggaaaacgcgtttttcagactgctgtgccgctggaaatgcagaagggcttctctaagaaaaggatagaccatcgtcaccatgccatggacgcaattgtcatcgcctgcgctacacggaatcacatcaactacctctccaatgagagtgccagcaagaaagcaaagatttctagaacggatctgcaaaggcttttgtgtaccaaatgccgcactgacgataacgggaattataagtggatagtgaagaaaccttggccagcttttacacaggacatccgaaaggccctggaaaacattaccgtttccttcaaacagaatttaagagtgatcaacaagacaactaattactatgtacactttgatgagtcaggtaaaaaggtcctcgagaaacagattaacggagacagttgggcgatccggaagcccatgcataaggataccgtgttcggcaaagtgaatctgcaaaaggtcaaagaagttaggcttagcctggccctagacacgcctaagatgatagtggataaaaagctcaaggagaaagtactgcagttgtactcgtataagtacgacaaaaagcgcatcgataaatattttaaggaaaacgcttccctgtggaaggacttaaacctctctaaagtggcagtctactacttcaccaatgatagcacagagcccctggtggccgttcgtaagccacttgacacttcatttaacgctaaaaagattaaagaaagtgtgaccgacacagggatccagaagattctgttgaatcacctctccaacaatcaggatgaccctaacctggccttctctcccgatggaatcgacaagatgaataaaaacctaactgcactgaatgatggcaagtatcatcaaccaatatacaaagtcagagtgtgcgagccgcagggtaacaagttcagcgttgggacctccggcaataaaacgtcaaagtatgtggaggcggccaaaggaacaaacctatttttcgctgtctaccagaccgaagacggcaagcggagctatgagactattcctctcaatgtagtgatcgaaagggagaagctggggtggacacccgttccagagaacaataacaatggagataaattgctgttttggttaagtcccaacgacctcgtgtacgtccctaccgccgatgaactgaacaatggcatgcgccttgacaacatggataagggtcgaatctataaaatgatttcttgttccgggccacagtgcttctttatcccccaaaatgtgagcaacgcaataattcctgtaatcgagctgggagctaataacaaggccgaaaaatcgtggaataacgagatgattaaggtggtctgtgttccgatcagagtggaccggttgggctgcataactcagattaataaccagaagtga

SEQ ID NO: 3435 - RNA, 4551 nt, synthetic construct
  misc_feature 1..4551: note = Cas9 variant
  source 1..4551: mol_type = other RNA
atgaagaacatcctgggcctcgaccttgggaccaatagcattggatggtccgtgatacaggagaaacacaacgaaaataacgagtgccaaaagctgatcttgggtgccggctctagaattatccccatggatgctgcagtcttaggggacttcgccaaaggaaatacaatttcacagactaaggataggacgcagtaccggggcgttcgccgactgcgtgaaagatgtctactcaggcgggagcgcctgtttagagtgcttgacatcatgggtttcctgcctcagcattttagtaacgcgttgaccaggtatgggaaattcaaggatgctgacgaggaaccaaagatagcctggcggaaagatgacgagggaaagatgcactttctcttcgcagatagctttaatgaaatgatcgaggagttccgctccgtacaaccggaactgctgaaacgaggcatgaaggtgccctacgactggacactctattacttaagaaagaaggccatgagggaggctgtcactccttttgaactggcatggcttattttgtctttcaaccagaagcggggctattaccagctgcgtggggaggaagagggagaagccgataattcgaaatcagaggagtatctagctcagcgcgtggttgacgtgatcgataccggtgaaaagaaaggcaagagcacatggtttgacattgtcctcgagaacgggatggtgtaccatagaccagccgaaatcaaacccgactggataggaaagaccaaagagttcattgtaactacacaatttgataaggacggcaatcctaagaaagataaggaaggtaacgttaaaatgagtttcaggatgccaaatgagaacgactggaatctgcagaagaaaaaggcggagaaggatatcgacgaatccgggatgaccgtgggagagtacatttataacgcacttctgcacaaccccaaacagaagatcaaaggcaagttggtccgggtggtggaacgaaaatactataagaatgagctccagaagatcctggaatctcaaaaacgcttcattcctcagttaagcgattccgccctgtacgagaagtgcataaaagagctctatcagtcaaacgaggcttacagaaatagtatcagcacgaggaacgactttacttatcttttcgtcgataatattatcttttaccaacggccactgaagtctaaaaagtccttgatagacaactgtccgtacgaatcactagcctataccaaggatggcgaggaacataaagcacccgttaagtgcattgctaaaagccaccctctgtaccaggagttccgcctctggcagtttatcagtaatctgagaatctatcagaggcaaaaacaggtgggggacaaagtaaaacttgacgtggatgtcacagacgagttcctgccaactgatgaccgtcgggaatctttgtttgattacctcaacgacaaaaccgaaattaagcaggatgtgctgttaaaggagttcttttccatgaaaaagcccaaaggaaaggacagcgtttatccttaccgatggaattatgtggaagataaatcgtacccatgtaacgtcacaagaggtaagatcctggccaagctaaatagggcgggcatttctgccgacttcctctcctcaaacgggaatgaggagagtctgtggcacatactttacagcgtggaagataaaggagagttgcgcaaggcactggctcggtttgccgctaaaaacggcctcgacgatgccttcaccgaagcactggccgacatcgagccctataagaaagaatacggtgcttattccgcgaaggcacttaagaaactgttgccgctcatgagactggggaagtactggaattatgacaacattgcccctgctacgaaagccaggatctctaagatcattgatggcgagtacgacgagaacatacgcaatcgagtacgggaaaaagcaatgagcttaaactcagccagtcagtttcaaggactgcccctatggctcgcttgctatatcgtttacgatcgtcattccgagagagccgacagcgggaggtggtcttcaccagaagatattgacaagtacctgagtgatttcaagcagcacagccttcgcaatcctatcgtggagcaggtcgtgactgaaacattgcggaccgtcagagacatttggaaaaggtatggggagatctccgagatacatgtggaactgggacgagagatgaagaaccccgcagataaacgctctaagatgaatcggagaatgctcgaaaacgagaatgcgaacatgagggctaaactgttactgactgagttcatgaatccagaatttggtatcgagaacgttcgttcgtacagcccctcccagcaagaacttttgcgcatttatgaggacggcgccatctcaaatgcagggagtgaaattgatgacgagatctctgatataatgagccggctctcccaggtggacgtaaagaaacagcctacagcctcagaggtcaagagatacattctgtggctagaacagaactataggagcccatacaccggacaaatgatcccgctggctaaactcttcacgcccgcctatgagattgaacacgtgatccctcagtctcgatactttgacgattccttcagtaataaggttatatgtgaggcagaagtgaacaagctgaaagaccggatgcttggctacgagtttatcaagcagcacaaaggtgagaaggtcagcttgtctatgggcggcaccgtggaaattctgtccccagaggaatatgtacgccatgtggagtcacaatacaagaataacaaagctaagatgagaaaattactcatggatgacatccccgatgagttcattaacaggcagctgaatgacagtcggtatatcagcaaacttataatttcgctgttgtccaacatcgttcgagaagagggagaagaggaagccacatctaagaatgtcatcagctgcaacggctcaattactgatagactcaagaaggactgggggatcaatgatgtgtggaaccacattatactgcctcgctttaggcgtctaaatgagctgaccggaacagacaaattcactaccagtaacaaggagggtcatgaagtgccagagatgcccctcgaactgcagaaaggctttaataagaaacggatcgatcacagacatcacgcgatggacgccattgtcatcgcttgtattacaagggaccacgttaaccttttgaataacgaggcagccatgtccaagaataacgctaatcgcatccagctgtctaagaaattacgaagatacgaaagcgtggagatagagaaggatgggatccggaaacaaatttccatggccaaggagttcaaaaagccgtgggaaggatttaccgcagacgtggaaaggactctccgcgatatcgtagtctcattcaagcagaacctgcgtgtgattaacaaaacgacaaattattaccagcattttaaggacggcaaaaagatctatagccctcagagtaaaggtgattcttgggcgataagaaagtccatgcacaaagagaccgttttcggggaaattaacatccggaggatcaaggaggtgagccttaaggaggccatgaaacgcattaaggacatagctgataaagaactgcgatcgaagatcgtcgagctaatggccctccaatacaatgaaaagaagattaagcagtacttctcagacaacaaagatgagtggtctgacgtgaatccaaagaaaatcaagattcattattttactaaagaaaccaacgagagattctttgcaacacggaagcccctggataccagtttcgacaagaaaaagatcaaaactcaggttgctgatacagccatacagaagatcttgctgaatcacttatccgcacacggcgacaaagccgagacggcttttagccctgacggaattgatgaaatgaacaggaatatcattgagctcaacgacggcaagttccatcaacccatcctgaaggtgcgcatatacgaaaaagcggataagtatgccgtagggcagcagggaaataaaaagaaaaagtacgtcgaggcagctaaaggcaccaacctgtttttcgccatttatgccgaggaaaagatcgacgagaagactggtgatacagtgatcaccagaacatacgactctattccacttaatgtggtcatcgatagggaaaaacgggggttgagccctgttcccgagaacgaaaatggagctaagccaaaatatgtgctctccccgaacgacctggtatacgtgcctaatgaggaggaacgtgagactggccgcatatgcgaacccctagataaggagcgaatttacaaaatggtctcaagtaacaagaagcaagcatttttcatcaaaagcgaagtggcctctaccattgttgacaagtttgagttctccgcgctgaacaaacaggagagagctctttcaggtgaaatgatcaaggagatatgtattccaatcagtatcaataggattggcgaaatcacgctccggtga

SEQ ID NO: 3436 - RNA, 4554 nt, synthetic construct
  misc_feature 1..4554: note = Cas9 variant
  source 1..4554: mol_type = other RNA
atgaagaaaatcgtgggcctggacctcgggaccaacagcattggatgggcccttataaatgcttacatcaacaaggagcacctgtatggtattgaagcatgcggctccagaatcattcccatggatgccgcgatcttggggaatttcgacaaaggaaactctatatcacagacagctgataggacgagttaccggggcatccgccgattacgtgagagacatctgctaaggcgggaacgcctccacaggattctggaccttctgggtttcttgcctaagcattatagcgattccctcaatagatacgggaaattcctgaacgacatcgagtgtaagctgccatgggtcaaggatgaaactggatcttataaatttattttccaagagtcgtttaaggagatgctcgccaatttcaccgaacaccatccgatcttaatagcaaacaataaaaaggttccctacgactggacaatttattacctgcggaaaaaggcccttactcagaagatctcaaaagaggaattggcttggattctgctaaactttaatcagaagcgcggctactatcagctccgaggcgaggaggaagagacccctaacaaactggtggaatactatagccttaaggtagagaaagtggaagatagtggggagagaaagggaaaagacacatggtacaatgtccacctggagaacggtatgatctataggcggacctccaatatcccattggattgggaaggcaagactaaggagttcattgtgacaaccgacctcgaagcagatgggtctcccaaaaaggacaaagagggaaacataaagcgtagctttcgcgcccctaaagacgatgactggacgctgatcaagaagaaaactgaagctgatattgacaagatcaaaatgaccgttggcgcctacatatatgatacattactgcaaaagccagaccagaaaattagaggtaagctcgtgaggactatcgagcggaagtactacaaaaacgagctttatcagatcctgaagacccagtccgagttccacgaagaattgcgagataaacaactatacattgcgtgcctgaatgagctctatcccaacaatgaacctcgcagaaactcaatcagtacaagggacttttgtcatctgttcattgaggatataatcttttaccagcggccacttaagagcaaaaagtctctgattgacaattgcccgtatgaggaaaaccgctacatcgataaggagtccggggaaatcaaacacgcatcaattaagtgtatagccaaaagccatcccttgtatcaggagttcagactctggcagttcatcgtcaatctgaggatttaccgtaaggagaccgacgtggacgtaacgcaagaattactgcctactgaggctgattacgttacactatttgaatggctcaacgagaaaaaggaaatcgaccagaaagccttctttaagtatccacccttcggatttaagaaaaccacaagtaattaccggtggaactatgtggaggataagccttacccatgcaatgagactcacgcacagattatcgctcgactgggcaaagcccacatacccaaggcgttcctttctaaagaaaaggaggaaaccttgtggcatatcctgtattccattgaggacaagcaagaaatcgagaaagccctccacagctttgcaaacaagaataacctgtcggaggagttcattgaacagtttaaaaatttcccgccttttaagaaagaatacggctcttattccgctaaggccatcaagaaacttctgcccttgatgagaatggggaagtactggtcaatagagaacattgataacggaacgaggatccgcattaataaaatcatagacggtgaatacgatgagaacatccgggagagagtcaggcagaaggctattaatctcaccgacatcacacatttccgcgccctgccattatggctggcatgttatctagtgtacgatcgacacagtgaagtgaaagacattgtcaagtggaagactcctaaagatatcgacctctatcttaagagctttaaacagcattcccttcggaaccccatagttgagcaagtgattaccgaaacattgcgtactgtaagagatatctggcaacaggtgggccacatcgacgagattcacatcgagctggggagggaaatgaagaatccagccgacaaacgcgctcggatgtctcagcagatgattaagaacgagaataccaacctcagaataaaagcgctgttaacagaatttctgaatcccgagttcggaatcgaaaacgtcaggccttacagcccatcacagcaggatcttttgcgaatttatgaggagggcgtgctcaatagtatcctggaactaccggaggacattggtatcatactggggaagtttaaccagaccgatactctcaagcgccccacgcggtccgaaatcctgagatacaaactttggttggagcaaaagtataggagcccttacacaggcgaaatgattccactgtctaaattattcacccccgcatacgagatcgagcatattatccctcagtcacgttattttgacgatagtctcagcaataaggttatatgcgaatccgagattaacaaactgaaggaccgctctcttggatacgagttcatcaagaatcaccatggcgaaaaagtggaactggcctttgataagccagtcgaggtgttgtcggtagaggcttatgaaaaactcgttcacgagagctactcccacaaccggtcaaagatgaaaaagctgctaatggaagacatccccgatcagttcattgagagacagctgaacgacagtaggtatatatctaaggtggtcaaaagcctcctgtccaatatcgtgcgagaggaaaacgagcaagaagccatttcaaagaatgtcatcccgtgtactgggggaattaccgatcggcttaaaaaggactggggtatcaacgatgtgtggaataaaatagttttgcctcgctttatcagactgaacgagttaacagaaagcaccaggttcacttctattaatacaaacaatacgatgatcccatccatgcccctcgagctgcagaagggctttaacaagaaacggattgaccatcgacaccatgcaatggacgccatcataattgcttgcgccaatagaaacatcgtgaattaccttaacaatgtaagtgcaagcaagaacaccaaaatcactcgcagggatctgcagacactactctgtcacaaggacaaaaccgataacaatgggaactataagtgggtcattgacaagccttgggagacattcactcaagataccctgacggcgttgcagaaaatcaccgtgtcttttaagcagaatctgcgtgttataaacaaaacaactaatcattaccagcactacgaaaacggaaagaaaattgtgtccaatcaatcaaagggcgacagttgggctatccggaaaagcatgcacaaggagaccgtccatggtgaagtgaacttaagaatgattaagacagtatcgttcaatgaggccctcaaaaagccccaggcaatcgtggaaatggatctgaaaaagaaaatacttgccatgctggagttggggtatgacactaagaggattaagaactactttgaggaaaataaagatacctggcaggacatcaacccatccaagatcaaagtttattacttcacgaaggagacaaaagatcgctatttcgctgtccgaaagcctattgacacctcttttgacaagaaaaagatcaaagaaagcattactgatacaggcatacagcaaatcatgctcagacacctggagaccaaggacaatgatcccactctagccttctcaccagacggaattgatgaaatgaaccggaatatcctgatccttaacaaaggcaagaagcatcagccgatttacaaagtgagggtgtatgagaaggcagagaaatttaccgtcgggcagaagggaaataaacgcacaaagttcgttgaagctgccaaaggtacgaacctctttttcgcgatatacgagaccgaagagatcgacaaggatactaagaaagtgattcgtaagagaagttactccacaatccctctgaacgtggtaattgagcggcagaaacaaggcttgtctagcgcccccgaagacgagaatgggaacctgccaaagtatatcttatcccccaatgatctcgtctacgtgcctacccaggaagagataaacaaaggagaagttgtgatgccaatcgacagggatcgcatttataagatggtcgactcaagcggcatcacagctaattttattcccgcaagtactgccaacctgatcttcgctctgcctaaggccaccgcagagatatactgcaatggtgagaactgcattcagaatgaatatgggatcggctctccgcaatccaaaaaccagaaggcgattacgggagagatggtgaaagaaatctgttttccaataaaggttgatcgactgggcaatatcattcaggtggggagctgcatcttgacaaactga

SEQ ID NO: 3437 - RNA, 4563 nt, synthetic construct
  misc_feature 1..4563: note = Cas9 variant
  source 1..4563: mol_type = other RNA
atgaagaaaatcgtgggcctggacctcgggaccaacagcattggatgggcccttataaatgcttacatcgatgagtataacaaggaacacctgtacggtattgaggcatgcggctccagaatcattcccatggacgccgcgatcttggggaatttcgataaaggaaactctatatcacagacagctgacaggacgagttatcggggcatccgccgattacgtgaaagacatctgctaaggcgggagcgcctccacagaattttggatcttctgggttttctgcctaagcattacagcgactccctcaataggtatgggaaattcctgaacgatatcgaatgtaagctgccatgggtcaaggacgagactggatcttacaaatttattttccaagagtcgtttaaggaaatgctcgccaatttcaccgagcaccatccgatcttaatagcaaacaataaaaaggttccctatgattggacaatttactacctgcggaaaaaggcccttactcagaagatctcaaaagaagagttggcttggattctgctaaactttaatcagaagcgcggctattaccagctccgaggcgaggaagaggaaacccctaacaaactggtggagtattacagccttaaggtagaaaaagtggaggacagtggggagagaaagggaaaagatacatggtataatgtccacctggaaaacggtatgatctacaggcggacctccaatatcccattggactgggagggcaagactaaggagttcattgtgacaaccgatctcgaagcagacgggtctcccaaaaaggacaaagaaggaaacataaagcgtagctttcgcgcccctaaagatgacgattggacgctgatcaagaagaaaactgaggctgacattgataagatcaaaatgaccgttggcgcctatatatacgacacattactgcaaaagccagatcagaaaattagaggtaagctcgtgaggactatcgagcggaagtactataaaaacgaactttaccagatcctgaagacccagtccgagttccacgaagagttgcgagacaaacaactatatattgcgtgcctgaatgaactctaccccaacaatgagcctcgcagaaactcaatcagtacaagggatttttgtcatctgttcattgaggacataatcttttatcagcggccacttaagagcaaaaagtctctgattgataattgcccgtacgaagagaaccgctatatcgacaaggaatccggggagatcaaacacgcatcaattaagtgtatagccaaaagccatcccttgtaccaggagttcagactctggcagttcatcgtcaatctgaggatttaccgtaaggaaaccgacgtggatgtaacgcaagagttactgcctactgaagctgactatgttacactatttgagtggctcaacgagaaaaaggaaatcgatcagaaagccttctttaagtacccacccttcggatttaagaaaaccacaagtaattatcggtggaactacgtggaggacaagccttatccatgcaatgaaactcacgcacagattatcgctcgactgggcaaagcccacatacccaaggcgttcctttctaaagagaaggaagagaccttgtggcatatcctgtactccattgaagataagcaagagatcgagaaagccctccacagctttgcaaacaagaataacctgtcggaagagttcattgaacagtttaaaaatttcccgccttttaagaaagagtatggctcttactccgctaaggccatcaagaaacttctgcccttgatgagaatggggaagtactggtcaatagaaaacattgacaacggaacgaggatccgcattaataaaatcatagatggtgagtatgacgagaacatccgggaaagagtcaggcagaaggctattaatctcaccgatatcacacatttccgcgccctgccattatggctggcatgttacctagtgtatgaccgacacagtgaggtgaaagatattgtcaagtggaagatccctaaagacatagatctctaccttaagagctttaaacagcattccctgcggaaccccattgttgaacaagtgatcactgagaccttgcgtacagtaagagacatctggcaacaggtgggccacattgacgagatccacattgaactggggagggagatgaagaatccagccgataaacgcgctcggatgtctcagcagatgataaagaacgaaaatactaacctcagaatcaaagcgctgttaaccgagttcctgaatcccgagttcggaattgaaaacgtcaggccttatagcccatcacagcaggaccttttgcgaatctacgaggaaggcgtgctcaatagtattctggagctaccggaagatatcggtataatcctggggaagtttaaccagacagacaccctcaagcgccccactcggtccgagattctgagatataaactttggttggaacaaaagtacaggagcccttacacgggcgagatgatcccactgtctaaattattcacacccgcatatgagattgaacatatcatacctcagtcacgttactttgatgacagtctcagcaataaggttatttgcgagtccgaaatcaacaaactgaaggatcgctctcttggatatgagttcatcaagaatcaccatggcgaaaaagtggagctggcctttgacaagccagtcgaggtgttgtcggtagaggcttacgaaaaactcgttcacgaaagctattcccacaaccggtcaaagatgaaaaagctgctaatggaggatattcccgaccagttcatagagagacagctgaacgatagtaggtacatctctaaggtggtcaaaagcctcctgtccaatattgtgcgagaagagaacgaacaagaggccatctcaaagaatgtcattccgtgtaccgggggaatcactgaccggcttaaaaaggattggggtataaacgacgtgtggaataaaatcgttttgcctcgctttattagactgaacgaattaaccgagagcacaaggttcacctctatcaatactaacaatacaatgattccatccatgcccctcgagctgcagaagggctttaacaagaaacggatcgaccatcgacaccatgcaatggatgccataattatcgcttgcgccaatagaaacatcgtgaattatcttaacaatgtaagtgcaagcaagaacacgaaaattacccgcagggacctgcagactctactctgtcacaaggataaaacagacaacaatgggaactacaagtgggtcatcgataagccttgggaaaccttcacacaagacactctgaccgcgttgcagaaaataacggtgtcttttaagcagaatctgcgtgttattaacaaaaccacaaatcattaccagcactatgagaacggaaagaaaatcgtgtccaatcaatcaaagggcgatagttgggctattcggaaaagcatgcacaaggaaactgtccatggtgaggtgaacttaagaatgatcaagaccgtatcgttcaatgaagccctcaaaaagccccacgcaatagtggagatggacctgaaaaagaaaattcttgccatgctggagttggggtacgatacaaagaggatcaagaactattttgaagagaataaagacacttggcaggatatcaacccatccaagattaaagtttactatttcaccaaggaaacgaaagaccgctacttcgctgtccgaaagcctatcgacacatcttttgataagaaaaagattaaagagagcataaccgacactggcatccagcagattatgctcagacatctggaaacaaaggataatgaccccaccctagccttctcaccagatggaatcgacgagatgaaccggaatatcctgattcttaacaaaggcaagaagcaccaaccgatatataaagtgagggtgtacgagaaggcagaaaaatttactgtcgggcagaagggaaataaacgcaccaagttcgttgaggctgccaaaggtacaaacctctttttcgcgatctacgaaacggaggagattgataaggacaccaagaaagtgatccgtaagagaagttattccactattcctctgaacgtggtaatcgaacggcagaaacagggcttgtctagcgcccccgaggatgaaaatgggaacctgccaaagtacatattatcccccaatgacctcgtctatgtgcctacacaagaggaaatcaacaaaggagaggttgtgatgccaattgatagggaccgcatctacaagatggtcgattcaagcggcattaccgctaattttatccccgcaagtacagccaacctgatattcgcccttcctaaggctactgcagagatttattgcaatggtgaaaactgcatccagaatgagtacgggattggctctccgcagtccaaaaaccaaaaggcgatcaccggagaaatggtgaaagagatatgttttccaatcaaggttgaccgactgggcaatattatccaggtggggagctgcattttgacgaactga

SEQ ID NO: 3438 - RNA, 4563 nt, synthetic construct
  misc_feature 1..4563: note = Cas9 variant
  source 1..4563: mol_type = other RNA
atgaagaaaatcgtgggcctggacctcgggaccaacagcattggatgggcccttataaatgcttacatcgatgagtataacaaggaacacctgtacggtattgaggcatgcggctccagaatcattcccatggacgccgcgatcttggggaatttcgataaaggaaactctatatcacagacagctgacaggacgagttatcggggcatccgccgattacgtgaaagacatctgctaaggcgggagcgcctccacaggattctggatcttctgggtttcttgcctaagcattacagcgactccctcaatagatatgggaaattcctgaacgatatcgaatgtaagctgccatgggtcaaggacgagactggatcttacaaatttattttccaagagtcgtttaaggaaatgctcgccaatttcaccgagcaccatccgatcttaatagcaaacaataaaaaggttccctatgattggacaatttactacctgcggaaaaaggcccttactcagaagatctcaaaagaagagttggcttggattctgctaaactttaatcagaagcgcggctattaccagctccgaggcgaggaagaggaaacccctaacaaactggtggagtattacagccttaaggtagaaaaagtggaggacagtggggagaagaaaggaaaggatacatggtataatgtccacctggaaaacggtatgatctacagaaggacctccaatatcccattggactgggagggcaagactaaagagttcattgtgacaaccgatctcgaagcagacgggtctcccaagaaagacaaggaaggaaacataaaacggagctttcgtgcccctaaggatgacgattggacgctgatcaagaaaaagactgaggctgacattgataaaatcaagatgaccgttggcgcctatatatacgacacattactgcaaaaaccagatcagaagattcgcggtaagctcgtgagaactatcgagaggaaatactataagaacgaactttaccagatcctgaaaacccagtccgagttccacgaagagttgcgggacaagcaactatatattgcgtgcctgaatgaactctaccccaacaatgagcctcgacgcaactcaatcagtacaagagatttttgtcatctgttcattgaggacataatcttttatcagaggccacttaaaagcaagaagtctctgattgataattgcccgtacgaagagaaccggtatatcgacaaagaatccggggagatcaagcacgcatcaattaaatgtatagccaagagccatcccttgtaccaggagttccgcctctggcagttcatcgtcaatctgagaatttacaggaaagaaaccgacgtggatgtaacgcaagagttactgcctactgaagctgactatgttacactatttgagtggctcaacgaaaagaaagagatcgatcagaaggccttctttaagtacccacccttcggatttaaaaagaccacaagtaattatcgttggaactacgtggaggacaaaccttatccatgcaatgaaactcacgcacagattatcacccggctgggcaaggctcacatacccaaagccttcctttctaaggagaaggaagagacgttgtggcatatcctgtactccattgaagataaacaagagatcgagaaggcgctccacagctttgccaacaaaaataacctgtcggaagagttcattgaacagtttaagaatttcccgccttttaaaaaggagtatggctcttactccgcaaaggctatcaaaaagctgctgcccttgatgcgaatggggaaatactggtcaataaagaacattgacaacggaaccagaatcaggattaataaaatcatagatggtgaatatgacgagaacatccgcgagcgggtcagacagaaggccattaatctcacagatatcactcatttcagggctctgccattatggctggcctgttacctagtgtatgaccgccacagtgaagtgaaggatattgtcaaatggaagacccctaaagacatcgatctctaccttaagagctttaaacagcattcccttcgaaaccccatagttgagcaagtgattacagaaactttgcggaccgtacgtgacatctggcaacaggtgggccacatcgacgagattcacatcgagctggggagagaaatgaagtctccagcagataaaagggcccgcatgagccagcagatgattaagaatgagaacacaaatctccggataaaggctctgttaaccgaatttctgaaccccgagttcggaatcgaaaatgtcagaccttattcaccaagtcagcaggaccttttgaggatttacgaggagggcgtgctcaactccatcctggaactaccggaggatattggtatcatactggggaaatttaatcagactgacacgctcaagcgacccacacgcagcgaaatcctgcggtataaactttggttggagcaaaagtacagatctccttacaccggcgaaatgattccactgtcaaaattattcactcccgcgtatgagatcgagcatattatccctcagagtaggtactttgatgacagcctctccaacaaggttatatgcgaatctgagattaataagctgaaagatcgttcgcttggatatgagttcatcaagaaccaccatggcgaaaaagtggaactggcatttgacaagccagtcgaggtgttgagcgtagaggcctacgaaaaactcgttcacgagtcctattcacacaatcgcagtaagatgaagaaactgctaatggaagatatccccgaccagttcattgagcggcagctgaacgattctagatacataagcaaggtggtcaaatccctcctgtcaaacatcgtgagggaggaaaatgagcaagaagctattagcaagaacgtcatcccgtgtaccgggggaattacagaccgacttaaaaaggattggggtatcaatgacgtgtggaacaagatagttttgcctcggtttatccgcctgaatgagttaaccgaatctactagattcacatccattaacacgaataacaccatgatcccaagtatgcccctcgagctgcagaaaggctttaataagaaaaggattgaccatcggcaccatgccatggatgcaatcataattgcctgcgctaaccgaaatatcgtgaactatcttaataacgtaagcgcctctaagaatactaaaatcacaagacgcgacctgcagaccctactctgtcacaaggataagacagacaacaacgggaattacaaatgggtcattgataagccttgggagactttcacccaagacacgctgaccgcattgcagaaaatcacagtgtcctttaagcagaacctgagggttataaataaaactaccaaccattaccagcactatgaaaatggaaagaaaattgtgtcaaaccaaagtaagggcgatagctgggcgatccgtaagtcgatgcacaaagagacagtccatggtgaagtgaatttacggatgattaagactgtatccctcaacgaggctctgaaaaagccccaggccatcgtggaaatggaccttaaaaagaagatactggcaatgttggagctcgggtacgataccaaaagaattaagaattatttcgaggaaaacaaagacacgtggcaggatatcaatccatctaagatcaaagtttactattttacaaaggagaccaaggacaggtacttcgccgtccgcaaacctattgacactagcttcgataagaaaaagatcaaagaatcaattacagacaccggcatacagcaaatcatgctgcgacacctagagactaaggataacgaccccaccctggcttttagtccagatggaattgacgaaatgaatagaaacatccttatcctcaataagggcaaaaagcatcagccgatttataaagtgcgggtgtacgagaaggccgagaaattcacagtcgggcagaagggaaacaaaaggacgaagtttgttgaagcagctaagggtaccaatctgttctttgccatatacgagactgaagagatcgataaagacacaaagaaagtgattcgcaagcgttcctattctaccatccctttgaacgtggtaattgagagacagaaacaaggcctgagctccgcgcccgaagatgagaacgggaatttaccaaagtacatcctctcacccaacgacctggtctatgtgcctacacaggaagagataaataagggagaagttgtgatgccaatcgatcgggacaggatttacaaaatggtcgatagcagtggcatcactgccaacttcattcccgcttctaccgcaaatcttatctttgccctgcctaaggctacggccgagatatattgcaacggtgagaattgcattcagaacgaatacgggatcggctccccgcaaagcaaaaatcagaaggcaattacaggagagatggtgaaagaaatctgtttcccaataaaggttgaccgcttgggcaacatcattcaggtggggtcgtgcatcctcaccaattga

SEQ ID NO: 3439 - RNA, 4575 nt, synthetic construct
  misc_feature 1..4575: note = Cas9 variant
  source 1..4575: mol_type = other RNA
atgaacaagatcctgggcctcgaccttgggaccaatagcattggatgggccatagtgcagaaagatgagcaaggtttctacgaaaagatcattaacgctggctccagaatcattcccatggacgcagagacaatgaataactttaataaagggatcactaagtctcctgcctcagaaaggacgcggttccgcggagcgcgacgtctgatagagagaagtttgttaaggcgggaacgcatccacagactgctaaacaccatgaattatctcccaccgcattacgctgagaaaattgattttgtcaacaggctgggcaagttcatcggtgaggaggaacccaagtatgcctacaaagttgacgaacacgggaagtttcagttcatttttaaagagagcttcaatgagatgcttaaggattttcaggacaaacagcctgaactggtgttgaacaataagaaggtaccatatgattggacaatctactatctccggaaaaaggcactgaaccgcgccatatccaaagaggaactgggatggattatcctccaattcaataacaagcgaggctactaccagttaagaggcgaggaagacgagactctgaccgaggggcagaaaaaggaatattttgctcttaaagtgattagggtcgaggcagattcttcgtcagccggaaagaagggtgaagtgtggtacaatgttcagttggagaacggctggatctatcggtgcaaaagcgaaatccccctggactgggaggggaagattaaagagttcatagtgacaaccgaagtcgatgagaacgacaatgtgctaaaggataaagaaggaaaggagaagcgtaaactcaagatccctgaagctggcgactggactctgcttaaaaagaaaacagagagtgacctggataagtccggtaagaccgtaggggcctacatttatgacacgttgctctctaacccagatcagaaaatcaagggaggcctgatacgcactattgagagagaattatacaggagcgagctggaacaaatcctcgacaaacagaaggagtttcatcccgagcttaaagatggcaccctgtataataagtgtgttgaagagttgtaccggtccaacgaatcacgacgcatcagtctaagcaattacgacttcacaagattcattactgaggatgtgatcttttatcagaggcctctgaagtctaaaaagtccctcattgacaactgctcattcgaacggcgcaattacctgaacccaataaccaaagagcttgcgtatgcaccgatcaagtgtattgccaaaagccaccccctgtttcaagagttcagattgtggcagtttatcaagaatctcaggatcattgaacgtgagaaaatagtcggggataagctgatgttcgaccaggatgtgacaaccgaatttttacctacgcaaaacgactacgtgatcctgttcgactggctaaatgagcataaggaaattgatcagaaagctctcctgaagtatccagcctttaaccttaaaaagaatatcgacaaataccggtggaactatgtcgagaataagagttacccctgcaacgagactcgagcattgctgaaggctaaactcaacaaggccggaaatattccttctgatttcctggacaacgatacacttgaatccctgtggcacatcttgtacagcgttgaggacaaatttgaaatagagaaggcgctcaaatcgttcgccaccaagaaggaactgagagaggagcagactgtggcatttgtaaaacagttcatcaatattccacccttcaagaaagaatatggttcttactccgctaaggccatcaaaaagttactgcaactaatgaggatgggctcacgctggagtgagaacgaaattagcgattccacaaaggaccggatccagaaactcatagatggggagtgggacgagtctattaagaccagaacgagggataaagctatcaagctgaatgaaattaacgactttcagggacttccgttgtggctggccagctatatcgtgtacgatcgccactcagagagtggcgacgtcatgaaatgggaaacccctgaggacatagattattacctcaagcatgtgttcaaacagcacggtctgcgaaatcccatcgttgaagtggtcgtggtagagacattaaaggttgtgaaggacctgtggaaaacttatgggtactttaacgagattcatatcgaacttggccgggagatgaagaatccagcagataaacgtagatccatgaccaacaagaatattgaaaacgagaatacaaacttgaggatcaaagccctcctggctgaactagcgaatcacaaggacgtcgagggagtgcgcccttacagcccctctcaacaggagatactgaagatttatgaagagggcgtcctcgatatgctgactaaagaagacccagattacgagtcaatcagtaagatcagcaaaatggcacttccctcctcttcggaattgattcggtataagtgttggctggagcagaaatacagaagcccttataccggacaggtgatcccattagcccgcctcttcacatccgagtacgaaattgagcacataatcccgcaatcacgatattttgacgatagtttctctaacaaggttatttgcgaaagcgctgtgaacaaggacaaagataatctgcttgcctacgagtacatcaagcagaacgagggaaaaattatcgaaataggtctgggcaagaaagtaaagttgtttaccgcagactcctatactgagttcgtccagtcaaattacgtggggagcgttgccaagaaaaagaaactcctgatggatacgatccccgactcttttattaagcgccagctaaacgactcccggtatatcagtagagaaattatgaaactgctcagctctgtggtcagggagaaggaagaggaggaagaggaagaggaagaggaggctatctccaagaatgtgatagtatgtacaggagccattaccgataaactgaagcgtgaatggggccttaacgacgtgtggaatactatcatctaccctcgcttcgagcggttgaaccaactgaccaattcagataaatttggtcagtgggaaaacaagcaggggaaaaaggttttccaaattgagatgccattaaaactccagaagggctttaataagaaaagaatagaccataggcaccatgcaatggatgcgatcgtcattgcttgcgccacacagagtcacgtgaactatctgaataacgaaagcgcacattccaattcgaaggagaaacgatactatcttcggcgcaagctgagaaggatcgagattctagaaaaacaggagctcaaggacggagtgaccatcactaagaaaatagaagtcgccaaggagttcaacaaaccctggcctacattcacgcaagatgctcacgaggttctgcagtctatcattgtgagctttaagcagaacttgcgggtggtaaataaagccaccaaccgatacgcatgtttcgtcaatggcaagaaggaaatcgtgaaacagtcaaagggggagagttgggctattagaaaaccaatgcacaaggacactgtttccgccgcggtgtctctgcgcaaaatcaagacagtcagcttatcccaagccatagatgactggaccaacattgtggataagtcactcaggaaagaaatcggactgctttacagcaagtatggtcagaatggcagtaaaaacatcattaagtactttaaagaccgtgacaataagcataacgggctggatgtttctaaagtgaatgtacactatttcgacaacgattacgctgcatcccgggtcgccttggaccataagtttaatagcgctaagatcaaatcgataacagatactgggattcagaccatcctcctgaagcacctagagtcatataacgaaattaatggcgacaaaatcatagagcaccccgagctggccttctctgcagatggtcttgacattctcaacgcgaatatcacgaagctgaacaatgggaaatttcataagccgatcaagaaagtgagaaagaccgaaacattgggcctgaaattcattgtgggacagactggcaacaagaggaaaaagtacgtcgaggccgctgatgggaccaacttatttttcgccatctatgttagtgtggacggaattaggtcctacaagacaatacctctccgagaagtagcagagagactgaaagaaggccttatcccagtgcccgagaagaatgataaagacgatcacctgttgttttggctcagccctggtgacctggtctacgtgccctctattgaggaagaggggcggatcgttgaaatcgagaacattaagcaagacaggatatataaagtggtcagctgcactgaaaatgagtgtcattgcatcccacacttcgtggcttcccctattgttaagaccgatgagctaggagccaacaataaggcacagcgcgcctggtcaggcgaaatgatcaaagagacgtgcattaagatcaaaatgaaccgtctgggtcagatagtgaagatctga

SEQ ID NO: 3440 - RNA, 4581 nt, synthetic construct
  misc_feature 1..4581: note = Cas9 variant
  source 1..4581: mol_type = other RNA
atgaagaaaatcctgggcctcgaccttgggaccaacagcattggatgggccgtgctgaatgctgcagatgacaactccttgaagtacatagaggccgcgggttctagaatcattcccatggatgctgccatcttaggcgacttcgataggggaaattcaattagtcagacagcagaacggactcgcatccgagggatgcgtcacctgagagagaggtatctactccggcgcgccagactgcataggatacttaacctgttgggctttctccctttccactacgctcaagacatcgatcggtatggtaattttagcgcagacatggaaccaaaaattgcctggcgcaagaacctggagggggaactggagttcatctttattgagtccttcaatgaaatgctcgaggattttcgaaagaaccagccggaattagtcgctgacaataaaaaggttccctacgattgggtgatctattacctgaggaaaaaggcccttgagaaaaagatatctaaagaggaattggcgtggattctgctaaacttcaatcagaagagaggatattaccagctccggggcgaggacgatgacgaatcgatgaagacggcaaaaacccgtcaatactttgacaagcagatcattaaaaacatcatcgatacaaatcagacttataagggccagcgcattctgatagtagagcttcaaaacggggacaaaggaaagatcttcaaaaaggaaattcctgattggatcggtcaggagaagaatataattgtgaccgtcgacatcgataaagacggcaacgataagtacgaggaatcagggagcctgagttgcagatttaaaatcccaacagacgccgagtgggaatccgagtggaagttgattaaaatgaagacccagaaggatctcgacgaatctaacaaaactgtgggaacatatatctacgatagcattctgcagaatcccacccaaaaggttaggggcaaattagtgcggacgatagagcgaaagtattacaaagctgagctgaagcagatcctcgaaaagcagactgagttccattccgaacttcaagacaaagacctgtatattgagtgtttgaacgaactatactcaaataacgatacccaccgcaatgccatcacagacagagattttgtctacctgttcatgaacgacatcctcttctatcagaggcctctgaagagtaaaaagagccttattgataattgcccatacgagcggaacatatatatcgacaaagagactggtgaaattaagtactctcccatcaagtgtattgcaaaatcccatcctctgtttcaggagttccgcttgtggaagtttatctcaagcataagaatctatcagagggaaagtgtggtagaggttgtggataaacaactcgacctgttctcttcccagagcacctcggtccagaagttagtgacagatgtggacgtcaccgataaatttctgacgtgcgagaatgactacgttgctctattcgaatggctcaacaagaaaaagattatcgatcagaaggagtttctgaaatatcgtccattcgggcttaagggagacattgacaattaccggtggaactacgtggaagataaatcttatccgtgtaatgagactcacgccatgatcttgacatactttgcgaaggccggcatatccgaagacattctgaccaaagagatggaggaagcactctggcacatcctgtattcagtagaggatcgacaagaaattactaaggctcttagaacattcgccagtaagtaccatctgagcgactcctttgtgaaagtcttctctaacatacccccttttaagaaagagtatggcagctactcagctaaggccatcaaaaagttgctcagtctgatgaggatggggaagtattggtccgaagatgcaatcgacgtgaatacccgcgagcggattgataaaatcgttacgggagagtacgacgaaaagattagagatagggtgcgcgagaaaaccatccgattaaacgacatacggcacttccgtgccctgccagattggctagcttgctacgtcgtgtatgacagacatagcgaaacaagggagattactgaatggaagtctcccgaggagatcgatgaatacatccgcaacttcaaacagcactcactccggaatcctattgtagagcaggttatcaccgaaacactgagaactgtgagggacatttggaagcaggtcggttgtatagacgagatccacgtggagcttggccgagaaatgaagaacccagcggataaacgcaagcggattaccagtcaaatcattgagaatgaaaacgcaaatttgagagtcaaagccctgctcacagagtttgtgaaccccgagttcgagatcgagaatgttaggccgtatagcctggggcagcaggacatattacgtatctacgaagatggagtgctgaactccgtagctgaggtccctggcgacattgccggtatccttaagaaatttaatgaaaacgatgcaaagaaacgccccaccacttctgagattttgcggtataagctctggctggaacagaagtacagatcgccatatacgggggagatgatccctctaagcaaactgttcacatccgcctacgagatagaacatgtgattccccaatcaaggtactttgacgatagtttctctaataaggttatctgcgaggctgaagtgaacaaactcaaggacaatgccctgggctatgagtttatcaaaaagcaccatggagaaaaggtcgagcttggcttcgggaaaattgtggagatatttagcgtatccgtgtacgaacagttcgttaaggataactattcacgaaatcggggaaaaatgaagaaattgctgatggacgagatcccagaacagtttattgagcgccaattaaacgatagcagatacatctctaaggtcgtgaagaccctcctgtccaacgtggtcagggagaaagcagaacaggaggcggttagtaagaatgtgattgtgtgtactggtggcgtaaccgaccggcttaaaaaggactgggggatcaacgatgtctggaataaaatagtgctgccccgattcttgagactcaacgaactgacaaatagcaccaactttactgctaagaatgccgcaggaaacgagatccctgccatgccactagaactgcagaagggcttcaataaaaagcgcattgaccacaggcatcacgctatggatgccatcgttattgcatgcgctaaccgtaatatcgtgaactatctcaataacgagtctgcctcccggaaagcgaagatatcaagacacgacctgcaggccattctttgtgataaagtcaggacagacgataagggtaattaccaatggcgcgtgaagaaaccgtgggacacgttcacccaggatgtttatgtggctttggagaacatcatcgtaagttttaagcagaacctgcgagtcattaataaaactagcaactactactggcattatgaaaatgggaagaaagtgttagtgaagcaggtcaaaggcgactcgtgggcaatcagaaagcccatgcacaaggatacagttttcggagaggtgaacctccggaaagtaaagtccgtgtctctgaatgaagcccttaaaaaccctcaatttatagtcgagaaggacctgaaaaggcagctactcagcctgttgcagcagaatttcgatattaagaagatcaaaaagtactttgaagaacataaagacatttggtcagacatcagtctgtccaagatgaacatatattacttcaccaaagagacaaaggatcgctattttgctactcgtaagccattagacgcctctttcgataaaaagaaaattgaaagctgcatcaccgacacgggcatccaacagattctcctgagacaccttgagctgaaggaaaatgatcccgagcgggcattttcccctgacgggatcgatgaaatgaacaggaatattatacagttgaacaaaggaaagggtcaccatccaatcgcgaaggtgcgcgtttacgagaaagccgacaagttcgaggtgggccaacgagggaataaatcaagcaagtttgtcgaagctgccaaaggaaccaacctcttcttcgcagtgtatgagacagaataccccgatgagaagactaatagtattgttagaaaacggaactacgctaccatcccgctgaatatcgccattgagaggcagaagcgcggcctatctacagcacctgaagacgagaagggtaacgtgccatcctttgtcctgagccccaacgatcttgtatatctccctacttcggaagacatagtgaatgggcacatcacccagcccattgataaatcaagaatctacaagatggtttctagttccggcagccagtgcttctttattaaacataacatcgccaatataatcgtggacaagtatgagttctctccactgaacaaaatggaaagggctattagcaatgagatgatcaaggagatttgtatccctgtcaaggtggaccggttgggaaacatagtaaaactgggcaagtccgaatga

SEQ ID NO: 3441 - RNA, 4581 nt, synthetic construct
  misc_feature 1..4581: note = Cas9 variant
  source 1..4581: mol_type = other RNA
atgaagaaaatcctgggcctcgaccttgggaccaacagcattggatgggccgtgctgaatgctgcagatgacaactccttgaagtacatagaggccgcgggttctagaatcattcccatggatgctgccatcttaggcgacttcgataggggaaattcaattagtcagacagcagaacggactcgcatccgagggatgcgtcacctgagagagaggtatctactccggcgcgccagactgcataggatacttaacctgttgggctttctccctttccactacgctcaagacatcgatcggtatggtaattttagcgcagacatggaaccaaaaattgcctggtgcaagaacctggagggggaactggagttcatctttattgagtccttcaatgaaatgctcgaggattttcgcaaaaaccagccggaattagtcgctgacaataagaaggttccctacgattgggtgatctattacctgcgaaagaaggcccttgagaaaaagatatctaaagaggaattggcgtggattctgctaaacttcaatcagaagagaggatattaccagctcaggggcgaggacgatgacgaatcgatgaagacggcaaaaacccggcaatactttgacaagcagatcattaaaaacatcatcgatacaaatcagacttataagggccagcgtattctgatagtagagcttcaaaacggggacaaaggaaagatcttcaaaaaggaaattcctgattggatcggtcaggagaagaatataattgtgaccgtcgacatcgataaagacggcaacgataagtacgaggaatcagggagcctgagttgtcgctttaaaatcccaacagacgccgagtgggaatccgagtggaagttgattaaaatgaagacccagaaggatctcgacgaatctaacaaaactgtgggaacatatatctacgatagcattctgcagaatcccacccaaaaggttagaggcaaattagtgaggacgatagagcggaagtattacaaagctgagctgaagcagatcctcgaaaagcagactgagttccattccgaacttcaagacaaagacctgtatattgagtgcttgaacgaactatactcaaataacgatacccaccgaaatgccatcacagaccgcgattttgtctacctgttcatgaacgacatcctcttctatcagagacctctgaagagtaaaaagagccttattgataattgtccatacgagaggaacatatatatcgacaaagagactggtgaaattaagtacctgcccatcaagtgcattgcaaaatctcatcctttgtttcaggagttccggctctggaagtttatctcctcaatacgcatctatcagagagaaagcgtggtagaggttgtggataaacaactggacttattcagttctcagtccaccagcgtccagaagctggtgacagatgtggacgtcaccgataaatttctaacgtgtgagaatgactacgttgctctcttcgaatggctgaacaagaaaaagattatcgatcagaaggagtttcttaaatataggccattcgggttgaagggagacattgacaattaccgttggaactacgtggaagataaatcgtatccgtgcaatgagactcacgccatgatcctgacatactttgcgaaggccggcatatctgaagacattctcaccaaagagatggaggaagcactgtggcacatcctttattccgtagaggatcggcaagaaattactaaggctctgcgaacattcgcctcaaagtaccatttgagtgacagctttgtgaaagtcttctccaacatacccccttttaagaaagagtatggctcttacagcgctaaggccatcaaaaagctcctgtcattaatgagaatggggaagtattggagtgaagatgcaatcgacgtgaataccagggagcgcattgataaaatcgttacgggagagtacgacgaaaagattcgggatagagtgagggagaaaaccatccgcctgaacgacatacgacacttccgggccctaccagattggctcgcttgttacgtcgtgtatgaccgtcattccgaaacaagagagattactgaatggaaaagccccgaggagatcgatgaatacatcaggaacttcaaacagcactctctgcgcaatcctattgtagagcaggttatcaccgaaacacttcggactgtgagagacatttggaagcaggtcggttgcatagacgagatccacgtggagttgggcagggaaatgaagaacccagcggataaacgaaagcgcattacctcacaaatcattgagaatgaaaacgcaaatctgcgggtcaaagccctcctgacagagtttgtgaaccccgagttcgagatcgagaatgttagaccgtatagtttaagccagcaggacatactgaggatctacgaagatggggtgcttaactccgtagctgaggtccctggagacattgccggcatcttgaagaaatttaatgaaaacgatgcaaagaaacgtcccaccacttctgagattctccgctataagctgtggctagaacagaagtaccggtcgccatatacgggtgagatgatccctctgagcaaactcttcacatccgcctacgagatagaacatgtgattccccaatcaagatactttgacgatagtttctctaataaggttatctgtgaggctgaagtgaacaaactgaaggacaatgcccttgggtatgagtttatcaaaaagcaccatggcgaaaaggtcgagttgggattcggcaaaattgtggagatatttagcgtatccgtgtacgaacagttcgttaaggataactattcaaggaatcgagggaaaatgaagaaactgttaatggacgagatcccagaacagtttattgagcggcaactcaacgatagccgctacatctctaaggtcgtgaagaccctgctttccaacgtggtcagagagaaagcagaacaggaggcggttagtaagaatgtgattgtgtgcactggaggtgtaaccgacaggctgaaaaaggactggggcatcaacgatgtctggaataaaatagtgttgccccggttcctccgactgaacgaactaacaaatagcaccaactttactgctaagaatgccgcagggaacgagatccctgccatgccactggaactccagaagggattcaataaaaagagaattgaccaccgccatcacgctatggatgccatcgttattgcatgtgctaacaggaatatcgtgaactatctgaataacgagtctgcctcccgtaaagcgaagatatcacggcacgaccttcaggccattttgtgcgataaagtcagaacagacgataagggcaattaccaatggagggtgaagaaaccgtgggacacgttcacccaggatgtttatgtggctctggagaacatcatcgtaagttttaagcagaacttacgcgtcattaataaaactagcaactactactggcattatgaaaatggtaagaaagtgctcgtgaagcaggtcaaaggggactcgtgggcaatccgaaagcccatgcacaaggatacagttttcggcgaggtgaacctgagaaaagtaaagtccgtgtctcttaatgaagccctgaaaaaccctcaatttatagtcgagaaggacctaaaacggcagctcctgagcttgctgcagcagaatttcgatattaagaagatcaaaaagtactttgaagaacataaagacatttggtcagacatcagtttatccaagatgaacatatattacttcaccaaagagacaaaggataggtattttgctactcgcaagccactcgacgcctctttcgataaaaagaaaattgaaagctgcatcaccgacacgggaatccaacagattctgcttcgtcacctggagttgaaggaaaatgatcccgagagagcattttcccctgacggcatcgatgaaatgaaccggaatattatacagctcaacaaagggaagggacaccatccaatcgcgaaggtgagggtttacgagaaagccgacaagttcgaggtgggtcaacgcggcaataaatcaagcaagtttgtcgaagctgccaaagggaccaacctgttcttcgcagtgtatgagacagaataccccgatgagaagactaatagtattgttcgaaaaagaaactacgctaccatcccgctaaatatcgccattgagcggcagaagaggggactgtctacagcacctgaagacgagaagggcaacgtgccatcctttgtccttagccccaacgatctcgtatatctgcctacttcggaagacatagtgaatggtcacatcacccagcccattgataaatcacgcatctacaagatggtttctagttccgggagccagtgtttctttattaaacataacatcgccaatataatcgtggacaagtatgagttctctccattgaacaaaatggaaagagctattagcaatgagatgatcaaggagatttgcatccctgtcaaggtggacaggctgggcaacatagtaaaattaggaaagtccgaatga

SEQ ID NO: 3442 - RNA, 4584 nt, synthetic construct
  misc_feature 1..4584: note = Cas9 variant
  source 1..4584: mol_type = other RNA
atggccaagatcctgggcctcgaccttgggaccaacagcattggatgggctatagtggagaaagatggtaatgacttctccctggtcgataagggcgttagaatcttttctgaaggggtgaaatcagagaagggaattgaaagtagcagggcagccgagcggacaggctaccgctccgcgcgaaaaatcaagtatcgtagaaagttgaggaaatacgaaactttaaaggtactgtctctaaacggtatgtgccccctctcgattgaggaggtggaagagtggaaaaagtcagggttcaaagaatatcctctgaatccagagtttcttgagtggctgcggacgagcgacgatgaaaacatcaatccgtacttctttcgcgacaaggctagtaagcagaaagtcaccttgttcgaggtgggcagagccttttatcacatagcacaaaggcggggattcctctccaaccgcctggatcagtctgccgaaggcatcctggaggaacattgtcccaagattgaggctctcgttgaggacttaaatagcacagatgaaatcctgacttcccttaaagactactttttcgataccgggattttggacgcaaacgagaagggaggttttgccaaagatctggacgaaggcgacaagaaactcgtgtcactctatcgaagtatccaggctatagtcaagaagaatgatacagacttcgagaaagggaaggccgaaattatcgagagactgaacaaaaaggatgtgcttggaaaagtaaagggcaagattaaagacatcagccaggcgatgctggagggtaattttaagaccttggggcaatacttcttctctctctacaacaaagaaaggatccggaatcagtatacttcccgtgaggatcactacctggaagagtttaagattatatgcaaattccagggaatcggctcaattaaccagaatgaaaagttacctgagaagaaatttgagggcctggcaaaggaactctataaagccatcttctttcaacgcccacttaagagccagaaagggctgataggaaagtgtagtttcgagaagtctaaatccagatgcgctattagccatcccgactttgaagagaagaggatgtgggagtacttgaacacaatcaaaatcggtacccagtcggaaaaggttctacggttcctgtctcaggaggaaaaactcaacctgattcctaagtttcttcgaaagaaggataatttcaactttgaggacctggccaaggaattgatcgagaaaggcgcaacgttcgggttttataagtcctcaaaacgcgatagtttccactactggttcaattataagccaactgacaccgtgagcggatgtcccgtctccgcttctctcaaaagcgtggtgggcgaggattggaagacaaagtcatttatttacaaaactaccaacagtaagggtatagaagtctccagaacagttaattacaaagacctgtggcatttactgagcgtgtctacctcagacatctatctatacgagtatgccaagaacaaactcgggctggaagataagaatgcgaaggccttcagtaaaattaaacttaaaaaggactttggcaacttgagcctgaatgcaatcaacaaaatcctcccttacatgagggagggactgctttattcccacgctgtattcatggccaatattgaatctatagtggatgaggtcatctggaacgacctgggccaacggaagtacattcaggataagatcgctgccattatcgcaaataacatagtggacaatgggttgctcgaggttgtgaacggactgatcaaagaatgcaaggtcgatggtgcctattactcgaaagaggctgcggacacgtaccgcaaggatttaagcaaaaagctggtgtcctttttcaaatttcaccatattgacgatggcatcaagcaggaaactattctaaacgagctattcccagtatttatcgaacaactgaaggcacacgagttcataaaagttaagagacttgacgagaaagtgttggaatttctgaagggggagaatcaggatggagaagtcttctgtaacaatgccaaacagctcaagaagctgtatcatccgtcagacattgaggtgtttaaaaagcagatcgtcaaagacaaggatggcacagagaccggtcaattaattctggggagtccccttacttctagcatcaaaaaccctatggctatgagggccttgcaccagctccgtaaggtgctgaatacactaatagttgaagaacaggtggactcctcaacccggatccacattgagatggcacgagagctgaacgatgccaataagagaaaaggcatccaggactaccaaaacgaaaataagaaagagagggagaagtatcgcgatgaaattaaaaagctctacctggctgagtgcaacaaggaaatcgagccaacggtagacgatcttttgcggtatcagctgtggatagaacaggacagaaaagagatttacgagaatggaaacagcatctctatctgtgatattatcggcgacaatcccgcctatgatattgaacataccgtccctaggtccataagtcaggacaacagccaaatgaataagacattatgctctcagaaattcaaccgcgatgtgaagaaacagaagatgccattcgagctcgggaaccacctggaaatccttccccgaattgcacattggaaggaggaagcggacaatctgtcccgggagatcgagatgattatccgttcaactaaaaccgctgccacaaaggaagcaaaagacaagaaaataagaaggcgccactacttgactctccggagagattacctgcagggaaagtatgacaggtttatctggaccgagccgaaagttggtttcaagaacagtcaaattcctgatacaggcatcattacccgatacgcccaggcttatctaaagagctactttaatcgcgtggaatcggtcaaagggggaatggtggccgagttccggaagatctggggcatacaggagtcctatcaagaaaacggtaaaaagtactttaaagagaaggacagatctaagcatactcaccacacgattgatgcaatcacaatcgcttgtatgaccaaagacaagtatgatgtactggcccatgcgtggactctcgaagacaaagagcagattaccgaagccaggaagatagtggctgagagcaaaccctggaagacattcaaggaggatctgaaaaagatcgaagaggggattcttgtttcacactacaccccagacaatgtcaaaaagcagagtaaaaagatcgtgcgtgtgcgcggccggaagcagtacgtcgcagaaattgagagagatgttaacggaaaagccgtggctaagaaagacatctccggcaaggtgatatataaattggacaaggatgggaaaaagctgcctaggttacaacagggagacactatccgaggctctctccatcaggatagcatttacggtgccatcaagaatcccctgaaaacagaagagattcggtatgtaatccgcaaggaccttgagtccataaaagcatcagatgtcgacaacattgtggatgaaatggttaaggagaaagtgaaggaagcgatcgccagcaaggtcctgatcctaagttctaatccacagcagaaaaacaagattgacgggaaagtgtggatgaatgaggaaaagggaatccccataaacaaagttagactctacgctaattccgtgaagaaccctctggagattaaggagcacagctcgttgtcaaaatctaggcacgaacataagcaaaaagtatatggccagaatgatgagaactttgccatggcaatctacgaaggtctggacaagaaaggcaagacggagcgggctttcgagttaattaactatatggatgccgggtactactataagctcaaaaataagaacgaacgaaagaaggacatcataagtctggtcccagagaaacacattgaaaccggatttaatcttctgagatccaacaagatcccgatcattttgaaaaagggcctcaatgtgatcctgtacaagaacgagaaagaagagattgatttcaataaccccaatagcataatcaagcgcctatataaaatttctgggctggacaaggacggaatcaaacttatgtactgcatcagcgcaaagggctccactgagaacattgcctatatgaatgatgtgataaacaagcagaaactctttgaactgaagtcagagatggaaaaattgggtctgtgggacaaggtcttcagtgatttcaaaaatgacaacttaaagaaaagcgactttttcaaaaagctcaatgatctgcttaacaaacattactttgagaataacgtttgcgattctatcgggtccattaagaaagtgaagatcaaggaatcaggactgacaacccctaaaggcggtgacgtaattgataacttcaaggactttccatatatcaaattcaaggtgagtaattttaacgctttgatagagggcatcgatttcaaaattagccccacagggaagtttgtccaaatctga

SEQ ID NO: 3443 - RNA, 4587 nt, synthetic construct
  misc_feature 1..4587: note = Cas9 variant
  source 1..4587: mol_type = other RNA
atgaagaaaatcctgggcctcgaccttgggaccaacagcattggatgggccctggtggagcaggatttcaagaataaacaaggtaacataatgggcatggggtccagagtcatccccatgtctcaggaaattttgggagagtttgctaggggcaatacaaagtcagaaactgcagagcggacgcgcttacgaagtgttcgtagactgagggaacggcacctactccgcagagagaggctgcatcgggtgcttcacatcctgggtttcttgcctaaacattacgtaaaccagattgactttcaggagcgcctcgggaagttctttgaagagagcgaaccaaagctggcctatgataccggagacttcctgtttaaaccgtccttcctcgagatgttagaggaatttaagatccaccaaccctctttcgtggagggcgataaaaaggtcccttacgactggacaatatattttctgcggaaaaaggcgcttactgaaagaatcgagaaggaagagttggcttgggtgattctgtcgttcaatcagaaaaggggctactatcagctacgaggggaggatgaagaggaaaagccaaacaaactcgaggaattttactcactgaagatcgttgacattaaagtggatgagagccccaataagaaaggagacacctggtatagtcttacactggagaacggttggatctaccgtcgctcctctaaggtccctttggatgactggctcggcaagaccagagatttcatagtgactacagacattgacgaagaggggaatccaaaactggataaggaaggaaaccccaaaaggagcttccgggccccttccgaggacgattggggcttacgaaagaaaaagaccgaaaaggagatcctggactcaagtaaaacggtaggtcattttattttcgagaatctccttgcagatccaactcagaagatcaaagggcgcctggttagaaccatcgaaaggaagttttacaaagacgagttgaagcaaattctagtgagccagaaccggttccacccggaactgtctgatgccgacatgatggctgattgcgtccgcgagctctataagcacaatcattcccaccagaactttctggcatcaaaagacataaagcatcttctggtggatgacatcattttctaccagagacccttgaggagccaaaaatcaacaatcggaaattgtcctctcgagtttaagactttcaaaaaggacggcatagaaattaaggtgccatataaagtcgcccccaagtctcaccctctgtttcaggagttccgtttactgcagtgggtttccagcctacggatcatccgaaaatcggatgactctgatgtgaccagagaatttctcggcacacaagacaagaccaaacagctgcttgattacttgatgacgcagtccgagatggactgcaacaagctgatgactttcctcctgacacaggaagggtataaaaggaaggatcttaagtcagaggtaggaaaatttcgctggaactacgtgttcgacagtgagaccggtgaaagcaagacttatccaggcaattccacacgggctgagttcctgaaaagattggggaaggtcgaaggatttgatttctctaaatacaccgaggaatttgaggagagcctctggcacctggtgtactcagttacggacaaggtggaatttgagaaggccttaaggaaatttagtcgcaagaacggcattgaaatcaattccttcgtcgagaacctgaaaaagtttcccccgtataaaagcgaatacgcgtcttattcactaaaggcaattaagaaactcctggcccttatgcgattcggtgagaattggaaggaggatagtatagacagcatctccaaacatcggattgaaaagatcttgaccggggagtacgatcctgaaatcaaagacaaggtgcgtgagatttctagagcttttgacgaggtagaagatttccaaggcctgcccgtttggtttgccaactatgtggtctacggaaggcactcggaggcaagcgaactcataaagtggacatcctcagacgagatggctgatttcatcaaagaatttaagcagcatagtctgcgcaatccaattgtggagcaggtcgtgttagagactctgcgggttgtgaaagacatctgggataagtatggccacgggcagaaagacttcttcgatgaaattcatgtagagcttggaagagaattgaagaaccctgccgagcaaagggcgcgactcaccacacagatctctgccaatgaaaacactaatctgcgcataaaaagcctactggtcgagctcctgcacgaccccggtgtggagaacgttcggccatactcccccatgcagcaggaaatccttaagatttacgaggaaggcgtgttgaagagtagctttgaggtccctgatgacatcctgaaaatttctaagaccgcacaaccatccagtagcgatttaaaaagatataagctctggctggaacagaaatacaggtctccgtatacagggaagatcataccccttaataagctgttcacccctgcttacgaggtggagcacgtaattccacagtcccgttattttgacgattcattcagtaacaaagtgatctgtgaagccgctgttaataagttgaaagacaaccgcctcggaatggagtttattaagtgcttccatggccagcgggtcagcctgggttttggggaagaggtggagatcttctcggaatccgcctacaaagcatttatacaagacaacttccccaagaatcctgccaagaaaagaaagctactgatggatgagctcccagaacagatggtggagaggcagatgaacgacactcgatatatctctaaatttgtcacgagcattctgtcaaatatcgttcggagtgaagagaacgatacaggcttcaattccaagaacattatccccggaaatggcaaaataaccactgctcttaagcaagactgggggttgaacgatgtgtggaatgagctgattttaccgcgcttcgaaagaatgaaccagctcaccggaacaaccgtgtttactgcgtggaatgagaaccaccagaagttcctgcctacagtaccacttgaatacgcaaaaggttttcagaagaaaaggatcgaccatcggcaccacgccatggatgctctggtcatcgcctgtgcaacgcgagaccatgtgaattacctaaacaatgagcacgccctcggcaagaactataaagggaaggaagagaagcaatctagacgcttcgatctgaggcagaaattgtgcctgaagaaaaagaacggacatagccaggagcagtacgaatggattttctccaaaccctgggactcattcacccaagatgctaagaaaaatttagagcgtatcattgttagctttaagcagaacctccgggtgataaataagacaagtaacaaatatctgtcttacaaggacgaagagggcaatcttagactggactcccagggtaaacctgtcaaggccttgacaaggcagatcaaaggggatgcatgggcgattcgcaagagcatccacaaggacaccgtgtcgggcctcgttaaactgcgaagagtgaagatggtaaacctatcagtcgctctggataatcccgaaaacattcttaataaaaagctcaaaaagaagatcgccgagctggtgaaattgaactatgacaataagctgttactcaaatacttccgggatagggactatatgtttgatggacgcgaggtgtctaagctggacgtctactacttcgaagagggccttgcagccagtcgtgtttccctggatactagcttttctgacaaaaagatacaaagcatcactgataccgggattagaaagatcttgctcgctcatctggccaactatcacggacggctagacgaaaaaggcaaggtgattccacctgagacgctggcattcacccccgagggtatcgaggagcttaataaaaacataaaggggctcaatggaggcaaatttcaccagccaattttcaaggtaaggacatacgaaccgaaaggtaacaagttccaggtgggctttaaggggaacaaaaattccaagtatgtcgaggctgccaaaggaactaacctgttctttgcgatctacttgaatgatgaaggcaagcgctcatatgagaccatccctttcaacgtggttatggagcgattaaaacaaggggaaggacccgtgccacagacaaatgagaagggcggtaagctgctctttcatctgagtcccaacgaacttgtctacgtgcctgagactgacgaaaattataccaacgttgacttcaaaaatctgagcaaggaacaggtggagaaaatttacaagatggtctcttccacggggtcagaatgtcactttgtaagagccgatataagtagcttgatcaaaggatacgacgctaagacaaaggtgggcgagctaggttccctgaacaaacaggaagttaccaataacggcatgactcggattaaggagaaatgctggaagatcaaaattgataggctcgggtctatctga

SEQ ID NO: 3444 - RNA, 4587 nt, synthetic construct
  misc_feature 1..4587: note = Cas9 variant
  source 1..4587: mol_type = other RNA
atgaagaaaatcctgggcattgacctcgggaccaacagcataggatgggccgtggtcaattccttcgatgagaaccagaatgaagagtctcttaagcacatcgaatgcgttggttcaagaattatccccatggacgctgcaattctgggcgattttgacaaagggaacagtatcagccaaacagccaagaggactgagttccggtccgtgcgccatttgcgagaacgtcacttactgagaagggcgcggctacataaaatactctctctgcttggatttctgcctgatcactacgtacaggacttggattcgcatggcaatttcccagtgaacgtcgagccgaagatcgcttggcgcaaggactcaaatggtgcctttgagttcatttttaacgatagcttcgacgaaatgctccaggattttgcaacgtatcagcccgagctgatcgcctgtaataaaaaggtgccttacgactggaccatttattacctgagaaagaaggctctcactaaaaagttaagtaaggaggagctgtcctggatccttttgaacttcaatcagaaaagggggtattaccaactgcggggagaggaagatgacgagtctgttaagagcgcaaaaacacgccagtattttgaccgacagaagataaaatccattgtggataccaaccaaacatacaagggccagaaagtcctaatcgtggaactcgaggacggcattaaggggaagatcttcaaaaaggaaatcccaaattgggtaggacaggagaaatcaattatagttaccatcgatattgacaaggatggttgcgacaaatacgaggaaagtggcgagctgagctgtagatttaagatcccctctgatgccgaatgggagtccgaatggaaacttataaaaatgaagactcagaaagacctggatgcttcagggaagacagtgggagcctatatttacgacgcgatcttgcaaaaccctagccagaaaatcaggggcaagctcgtccggaccattgagcgtaagtattacaaagaggaactgaagcagatcctgaaaaagcaagtggagttccacccagaattacgcgataaagacctcttccttgactgcctgaatgagttgtatcccaacaacgatgcacacagaaatgcctgtgctgacagggattttatttacctattcatggacgatatactgttttatcagcggcctctcaagagtaagaaatctctgatcgccgactgcccatacgaaaagcatatgtaccgagataaagagacgggtgagcttaagtattccagcgtgaaatgtattgcaaagtcgcacccgctgttccaggaatttcgcttgtggcatttcatctctaacatcagaatttaccagaaagagagggtcgttgacgtggatgctgaccaatccgccctctcaagtgcgcggagcgccctgaagtccaagttagaagcagatgtagacgtgactaatgagtttctgacctgcgaggctgattatgtctctctattcgaatggctcaacaataaaaagagcgtgtcacagaaagactttctgaagtaccccgccttcgggatcaaaaagagtggagacaactatcgctggaattacgttgaggataagtcctatccttgtaacgaaacaagagctcttatattgagccacctggagaaagccaatattaggggcgacatctttactcgtgaacaggaggaggcactctggcacattctgtactctgtggaagatcggtacgagatcgtcaaggcccttcagtcattcgctgcgaaatatcgatttaacgacgatttcgtgaccgtattcagtaagtttccacccttcaaaaaggaatacggcagctattccgcaaaggccatcaaaaagctgttgcctctcatgagaatggggaaatactggtctgaggctgccatagacattaagacaagggaacgcatcgagaaaattatcaccggagagtgcgatgactcgatacgggaaagagttaggctgaaggcaattcgcttacatgatatcggtgactttcgagccctgccagtgtggctagcttgttatgtcgtgtacgatcggcacagcgagtccggcgacattacgaagtggaaaactccccaagaaatggattggtatatccagaatttcaagcagcattcactccgtaacccgatagtcgaacaggtgatcacagaaaccctgagagttgtgagggacatttggaaacaagtagggcgcatcgacgagattcacgtcgagcttggacgggaaatgaagaatcctgccgataaaagagcaaagatgactgcgaggatgatcgagaacgaaaatacaaacttgcgaataaaagctatgctgaccgagtttctcaaccccgagttcgaaattgagaatgtgcgcccatacagtgcctctcagcaggacatcctgcggatctacgaaaacggcgttttaaatagcgtgtccgagattcctgaagagatcacgggtattctgaagaagtttaacgagagagaacagaggaaacgtccctcaaccagcgaggtccttcgctataagttgtggctcgaacaaaaataccggtctccatatacagggaagatgatacccctgggcaaactattcactcctgcatacgagatcgaacatattatcccacagtccagatattttgatgacagtttcaataacaaggtgatttgcgaggccgaggtaaataagctgaaaggaaacctcctgggctacgaatttatcaagaaacaccacgggaggcgagtggatcttggattgggtgagatagttgacatcttcagcgtcgatgaatatgagacctttgtgaaggactactactctgctaatcagcagaaaatgaagaagctgttaatggatgaaattccggagcaattcatcgagcggcagctcaacgactcccgctatatttcaaaagtggtcaagagtctgcttagcaatatcgttagagaacaggatgagcaagaatcgatatccaaaaacctgattgtgtgcacaggcggggtgactgacaggttgaagaaagactggggaatcaatgatgtatggaacaagctcatcctgccccggttccagcgactaaataacattaccgagacaaccgagtttactgccaagaacatgcagggccatgaaatacctgtcgtgccattcgagtaccagagaggttttaataaaaagcgcatcgaccacaggcatcacgcaatggatgctattgttatcgcctgtgcggggcgtaacattgtgaattatctgaacaatgaatctgcccggaaaaaggctcaaatcagcagatacgacctccagaggctgctttgcgataaagtcaagacggacgataacggcaattataagtggatattgaaaaagccctggtcaacactgacccaggacgtgtacgcagccttagataacgttatcgtgagtttcaaacagaatctccgcgtaattaacaagactaataaccactatgtccattacgaggctggcaaaaagatcattgccaaacaagaaaaggcatcctgggcgatccgaaagcctatgcacaaagacaccgtgtttggagaggtgaatctgagaaaggtcaaaacagtttctcttaacgaggccataaagagcccacattgtattgtgcagaaagatttcaagaagaaactgctatccctcctgaagcagaattttgacgctaaagaagtaaaggcctacttcgaggaacacaaagatgtgtggtcagacatcaacttgagcaagatcgaggtctattactttaccaaggacactaaagaacggttctttgcaacaaggaagcccctggatagttctttcgaccgcaaaaagattgagtccgtgacggataccgggatccagaaaatattactccgtcatctggagcaaaagaacggagacagcgatcttgctttctcgccggacggtattgaagagatgaatcagaacatcgttcagctgaatggcgggagaaagcaccaacctattgtgaaagtccgggtgtatgaaaaggccgataaatttgcaatcggacagcagggcaacaaggcctcaaaatacgttgaggctgcgaagggtactaatttgttctttgccgtgtatgaagaggaggtcagggacaaaaagacaaacgcagtaatgttcaagcgcaattacgcttctataccactcaacgtggccattgatcgacagaaaaaggggctgagtaccgcccccgaagacgagaatggcaacgctcctatctttgttctatcccccaatgatctggtgtatcttccaacagcagaagacatcattaacgccagaatcagcttccctattaataaaaaccggatatacaagatggtctcttgcactggataccaatgctttttcatcaaacaccatgtggcgaatgtaattgtggataagaaggagtttagcgctctcaacaaaatggagaaggccgaaaccaatgagatgatcaaagacatctgtgtccccattaagctggacaggttgggcaacatagttaaaatcggggtgtataagtga

SEQ ID NO: 3445 - RNA, 4587 nt, synthetic construct
  misc_feature 1..4587: note = Cas9 variant
  source 1..4587: mol_type = other RNA
atgaagaaaatcctgggcctcgaccttgggaccaacagcattggatgggccgtggtcaattccttcgatgagaaccagaatgaagagtctctgaagcacatagaatgcgttggttcaagaatcattcccatggacgctgcaatcttgggcgattttgacaaagggaacagtattagccaaacagccaagaggactgagttccggtccgtgcgccatttacgagaacgtcatctgctaagaagggcgcggctccacaaaatcctgtctcttctgggatttttgcctgatcactacgtacaggacctcgattcgcatggcaatttcccagtgaacgtcgagccgaagatagcttggcgcaaggactcaaatggtgcctttgagttcatctttaacgatagcttcgacgaaatgctgcaggattttgcaacgtatcagcccgagctgattgcctgtaataaaaaggtgccttacgactggaccatctattacctcaggaaaaaggctttaactaaaaagctgagtaaggaggagctttcctggattttgctgaacttcaatcagaaaagagggtattaccaactacggggagaggaagatgacgagtctgttaagagcgcaaaaacacgccagtattttgaccgacagaagatcaaatccatagtggataccaaccaaacatacaagggccagaaagtcctcattgtggaactggaggacggcatcaaggggaagattttcaaaaaggaaatcccaaattgggtaggacaggagaaatcaatcattgttaccatagatatcgacaaggatggttgcgacaaatacgaggaaagtggcgagcttagctgtagatttaagattccctctgatgccgaatgggagtccgaatggaagctgatcaaaatgaagactcagaaagacttggatgcttcagggaagacagtgggagcctatatatacgacgcgattctccaaaaccctagccagaaaatcaggggcaagctggtccggaccatcgagcgtaagtattacaaagaggaattaaagcagattctgaaaaagcaagtggagttccacccagaactccgcgataaagaccttttcctggactgcttgaatgagctatatcccaacaacgatgcacacagaaatgcctgtgctgacagggattttatctacctgttcatggacgatattctcttttatcagcggcctctgaagagtaagaaatctcttatagccgactgcccatacgaaaagcatatgtaccgagataaagagacgggtgagctgaagtattccagcgtgaaatgtatcgcaaagtcgcacccgttgttccaggaatttcgcctctggcatttcatttctaacatcagaatctaccagaaagagagggtcgttgacgtggatgcttgccaacccgacctgtcctcagcccggagtgcgttaaagagcaagctggaagccgatgtagacgtgactaatgagtttctaacctgtgaggcagattatgtctccctcttcgaatggctgaacaataaaaagtctgtgagccagaaagactttcttaagtaccctgctttcgggattaaaaagtcaggagacaactatcgctggaattacgttgaggataagagttatccatgcaacgaaacaagagccttgatactgtcccacctcgagaaagctaatatcaggggcgacatttttactcgtgaacaggaggaggccctgtggcacatcctttacagcgtggaagatcggtacgagattgtcaaggcactgcagtctttcgccgctaaatatcgatttaacgacgatttcgtgaccgtattctcaaagtttccccctttcaaaaaggaatacggcagttatagcgcgaaggcaatcaaaaagttgctcccactgatgagaatggggaaatactggtccgaggccgctatagacatcaagacaagggaacgcattgagaaaatcattaccggagagtgtgatgactctatccgggaaagagttaggttaaaggccatacgcctgcatgatattggtgactttcgagcactacccgtgtggctcgcctgctatgtcgtgtacgatcggcactcggagagcggcgacatcacgaagtggaaaactccgcaagaaatggattggtatattcagaatttcaagcagcattccctgcgtaaccctatcgtcgaacaggtgataacagaaacccttagagttgtgagggacatctggaaacaagtagggcgcattgacgagatccacgtcgagttgggacgggaaatgaagaatcccgctgataaaagagccaagatgactgcaaggatgattgagaacgaaaatacaaacctgcgaatcaaagcgatgctcaccgagtttctgaacccagagttcaagatagaaaatgtgcgcccttactcagctagtcagcaggacattttacggatctacgagaacggcgttcttaattctgtgagcgaaatccccgaggaaattacgggtatcctgaagaaatttaacgagagagagcagaggaagcgtccatccacctcagaagtcttgcgctataaactctggctggagcaaaagtaccggagcccctatacagggaaaatgattcctctaggcaagctgttcactccagcctacgaaatagagcatatcattccgcagtctagatattttgatgactccttcaataacaaggtgatctgcgaagcagaggtaaataaactcaagggaaacctgcttggctacgagtttattaaaaagcaccacgggaggcgagtggatttgggactgggtgaaatcgttgacatattcagtgtcgatgagtatgaaacctttgtgaaagactactacagcgccaatcagcaaaagatgaagaaattactcatggatgagatccccgaacagttcattgagcggcagctgaacgactctcgctatatctccaaggtggtcaaatcacttctgagtaatattgttagagagcaggatgaacaagagagcatctcgaagaacttgatagtgtgtacaggcggggtgactgacaggctcaaaaaggactggggaattaatgatgtatggaacaagctgatcctacctcggttccagcgactgaataacatcaccgaaacaaccgagtttactgctaaaaacatgcagggccatgagattccagtcgtgcccttcgaataccagagaggttttaataagaaacgcatagaccacaggcatcacgccatggatgcaatcgttattgcttgcgccgggcgtaacatcgtgaattatctcaacaatgagtccgcgcggaagaaagcccaaatttctagatacgacctgcagaggcttttgtgtgataaggtcaagacggacgataacggcaattataaatggatcctgaagaaaccttggagcacattaacccaggacgtgtacgctgcactcgataacgttatagtgtcattcaagcagaatctgcgcgtaatcaacaaaactaataaccactatgtccattacgaagccggaaagaaaattatcgctaagcaagagaaggccagttgggcaattcgaaaaccaatgcacaaggacaccgtgtttggcgaagtgaatcttagaaaagtcaagacagtttccctgaacgaggcgatcaaatctccccattgcatagtgcagaaggatttcaagaaaaagctactcagcctgttgaaacagaattttgacgccaaggaggtaaaggcttacttcgaggaacacaaagatgtgtggtccgacattaacctgtcaaagatcgaagtctattactttaccaaagacactaaggagcggttctttgccacaaggaaaccgttagatagcagtttcgaccgcaagaaaatcgaatctgtgacggataccgggattcaaaagatcctcctgcgtcatcttgagcagaagaacggagactccgatctggcattcagccctgacggtatagaggaaatgaatcagaacattgttcagttgaatggcgggagaaaacaccaaccaatcgtgaaggtccgggtgtatgagaaagctgataagtttgccattggacagcagggcaacaaagcatcgaagtacgttgaagccgctaaaggtactaatctcttctttgcggtgtatgaggaagaggtcagggacaagaagacaaacgccgtaatgttcaaacgcaattacgcatcaatccccctgaacgtggctatagatcgacagaagaaagggctatctaccgcccctgaggacgaaaatggcaacgcccccatttttgttctgagtccaaatgatcttgtgtatctccctacagctgaggacatcatcaacgcaagaatttccttccccatcaataagaaccggatttacaaaatggtcagctgtactggataccaatgctttttcataaagcaccatgtggccaatgtaatcgtggataagaaagaattttctgcgctgaacaagatggagaaagctgagaccaatgaaatgattaaggacatctgtgtcccaatcaaattggacaggctgggcaacattgttaagataggggtgtataagtga

SEQ ID NO: 3446 - RNA, 4590 nt, synthetic construct
  misc_feature 1..4590: note = Cas9 variant
  source 1..4590: mol_type = other RNA
atgaagaaaatcctgggcctcgaccttgggaccaacagcattggatgggccgtggtcaattccttcgatgagaaccagaatgaagagtctctgaagcacatagaatgcttgggttcaagaatcattcccatggacgctgcaatcttaggcgattttgacaaagggaacagtattagccaaacagccaagaggactgagttccggggagttcgccatctgcgagaacgtcacctactcagaagggcgcggctgcataaaatccttcgcctgttgggctttctccctgatcactacgtgcaggacctggatggtcatgggaatttcctggtaaacgtggagccaaagatagcttggagaaaggactccaatggaacgtttgagttcatctttaacgattctttcgacgaaatgctccaggattttgccacctatcagccggagttaattgcatgtaataggaaagtcccctacgactggacaatctattacctgcggaagaaagcccttactaagaaattgtcgaaggaggaactgtcatggattctactcaacttcaatcaaaagcgcggctattaccagctgcgaggcgaggaagatgacgagagcgtgaaaaccgctaagacaagacagtattttgacaggcagaaaatcaagagtatagttgataccaaccaaacttacaaagggcagaaggtgcttattgtcgaactggaggacggagtgaaaggtaagatcttcaagaaagaaattcctaattgggtaggccaggagaagtccatcatcgttacagtggatattgacaaagatgggtgcgacaagtacgaggaatctggagagttgagctgtcggtttaaaataccatccgatgcagaatgggagtcagaatggaagctcatcaagatgaaaacccagaaggacctggatgccagtggcaaaacggtcggtgcttatatttacgacgccatcttacaaaaccccagccagaagatacgtgggaaactggtgcgcactattgagagaaagtattacaaggaggaactcaaacagatccttaagaaacaagtggagttccaccctgaactgagggataaggacttgttcctagactgcctgaatgagctctatccaaacaacgatgcgcaccggaatgcatgtgccgaccgagattttatctacctgttcatggacgatattttgttttatcagcgccccctgaaatctaagaagtccttgatcgctgactgcccttacgaaaaacatatgtacagagataaggagaccggagagctcaaatattcaagcgtcaagtgtattgccaaaagtcacccactgttccaggaatttaggttatggcatttcatatctaacatccggatttaccagaaggagcgcgttatcgacgtggatgcatgccaaccggacctgtccagcgctagatcggccctaaaatctaagctcgaagcggatgtagacgtgacaaatgagtttctgacttgtgaggccgattatgtctcccttttcgaatggttgaacaataagaaatcagtgagtcagaaggactttctgaaataccccgcattcggcatcaagaaaagcggcgacaactataggtggaattacgttgaggataagtcctatccttgcaacgaaacccgtgctctcattctgtctcaccttgagaaggccaatatacgaggggacatctttacacgggaacaggaggaggctctgtggcacattttgtacagcgtggaagatagatacgagatcgtcaaagccctccagtcattcgcagccaagtataggtttaacgacgatttcgtgaccgtattcagtaaatttccacccttcaagaaagaatacggatcctatagcgctaaggcgattaagaaactgttacctctgatgcgcatgggtaagtactggtctgagtcagcaatcgacataaaaacgcgggaaagaatcgagaagattatcactggcgagtgtgatgacagtattagggaacgcgttcgactaaaagccatccggctccatgatatagagcactttcgtgctctgccagtgtggcttgcctgctatgtcgtgtacgacagacatagcgaatccggggatattatgaagtggaagacaccccaagagatggactcttatatccagaatttcaaacagcactcgttgaggaacccgattgtcgaacaggtgatcaccgagactctgcgcgttgtgcgggatatatggaagcaagtaggaagaatcgacgagattcatgtcgaactcggcagggagatgaaaaatcctgcagacaagcgaaaagaaatgacaaagcgcatcattgagaacgagaataccaacctgcggatcaaagccatgttaacggaatttctgaaccccgagttcgaaatagagaatgtgagaccatacagcgcttcccagcaggatattcttaggatctacgaaaacggtgttcttaattcagtgagtgagatccctgaggaaattaccgggatcctcaagaagtttaacgagcgtgaacagcgcaaacggccctctacaagcgaggtcctgagatataagctatggctggaacaaaaatactgctccccatatactggcaagatgattcccctcggaaaactgttcacccctgcctacgagatagagcacgtgatcccacagtcaaggtattttgacgatagcttcaataacaaggtaatttgtgaagcagaggtgaataaacttaaaggcaacttgctggggtacgaatttatcaagaaacaccatggacagcgagttgacttaggtctcggcgagattgtcgatatcttctctgtggacgaatatgagacatttgtgaaggattactactccgggaatcaacagaaaatgaagaagctgcttatggacgagataccggaacagttcatcgagcggcagctgaacgatagtcgctatattagcaaagtcgttaagtctttgctctccaatatcgtgagagaacaagacgagcaggagtcaattagtaaaaacgtgatcgtatgcactggaggcgtcaccgataggctgaagaaagactggggtataaatgacgtgtggaacaagctaattctgccccggttccagcgactcaataacatcacagaaaccactgagtttacggcgaagaacatggaagggcacgagatccctgttgtgccattcgaataccagagaggctttaataaaaagcgcattgatcataggcaccacgctatggacgccatagtcatcgcatgtgccagccgtaacattgtgaattatctgaacaatgagtcggctcggaaaaaggccagaatctccaggtacgatcttcaaaaattgctgtgcgacaaggttcgcacagatgacaacggaaattataagtggattttaaagaagccctggggcaccctcactcaggatgtgtacgcagctctggacaacgtaatcgtctctttcaaacagaatcttcgagtgataaacaagaccaaaaattattacgtgcattacgaggccgggaagaaaacaatcgcgaagcaggaaaagggaagctcatgggccattagaaaacctatgcacaaggataccgtctttggtgaggttaacctgcggaaagtgaagactgtaagtctaaatgaagctatcaaaaacccacaatgtattgtggagaaggacttcaagaaaaagctcctgtccttgctgaaacagaattttgatgcaaagaaagtcaaggcctatttcgaggaacataaggacgtgtggtctgatatcaacttaagcaaaatagaggtttactattttacaaaggacacgaaagaaaggttctttgctacccgcaagcccctcgactcctcattcgataaaaaggagattgaaagcgtgactgacacaggcatccagaagatcctgcttcgtcacctggagcagaaaaacggggatccggacttggccttcagtcctgatggaattgaagagatgaatcataacatcgtccaactcaatggcggtagaaagcaccagccaatagtgaaagttcgggtgtacgagaaggcagacaaatttgcgattgggcagcaaggcaacaagtcttccaaatatgtcgaagccgctaagggaaccaatctgttctttgccgtatacgaggaagaggtgagggataagaaaacaaacgcagttatgctaaagcgccactatgctagcatccccctgaatgtggccattgaccgacagaaaaagggcctttcgactgcacctgaggatgaaaacgggaatgtccccatcttcgtgctctcaccaaacgacctggtatacttgcctaccgccgaggatatagctaatgcgtctattagttttcccatcaacaaaaatagaatctacaagatggtgtcctgcacgggaaaccggtgtttctttattaagcatcacgtcgccaatgttatcgtggacaaaagcgagttctctgtgctgaacaagattgaaaaagcagaaaccgatgagatgataaaggagatctgcgtcccaattaaaatcgacaggttaggcaatatcgtgaagattggtgtttataagtga

SEQ ID NO: 3447 - RNA, 4608 nt, synthetic construct
  misc_feature 1..4608: note = Cas9 variant
  source 1..4608: mol_type = other RNA
atgaacaccatcctgggcctcgaccttgggacaaatagcattggatgggccctgataaaggtgttgaacgataaaactagattacccctggagatcattgacctaggtgtcgttgtgatccctacggatcagaggaccctcgacaagttctccaaaggcgaatctatttcaaagacagctgagcggactaaacaaaagggggtacgcaagctgtacgaacgaaagaaacttcgtagagagaggctgcaccgggtgttgaatatcctcggatttctgccagaacattatagtaaaaagatagatttcaaaaagcacctgggccagtttttcggtaacagccagccgaagatctcctacgtcgagaatgaccatgggaaacacgagtttattttcatggattcttatcgcgaaatgctcaaggagttttcgaaacataacatcaagaatgtgccctacgactggaccatttattacttaagaaagaaggcactgtcacagaaaatcagcaaggaggaacttgcctgggttatattgaacttcaataagaaaaggggatattaccaatttcgggatgacaacgcggatgagaataaggaaaacaaaattgagaagtactatgctctgaaagtgacaaatgtcaagaaggaagacgcccagaactacaccatcactctagagaatggctggatttataaaaacaagagtaaaatctccctcctggattgggtgggctctacaaaggagttcatcagcaccgaaaaatttgacaacaaggggaatattataaagaaaaagaacggagaggacgatcgcacgcttaaactggtagactccgaaaaggattggatcgcaattaaaaagtcaactgaggaccgaatcgaaaattacggtaagaccgttggcacatatttgtacgagcacctcctgaaagatcctaaccagaagttaaatggggaactgataaacattatcgacagaaaattctataagaatgagctcaaacagatccttgagaagcaaaaagaatttcacccagagctgttgaacgaagatctattccagaagagtattatcgagctgtaccccaagaatagcactaggcagaaagaactcaagaacaaagacctgtgctaccttctgattgatgacgtgatatattaccagcgggatttgaagaaaaagaactctaccatcaataagtgttccttcgagtcacgtgagtattacctcaatggagaaaaacaaattcagaagatcaactgcatcgccaaaagcaagcctctgtatcaggagtttcgcacattacaattcattaaaaatctgaaggtctacgaaataatcgacggcctagagaaggacattaccagtaaactcctgccagattttgagacgaaggaacatttctttgagtggcttaacgacaaagaaaagatcgatcagttgcagctgctctcttataaatgtttcgacctgcacgataacgtgaagaatgaccttattgctaagggtatcaaaagacccactgagaaggcaataaggacagaactgttggagaaataccggtggaactactccaaggataatgaccgaaactttctcctgaatgagacccgcttcaaaatcttaaagtatctgaaaaaggtggataagaaactaactctcacaaacgaacagattgagagcctgtggcttttgctgtactcggccaaggacgaaagagagctcaaaaatgggctgcaaaagttttctgaaaagaacaagttacctaagaaattctccgatatctttatttcattcccaccgtttaagaaagagtatggagcttacagtgagaaggccctgaaaaagttgcttagcctcgtcaggttcggcaagtattggtccttcaataaaatcgacaacaatatacagaacaagattatgaatatcctgaacggcgaagttgatgactctattagcgaccgggtgcgcgagaaaaccatcctactgcaggataagaatgactttcaggatctccccctgtggcttgcgtcatacgtagcatataacagattcagtgaagtgtccgagataaaatactgggacagccctgataagatcgaatttttgaagcaacattctattgggaacccaatcgtcgagaaaattatcaatgagacgctgaagttaataaaagacatttgggtgatccacggaaagtcatgcaaaaacttctttagtgaaatccacattgagctcagcagggaaatcaagtcctcttcgaagaaacgtgcccagattaccaataacaatacaaagaaccagaaactgaataaccttataaagagcctgttgatcgagatggcttccgatactaaatacgagaatgttaccccctattcacctagtcagcaagaaattctcaagatctacgacgagggtatttattctaaagaagagaacagcgaaaagatcaaggagataaataaaatccggaacaataacaagatttccaaatcagatatcacaaagtacaaactgtggctagagcagggctatattagcccatacactgggaagatcatacccctgaccaaactcttcacagccaaatatcagaaggaacatattatcccgcagaccaaatttttcgacgattcttttaataacaaggtgatctgtgaggcagaagtcaacaaactgaaggacaattcccttgctatgaacttcattaaggccaaaggaggcaaggcggtgaaattgagtgatggtgagactgtaacgatactgaatcaagaagagtacaagcagttagttcgaaccagctttaaaaagaactctatcaagctcagaaatctgcttctggaggaaattcctgacacattcactaaaaggcagctaaacgacaccaagtacatctccaaactcgtgctgtcattgctgagtaatattgtccgcgagaagggggaattagagagcacagccaaacggatcgtgtcgaccaacggccaaataacttccatcctcagaaatgattggggactgaacaatatttggaacaaacttatcacacccaggtttgaacgcctgaataacattaataaaaacaagatctatggcaattgggagaacaagaaagggaagaacgtcttccagataaattacttgaacgacaatctctctacgctgaacaccaaacgaattgatcaccggcatcacgcactagacgctctgatcgtggcctgcactacacgtaatcatatcaacttccttaataaccagtatgctaagagcagaaatcagaggcacgatctccgcgccaaactgaagcggagagagaccattacaactgaaggatcaaagaaacaagtttttaaggacttcatcaaaccatgggagagttttacccaggatgcattgaagaaactggaaacgaccatagtgaacttcaaggtaaataagaggattatcaacaaaacaattaattggtacaagaaatgggagaagcagaaagacggtacttataagaagatccagaaaaagcaaaccaaaggcgatgcctgggctatacgaaagcctttacacattgacacaatctacgggatcgtctgtaaaaagctccccctgaaatccgcgcttgagaactataagaatattatcgatgaaaacctgaagcataaaattaaggagttgaaagaagtgaacaagtttgacaataaccagataatcaatttctttaaagagtgcaacttcatttttgaagacaataacatccagaaggttgaggtgtacgatttcaaggacaatcgcgataaaactatcctctctagctcccggcagctgattgacgagtcatttaccccaaagaaaataggaaaggtcctagatcccacgatcagaaacattctgcttaaacacctcaatagcacaaagtacaacaataagttcgacagtgatggcaaccctatcaaaccagaaaagctggcattctctccggagggtttgaaagacttaaataagaacattaaacatctgaataacaacaaggaacaccaacccatcaagagggtgaaactctttgagaccctggggaataagataaaagtaggctatactcagcagaagaacaaaaagttcgccgaaacagctaccggaactaatctttttctgggcatctactccgataacaataagcgtgacttcaaaaccattcctttgatcctagccattcaacgcgagaaggaggggctgaacccatgtcccgatacagacgaaaaaggaaatcagctcctgtttagcctttcgcctaacgagttagtgttcgttccaaataacgaggaacggaagaatcccaacctggtcgattttgaaaatctctcaaaagaccagatcgacagaatatataagttcgtgtcttgcacgggtagtgaggcatactttgtgccgtccaggaccgccaaacctattatcgagaacgaaaatggcactaacaacaagagccagcgaattatcgagttcaatgaaaagacatctatcaaaaacgagaagaatgagccagtcttgataaaaaccatttgttggaagatcgaagttaaccggctggggaaaattatcaaggtgataaagtga

SEQ ID NO: 3448 - RNA, 4608 nt, synthetic construct
  misc_feature 1..4608: note = Cas9 variant
  source 1..4608: mol_type = other RNA
atgaccaagatcctgggcctcgaccttgggacaaacagcattggatgggccataagagatactgagaatgaaggtatcaaccagattctggacaaaggcgctaggatcttctccgagggggtgaagtctgaaaatggaaaagagatttcacgggcagccgaacgcacggcgtaccgaagtgctcgtaagatcaaatatagaaggaagttgcggaagtacgagaccttaaaagtcctgagcataaacggcatgtgccccctatccgttgaggaagtggagcaatggaagaaatctggttttaaggaatatcctctcaatccagagttcctggattggcttcgcacaaacgaggacaaaaatatcaacccgtacctgtttagagataaggcctcgaagcagaaagtaactttgttcgaactcgggagggcactgtatcacattgcccagcggcgcggatttctgtcaaatcgactcgaccagagcgctgagggcgtgttcgaggaacataacccccaaatccagaatttaattgaagatctggacagttccaacaccatccttaatgagttgaaggagtactatataaacctgggcattatcgatgaaacagagaaatctgggtttaagaaagacctagatgaaggagagaagaaactcaagagcctgtacaattcccttgtcgcaattaccaagaaaaacgccaacgacatcgaaacttgtaagcaggagctgatcgctagattgaataaaaaggaggatctcggtaaagtgaagggcaagattaaagacatatcacaggccatgctggacaggaacttcaagacattagggcaatactttttcagtctgtataataaagaacggatccgtaaccagtacaccagccgcgaggaacactatctcgaggaatttattatcatatgccagacgcagggaattgagggcatcaatactaacgagaaacttcctgaaaagaagttcaccggtctggcgaaggatttgtacagagcaatctttttccaaaggccactaaaatctcagaaggggctgattggaaaatgttccttcgagaagaataaatcacggtgcgccgttagccatcccgactatgaagagtttcgaatgtggagttacctcaacacaatcaagattggcactcagtctgagaagaccctgcgcttccttacactggaagagaaattgaagctcgtgcctaaattttatagaaagtccgatttcaattttgaagtcctggctaaagagttagtggaaaagggcgccagcttcgggtactacaaatcgtctaagaagaacgagtttttctattggtttaattacaaaccaaccgactccgtatcagcatgtgttgtgagtgctagcctggagaacgccataggaaaggattggaaaatcaagacgttcgaatatcaaactaggaatacagagaaaaacgaagtcaccaagtccgtggactacaaggatctatggcacctcctgtctgtggcgactagcgacacatatctttacgattttgccattgagaaattgaagctggaacccaaaaatgcaaaggctttctcaaaaaccaagctcaagaaagactttgccagtctgtcccttgctgccatcgcaaagatcctgccttatttgaaacagggtctcctgtacagccatgccgtcttcatggctaacattgagaacatagttgatgcggacatctggaaggacgaggaacagcagaaattcattcaatctaagatcgtggagttagtagataattacattgtggaaaagtcaaaactggagctaatcaacggcctcctgaagatatataatacggaagacaaagaggggcggaaggtctactatagtaaagaggcagaaagcctttttgaggccgatttgcgcaagaaactggtgccattctacaaggctaacatcattatcgaggaacacgagcaggaaattatctttcaggacctcttcccgatactgatggatcagttaaagaaacaagagtttattaagatcggaagactggacaaacagattgaagccttccttgagggcgaaaatgaggagggtcagatcttttgcaaccacaccgataagttgaaaaagctctatcatccctccgacatagaagttttcaagaaaaagacaatcaaagatgagtgggggaatgaaaaggtggtcctgggctctcctctaactacctcgattaaaaacccaatggcaatgagggccctgcaccagctccgtaaggtgctgaatacacttatcgctaacgaccaaattgatgaggacactcggatccatatagaaatggcccgagagttgaatgatgcaaacaagagaaaaggaatacaggactttcagaatgagaacaagaaattcagggaagaggcgatcaaggaaatcaaaaagctgtacttagaggaatgtcacaaggacgtaaatcccaccgaggatgacattctccgctatcagctgtggcttgagcaaggcaaatgcgaaatctacgaggaagggaacaacattagcatatgtgatatcattggatccaatccttcatacgacatcgagcacacaattccacggagtatctctcaggataacagccagatgaataagaccctgtgctccttgaaatttaacagatcaataaagaaacaaaagatgcccgttgagctcagcaattataacgacatcctgccgaggattgctcattggaagaaagaagccgaggaactaactcgccagatcgagacgatttctcgatccatcaagagtgcagccacaaaagtggctaaggataaaaatatacggaagcgtcactacctgaccctcaaaagagactatattctgggtaagtacgaaaggttcacttgggaggagcctaaggtcggctttaaaaacagccagatccccgataccgggatcattacaaagtatgcccaggcataccttaaatcttatttcaagcgcgtggaatccgtcaaaggaggcgctgtggccgagttccggaagttgtggggtatacaagaatcatttatcgacgagaattggtggaagcattacaaagataaggacagagataaacacacccatcacactattgacgcgatcacaattgcctgtatgccaaaggacaaatacgatctgttagctcacgcatggaggctcgaagacgagcaggataagaaggccgctaaagttctgatcgagcaggccaagccttggaaaacgttcaaggaagacatagagaaaatcgaaaccgagattcttgtgagtcattttactcccgataacgtaaagaagcagagcaaatcgatcattaagaatcgagggaaaaaggtctatgtgctgaaaaacgaactaccagttaatttcaagaacaaaatcgagggcaaggactactttaagctcaaattcgattccaagatactgtataaaattcccaagaaaaaggagaagcaaacagacaccttttacgaagagttgcctaaaaattatctgaacggagtggaaggcaaggattacttcaaaatcaacacaactgggaagaccttttataaaatcccaattttcaatcagggagacacgatccgcggttctttacaccaggagaccacatacggcgcaataaagctcccggatattgacatcgagactaagaaacccctgcataccgacaaagggggatttattcttaaaaaggatatcaaaggcaacgaaatagtcttcttcgtggtacggaaggagattagcaagatctcagaaaatgacgtgcagaacatcgttgataatgtcgtgagaaagaagattgagaacgcgatcgccaatagtctgattacatttaaaatagtgaagaaaaagaaagtcgctgttatcaaggaaggtgtgactatttggatgagggagcctaacatcgagaaggggatcgaaggcattccaattaaaaaggtgcgtatcattaccaattccgtcaaaaaccccatcgagattaaggtacactctcctttgagcaaatcccgccacaagcataagcaaaaagtgtacggacagaatgacgaaaactatgccatggcactctacgagctggatggcaagcgggagttcgaactaatcaataactttaatctggctaaacttctcaagcagtcacaaagctattacccactgcacaaagagaaggaaataaaggggaaaaagatcttggttcccattgagaaaagaaacaataaggacgtgatcctgaaaaggggacagcaggtcgtgttctatgataagacggttgaaaacccgaaggacattagtgagatcatagattttcgagaacggatttacatcattgagggcttaacaatccagcgccaaaaagacaagaaaacctctaaggtgaacgagtatggtataatccagctcagacatttcaaagaagccaggaagtccgaggaaattagcaaggataattttaaacctgacggggagttcaagatcaacgagaataaaccaactcggaagatgaaccacaatcagtttacagcattcgtagaaggaattgattttaaagtcctgccctcgggcaagttccagaaaatctga

SEQ ID NO: 3449 - RNA, 4614 nt, synthetic construct
  misc_feature 1..4614: note = Cas9 variant
  source 1..4614: mol_type = other RNA
atgaagaaaatcctgggcctcgaccttgggaccaacagcattggatgggccctgacaactaatgatttcgacacgaagaaaggtaccatagagggcttggggtccagaatcattcccatgtctcaggatatcttaggaaagtttgactcaggcgtgagtctgagccaaacagctcagaggactgaataccggggtaaacgccgtctagtccagcgattcctcctgagaagggagcggcttcaccgcgttctgcatattttggaactcctgcctaagcagtattccgaggcaatcgattttgacaagaaactggggcaattcaagccagaaagagagcagaaaatatctttttacaagaacgagtcgggcaaaaatcagttcatctttaccaagtcacaccaggaaatgctcacagagttccaaacctattacccgactattaagaacatcccctatgattggacaatttactatttaaggaaaaaggccctgaccgagaaaatcagcaaggaggagcttgcgtggatattgctgaattttaaccagaaacggggatactaccagctacgcggcgaagagaaggaagagaataaaaacaagaaggaagagttccatacgctcctggtgactgacattatcgagcgagataaagggaagagtggaacctggtataatgtaattcttgaaaacggttggatctacaaaagagagtccaagatctctctggctgactggattggcaaaacaaagagctttatagtgactaccgaatataatgatgacgggtccgtcaagttgacaaaagataacgaggaaaagaggtcattccggagtcctaaagaggacgactggggactcatcaagattcgtaccgagaaaacgatcaatcagagcgataagtctgtgggcgcctacatatatgacgcactgttaaagaacccaaatcagaaaattaagggtgaactggttcgcactatcgagagaaaatactataaggatgaactcagggagatccttaaaaagcaactggaatttcactccgacgtgttgaacgataagattctatacaaaaagtgcatcgacgagctgtacaaaaacaatgattcacataagaacagcattaaagaccgggggttcgattatctcttcctggacgatataatcttttaccagcgaccccttaagagtaaaacatctctgatttccgactgtagcttggagttccgccctatcaagaataagaacggagtcctcgtgaaagacaccgatggcaagcaaatcgccaaagctctgaagtgcattgcaagatcgaatccaatatttcaggagttcaggttactgcagtttgttaaaaacctaaagatctataagcggggcgtagtggacgatgtcgaggtgactaatgactacctcaaatctgaaaacgatgtggagaagctgttcaattggcttaacgacaaagccgagattaatcagaagcaatttttggtcaacttcaaactgaaggaagataagcaccgctggaattttgttgaggacaaagggtatccctgtaacgaaacaagaaatcagttcctcaacgctatcgccaagattgatgtggacaaatcctttttcaacaccaagaatacgcaggatctgtggcacatcctttactcagtaaccgacaaaatagagatcacaaaggcgattactacctttgcaaagaggcataacctgcctaatgagttcatcattaacttcagtaaaatcaagccatataaaaaggaatacggtagcttttccgagaaagccataaagaaattgctcccgctgatgcgtttcggatcttactgggatgctaagaatattgacatcaagacattagaccggattgataaaatccagactggcgaatttgacgagaagatacgaaacagagtgagggaaaaagccatcgatctgcacaagattgacgatttcaaagacctacccctctggctggcaagctatatcgtctacgataagcattcagaggctagtgacgtgtccaagtggaaaacccctgccgatattgaaaagtttcttaaacacgagttcaagcaacacagcttgcgcaatccaatcgttgaacaggtgataacagaaaccctgcgggtcgtgaaagacatttggctccagtatggggagggaaaggaaaactttttcaatgagatccatatcgaactgggcagagagatgaagaacgataaagcgactagggagaagatttctaaaaaggtatcagaaaatgagaacacgaatttacgcatcaaagccattctgacagaacttaagaacgacggtgttagtgatatacgaccctacagcccttcccagcaagagatcttgaagatttatgaggaaggggtgtacaataacgagtctcggaaagaaaagctcgaggaagtcgacaaaatccgtaagaacgcaaaaccaaccacttcggagattatcaagtataagctgtggctagagcagggctacgctagcccctacaccggaaaactgataccgatgtccgaactctttacaaccaagtatcagatcgagcacattatccctcagtcaagattctttgacgatagtctgtctaataaagtgatttgcgaaagcgaggtcaacgaacttaagtccaatatgactgccttggagttcatcctgacaaacgagaataggatagtgacgttaaccggcggggaaactgttaaaatttttacaaaggaggcttacaaccaacatatcatctcatattacagcaaaaataagaacaagcagaaacgcctcctgaccgaagagattcccgaacagttcatatctcggcaacttaatgacacaaagtatatctccaaaattgtgaagaacctgttgagtaaaatcgtaagagaggaggatgaacaggaggtcactagcaagcacgtggtttctctcaatggatccattacctcaaggatgaagcaggactggggtctgaacgatgtgtggaatacgatcgtcagtccacgattcgaacgcctaaacaccctgacaaatagcaacgactttggccagttcgagctcaaaaaggatgcctacgggaacgagggaaaacgggtgtttcaaactaccgtacctgacgcaatagccaagggcttcactaaaaagagaatcgatcataggcaccacgctctggacgcgcttgtgattgcatgtgttaatcgtacacatatcaactatttgaataacctgaatgccaaggataccgacgacaaagctgtcaagcacgaattacgcaacaaactctgctttaagacgaaacccgattcgaatggtaactacaagtgggagttccataagccatgggaaaaatttacaaaggaggcccaggacaaactgaataccactattgtgtccttcaagcagaacacacgggtgatcaataaaaccgtcaacaagtacgtttcttataaagatgaaaatgggaaccttaatgtggacgcaaacggcctgccccagaagaaggtgataactcaaaccaaaggagataattgggccattagaaagcctctacacgctgagacagtaagcggcaaagtctttctcaagaggatcaaacagtcacacatcacgattgccaacgcaatcgaacaggtggaactgatagttgacaaggaggtgaagaaacagttgaaggcgaaaattaagctgtacccaaacaatatcgctgggctcaaaaagcatttaaaggccttcccggtcatgattaacgataaagcaatcgacaagatacaaatttatgaaaccctggaggccactgctacacgaaaaatccttgatatcacctttgacgaaaagaaaattcagaagatcacagatactggaatacagaagattctgttgaatcacctcaaacaagagaagtaccagaacaccgtggacgagaatggtaaaaagctggcaccccatgaaatcgccttcagtgagaacggcctagaagatctgaataaaaacattacgttccttaatgacgggaagaaccaccagcctatcaaaaaggttcggatctttgaggaaggaaataagttcccactcggcgaggtgggtaacaaaattaataagtttgtagagacagctaaagggaccaacctgttctttgccgtctatgaaaatgacgataagaaacgcaactacaagactatacccttcaacgaggtgatcgaaagacagaagcaaggcttgaatgcggccctggagattgacgagaacggaaataggttactctttaccctgtcccctaacgatcttgtgtatatcccactggaagacgagattggctacttgaatggggtctacttcaaaaacctcaataaggaacagacagttcggatctataaatttgtgtcttgtactggaggcgagggtcatttcgtacccaacaattacagcaaggaaataatctccaacgagaatgggtcaaacaataaaaacgagcgaatgctgaattttaacaacttcaatattatctttgatggaaaggaaaagccggtgatgattaaaagcatctgctggaagctagaggtcgacagactgggcaaagtgataaagattatcaaatga

SEQ ID NO: 3450 - RNA, 4617 nt, synthetic construct
  misc_feature 1..4617: note = Cas9 variant
  source 1..4617: mol_type = other RNA
atgaagcacatcctgggcctcgaccttgggaccaacagcattggatgggccctggtgaaatccgagcaggattgcgacgatgtcgaaagaataaatggtatcgaggctgcaggctctaggattatccccatggacgccgcggttttgggggatttcgctaagggaaacacaaaatcacaaactgccgaccggacggcagcccgcggcattcgacgtatgggtgaaagacataagttaaggcgggagcgcctgaatagagtgctagatgtaatggggtttctccctgaacactacagtgctgcactgaccaggtatggaaaattcaaggacggcgaggagtgtaagatcgcctggcggaaagatgaaagcggccagtggacatttgtgttcgaggactcctttcgcgaaatgcttgctgatttcgtcgcccatcagccagagtggctggcagggggacgaaaggtgccgtacgactggactatatattacttgaggaaaaaggcactctctaaacccctgaccaagcaggagctggcctggctcttactgaactttaatcaaaagagaggttattaccagcttcggggcgaagatgagcacacagacgacaaagggaagttggttgaatattacgctctgaaagtggtcggagtggaggataccggcgacaagaaaggtaaggatacttggttcaacatcatgctagaaaatgggatggtataccgtcgccctgccgcagaggctccagactggattggaaaaacaaaggagtttatcgttaccacggatctcgaaaaggacggcactcccaaaaaggataaagagggcaacattaagagatcgttcaggatgcctaaagaagacgattggaccctgatcaagaagaaaacagagaatgacatagatcggtcagggaagactgtgggagaatatatttacgacgcccttctggcggacccaacccagaaaatccgaggtaagttggtccgcacagtggagagaaaatattacaaggaggaactcaagaaaattatcaacagccagaagaggtttatccccgagctgaatgataacgaattatatggccggtgcattagtgagctgtaccaatccaatgacgcctatcgccagtctataagctcctgtgatttcacctacctctttgtggacaacatcattttctaccagagacctcttaaatcaaagaaaagtctgatcgataattgcccatatgaggaacatagctacacggactctaagactggggaggtcaagacagcaccggttaaatgtgtggctaagtccaaccccttgttccaggaatttaggctatggcaattcgtacagaacatacgtatttttgagcggcagaaaaagatcggagattcagtgaaaaccgacgtcgatgtgactggcgaatttatcaagagcgccgacgatgttgtgagtctgtttgacttcctcaatgatcgaaaagacattacacaatctgtcctgcttggtacctattttaagatcaagaaacctaaggggaaagactccgattacccatatagatggaactacgtggaggacaagacgtatccctgcaatgagaccagggctctgattttgaaaggcctcaaggatgccggaatagacgaaggcttcctggataaggacaaagagtacagcttatggcacatcctgtactcggtagaagataagcaggagattacaaaagcaatggaaaagtttgccgctaaaaactctctagggggaaagttcgcggaggttttctcctcactccctccattcaataagaactatggtagttacagcgagaaagcaatcaagaaactgcttgccttgatgcgcactggcaagtattggtccgctgacgccatcgataaacacaccctggaacggattgacaagataatcaatggggagtacgatgaatctattagaacaagggtgcgcgagaaggcaatcaacctcactgacgtcagccattttcgaggactgcccctttggctggcctgttatattgtgtacgatcggcactcagaaagtaaagacataacctgctggaattgtccggctgacatcgatcagtatttggaccatttcaagcagcactccctccgtaaccctatcgtcgagcaagtggttacagagaccctgagaactgtgagggatatttggcgccagtacggcaaaatcgacgaaattcacatcgagatgggtcgggatatgaagaatcccgccgacgtaagagcaaaaatgagcaagaggatgatagataacgaaaatgcgaacttacgaattaaagctatgctggccgagttcgcagacccagattttgggatcgccggcgtccgcccttactctccctcacagcaggaaatgctacggatttatgaggagggagctctcgaaagtgtggacgaggttccagatgaaatcaatgagataatcagcaagttcaaccaaacggacattaagaaaagacccacacatggcgagatcattaagtacaaactgtggcttgaacagaagtatcagtccccttacaccgggaggactatctctttgtcgcgtctgtttaccgacgattatcagatagagcacgtgattccacaaagccgctacttcgacgattccatgtcaaacaaagtcatctgcgaagccgaggtgaatcagctcaaggaccggatgctgggatatgaatttatcaaggcacatcacggtgagaaagtattactgagttctggcgagacagtgaccattcttactgctgaagagtacgaaagattggttcagctcaacttcaggaagaatccggtcaaaatgaagaaactgctaatggatgacatccccgataagtttattgagcgacagctgaacgacagccggtacatatccaagaaaatcaagtcactcctgagcaatatggtgcgcgatgaaggggagcaagaggacatttctaaaaacgtgatcgcctgtaatggagcgattacagatagacttaagagggactggggcgtcaacgatgtttggaatcatatcatattgcctcggttcgaacgactgaacgccgtgacgggttccgacagatttaccactacaagtaccaatgggcacacaatcccagacatgcccttaaacctccagaaaggcttcaataagaagcgcattgatcacaggcatcacgctatggacgcaatcgtgattgcctgcactacccgtagccatgtaaacctgcttaataacgaggctgccatgtctaaaaacaatgcagtccggtatcagctgtccagaaagttgaggcgctacgaagatacgatggtgacccgaaacggagagacaagaactatctcagttgcgcgggaatttctcaaaccttggccaaccttcaatgccgacgtggagaaggctctgaggggcatagtcgtgagttttaaacaaaacctacgcgttattaataagacagtgaacaagtatcagaaattcgtatacaatgaggaaaagcacatcaaagagaagaaagccgtccgtcaggaagagagaaacgggcggcatctgctcgcaatcaggaagcccatgcacaaagatactgtgtatggagaggtgaatctgcgccgaattaaggaagtcagccttaaggacgctgttgccaacccgaaagcagtggtagataaggacttgaaaaagaaactgatggccatgatagagttaggctacgatctcaagcagatcaccaagtatttcgaagacaataaagatgcttggcaagacgtgaacctgaagaaaattaaggtctactactttacgaaagatacaggtgacagatatttcgcgacccggtttgggaatgaccttgtgactctgttctcgaagatcacaaaggccgatgacgcgaaaaagcagattgagaggatcaccgatactggaatacagaaaatcctaaagcgccacctcgaagctaacggcggtgactgccagaaagccttttccgccgatggcattgacgagatgaatagaaacatcacccaactgaacgggggaaggcctcataagccagtttacaaggtgcggatttatgagaaagctgataagttcgcaatcggcacaaaagggaataaggccgcgaaatttgtcgaagctgccaagggaacgaacttgttctttgcagtgtacctgaaagagtatgaagactctaccactggcgagacaataaagaagcgtgttttcgataccattcccttaaaaacagtgatcgaccgcctcaagaatggtcagactcctgcccccgaagagaaagatggggctaagctgctttttgtcctgagcccaaacgacttggtatacctccctaccgaggacgtggttaaaaatggaacgatcaaccgacccctggataagagaaggatttataagatggtgtcatgtacaggcaccgaatgctactacatcccattcatagtcgcaagtccgattgtggacaaagtagagttcttttccctaaataagatcggtcgggccattactggcgaaatgatcaaagagatatgtattcctatcaaggtggatcgcctggggaacatcaccgaagtcaataacgagaaaatttga

SEQ ID NO: 3451 - RNA, 4623 nt, synthetic construct
  misc_feature 1..4623: note = Cas9 variant
  source 1..4623: mol_type = other RNA
atgaacaagatcctgggcctcgaccttgggaccaatagcattggatgggccctggtgggtacagatgaggaaggcaaccccataagaatctacaaatccgggtctaggattatccctatgtcacaggacgtcttgggaaatttcgatcggggcaacagtattagccaaactgctgagcgcacgtcctatcgaggtgttcgtagattaagggaacggcatctgctacgcagagagaggctccaccgggtgctgcaccttatggggtttctgccatctcattacgaagaggcaatcggatgggacaagggcgataataaaaccttcgccaagttttattcggacacagagccgaaattgccctggcgcaagaacgcggaacgagagcacgagttcctctttaatactccttacaacgagatgctggtagatttcagaaagaatcagccacagctgtttaaaataaagaaaaacggccaggagtcactcatcccctatgactggaccatttactatttaaggaagaaagctctgagcaagcctatcagtaagaaagaacttgcctggattatcttgaatttcaaccaaaagcgggggtactaccagctgcgtggagaggaagaggaagaaaattccaacaaactaatagagtatcatgcactcacagtggtcaaggtgattgccgatgaaccacagaaaggtaagtctgacatctggtacaatgctgagctggaaaacggctgggtttatcgcagaagctccaaaactcccctttttgattgggagtcaaaggtgaaggagttcgtcgtgaccacagacctgaacgcagatgggagtttgaaagtagacaaggagggaggcgttaaaaggagctttcgggtgccttctgaggacgattggatgctcgtcaagaaaaagaccgaatccgacattgagaagtcagataaaacggtgggttgctacatctatgacactatcctgcagaatccaagccaaaagattcgagggaaattagtgcgcaccatagaaagaaagttctacaaaaaggagctgacagaaatcctcaacaagcagaaagagtttcacagtgagcttcagaataaggaactgtatcaggagtgtattaaagaattgtacccgcacaacgaggcccattacgattctctactggtcaaggactatactgatctcttcgttaatgacatcatattctaccaaaggcccctgaaatccaaaaagagccttatttcgaactgcccttatgagtaccgggtgtatcgcaatgattctggaatcgtagaaagagtgccaatcaagtgtattgctaagtcccaccccctgtaccaggagtttaggttgtggcagttcatccataacctccgtatttatgaacggcaacgagaggtcaatggcaaacctgaaaccgacgtggatataacagccgagtttatcccaaccacggaggacagagttaagctgttcgactggttaaacaataaaaaggaaattaaacaggatactctgctacagtcatactttaagatcaagaaaaagaaaggcgacgataagttcccctacaggtggaactatgtggaggacaaagaatacccgtgcaatgagacacgcgcgctcatcctgagtcggcttaccaagttgaacctgagcgaagattttctcactaaggagatggagctggcactttggcacattctgtattccgtcgaagacaaagaggaaataaagaaagccttcaagtcttttgctcagaaacacaatttggatgacagcttcgtggatcaatttatcaagttccctccctttaagaaagactacgggtcatatagtgccaaggcaattaaaaagctcctgccattaatgagaatcggaaaatactgggatgagaaggctatttccggtaacacaaggagccgcatcctgtctataaacgaacgactagaggacatgcggtcaagtggcaagaaaatcgaggatgtaagcgacgacgatattcctaagcaggttctcaaatccttcgacaaggtgaatggggtctattctggactgaacacctaccaggcctgttacgcggtgtatggccgtcattcggaagccagcgagatcacgaaatggaagacaccccaggatattgacgattaccttaatgagttcaaacaacactccttgagaaacccaatcgtcgaacaggtgataaccgaaactctgagggttgtgcgcgacatttggaagaagtatggtgatttttcagaaatccatattgagctcgggcgggaaatgaaaaatcccgcagacaagagagctaaaatgaccacacagatcagtgagaacgaaaatactaacctgaggatgaagtctttactggccgagcttaaaaatcacaacgatgtagagaatgtccgaccttacagcccatcccagcaagaaatattgaagatctatgaggaaggcgtgctcaactcagttagcgagattccggaagagatcattaagatcaccaaatcttcccagcccagtcagacagagctggtgcgctacaagctatggctggaacagaaatatcggagcccttacaccggagagataattccactcggcaagctgttcacttctgcttacgaaatcgagcatgtcatcccccaatccagatattttgacgattcacttagtaataaagtgatttgcgaaagcgaggtaaacaagttgaaggggaatctgttaggatacgagttcgtgaaaaaccaccacggtgttaaggtcgaactcaactttaataaaacggtggagatcttctcgattaacgaatatgaggagtttgtgaagggcaattacgggaaaaacaggggaaagatgaagaaactgcttctggaagacatacctaagtccttcatcgagcgtcagttgaatgatacacgctatatttctaaagtcgttaagggcctcctgagcaacatcgtgcgggaagacggtgagcaggaagccacctcaaaacatgtgattccatgtactgggggcgtaaccacaatcctaaagcaagactggggactgaatgatgtctggaacaagatagtgacccccagatttgagaggatgaatgagctcactaacacaagtctgttcggccagtgggaaaataaagaggggaagcgaatctttcggacggaagttccgcttgagttgcagaaaggattcaacaagaaacgcattgaccacagacatcacgcaatggatgccatcgtgattgcttgcgcgaccaggtcccacgtcacttacctgaataacgaatctagcaaggcaaatgccaaagagatccgggacggtttaaagcataagctctgttttaaatccaagacagatgagaccggcaactataaatggcagttccacaagccttgggacacattcactcaagatgtgcaggacaccctggaaaacatagttatttcatttaaacagaatcttcgagtgatcaacaagacgaccaatagataccagaagtacgaggaagagaaaaagatcctgaaaagccaagaaaagggggatagttgggctattcgcaaaccactacataaggacacagtattcgccaaggtctctctccagaaaataaagtgcgtgaaactggcaatggccttgaaggattggaaaaacatcgtggacaagcagctgaagaaagagattaggcgtttaatcctctcctatggaaagtttgacgctgagattctgaataaatacttcaaggatcggaaatatatctttaaggacgtcgatataagcaaagttgacgtgtactatttcgaaactgagtacgtagccaccagaaagaaccttgatacatcgtttgacaggaagtcaatcgaatctattactgataccggcatccagaaaattctgttgaatcacctcggtgtgaagaacaataaccccgagctggcattcagtgcggaggggatcgacgaaatgaatcaacgcatagtcgagctaaacggcggaaaacagcatcagcctatttataaggtgcgaatgtacgaacccctgggcaataaatttcaagttgggagaatcggaaacaagaaggataaatacgtggaggctgccccaggcacgaatcttttctatgcaatctaccagtccgaagacaagaaacggatttatgatacaatccctctcaacataattatcgagaggcagaagaaagagctgtttcccgtcccagaaaataaggaggacaaggataacttgtacaaactgttattctggctcagcccgaacgacatggtgtatctgcctaccgaaaaggagtgggccaatcccgaccttttcaactttaataacatgactaaaaatcagcgcaagaaactgtacaagttcattgatggttctgggacaaccgctaactttatcccaaatactgttgccaacataattttcagcatccccaagaaagactccggaaagtattcaatgggcaatcgtatcgtgcaaaacgaatttggtattggcagtcctcagagcaaaaatcagaaggcattcaccggggagatgatcaaagagagatgttggaagttgaaaattaaccggctcggagatataatcgaatgcattaagtga

SEQ ID NO: 3452 - RNA, 4629 nt, synthetic construct
  misc_feature 1..4629: note = Cas9 variant
  source 1..4629: mol_type = other RNA
atggagaagagaatcctgggcctcgaccttgggaccaacagcattggatgggccctggtgaaaggtgaaaggcacgagaatgataacgaaacaatattgtcctacatcgaggctgcaggctctcggattttacccctggacgccgcggctcagggggatttcgaaaagggaaatcctgccaaaactcaaacgtcagagcgcacccgaatgcgtggcatgagacatctactcgagaggagtctgcttcggcgcgaaagactgcacagggtcttggacatcatggattttctcccaccgcattatagccagtccctgacacggtacggtaagttcaaagcagacactgagtgcaagctggcctggcgcaagaccgaaacagggcactatgagtttctcttccaggattcttttcaggagatgttacaagacttccagaaccatggaaaactggaagagaataagaaaattccctacgattggaccatctattaccttcgaaagaaagctcttactcagcctgtttcgaagcaggaactggcatggatactactcaactttaatcaaaagagaggctattaccagagggaggaccaggccgtggatgacaaccagaaaaagcgggtagaataccaagctctgaaagtgatctcagtcgaggatacaggcgagaagaaagggaagaatacctggtatgacgtgcgtcttgaaaacggactggtttaccactatagcgccccaattaaacccgactggaagggtgagacgaaggagttcatcgtgactaccacaattgatcagaatggcaaacctgaattggacaaggatgggaaaccaaagtacagtatgcgcgcgcccaaagaagacgattataagctcctgatggagaagactaaaaaggacatcaccgattccggaaaatctgtcggcgagtacatatatgacgcattactggtgaaccctcagcaaaagattagaggtgggctcgtaaggacaatcgaacggtacttttacaaaaaggagcttgaaaagattctgttgagccaggagcgattcatcccagaactaaccgatcgcgagctgtatagaaggtgtgttgaggaactctacccgtccaatgacgcctatcggcacctgatcgagtcacgcgatatgagataccttctggtggaagacattttgttttatcagaggcccctcaaaagtaagaaaagcctgatagacgattgcccttacgagtctcgttcctatgtcgaccgggagacgggagaaatcaagtcaagcccagtgaaatgtattgctcagagtcatcccttattccaagagtttcgactgtggcagttcatccacaacctaagaatataccagaatgaaaggtctgtggagggcaagctccagctggatgtcgacgttactgaagaggtgcttcctacaccagagtccaaggccgcattgttccgctttctgaacgatcgggaaaacgtaacccaagagattctcctgaaagaagtgttcaagggcagaaaacttagcgtcaaggactgcccctacaggtggaattatgctggggagggtaaaaagtacccgtgtaacgaaactcgccatctgatgttgaaactcctgaagaaggccggaatcgatacagcgtttttaacccctgagaaagagcaggccctgtggcacatcatgtattcggtggaagacaaggatcagtacgagaaagcactatctacgttcgctcgaaagaatgacctccccgatggctttaaagaacagttcaagaaggccccaacctttaaaaaggactatggggcttactccctgcgggccattaaaaagttgttgcctctgatgcgtgttggagagtattggtcagcagattgcatcgacagtgaaacaaaagagagaattagccaaataatcaggggcgagatggacgaaaaggtgtcccagcgcatgactaagtctcgggatagcttcaccgacatttcacagtttcagggtctccccgtctggcaagcctgttacgtggtatacgggagacacagtgaggctacagaaatccagaggtgggagaaaccagaggatatcgacgtttatctgaaggcgttcaaacagcattccttacgaaaccccattgtggaacaagtcgtgctggagactcttcgcgtcgtgcgggatatatggaagacctacggcaaagttgacgaaatccacattgagatgggaagagatatgaagaatacagcagaagagaggaagcgtatctttaaccgcaatcagcagaacgagaatgacaacttgcggattaaagccctcctgaccgagttcatgaatcctgattttgaaatcgaaggcgtgagaccatatagcccgtctcagcaagaggctctaaggatatacgaagacggggcctggtcaggactggatgaggagaaggaagacaaaaaggagctcgaagcaatccgagagattctgggtaaattcagtcagagcgataaggccaaacggcccactcattccgaagtacttcgctataaggcttggttggagcagagatactcttcgccttatacgggcgaggccatcccactggcaaagttattcacacccgcgtacgaaattgagcacgtcatccctcagagcaggtttttcgacgactccttttcaaacaaagtggtttgcgaagctgaggtgaataagctcaaagatcggatgctggggtacgagttcataaaggcccatcaaggagaagtcgtgagtctttctggcaccggtcgatgtgcacgcattctgagcccagaggaatatgagcagagagtaactgactgctacaaacacaacaccgccaagatgaagaaattgctcatggaagagatccccgatgactttattcagaggcagatgaatgattcccgttatatctcaaagctggtgaaaagcctactgtctaacatggttcgggaggaaggggagagagaagctatatccaagcacgtcatcacatgtaacggcaccattactgacaggctcaaaaaggattggggagtgaatgacgtgtggaaccatatcattctgccgcgcttccaacgaatgaaggatcttacaggcagaaatgactttgtcgccgttaacagtcaggggcacgagatccctagcgtgccacccgaattgcagaaaggattcaagaaaaagcggatagatcataggcaccacgcaatggacgctattgtgatcgcctgcacgacccgcaatcatgtaaacctgttaaataacgaggcggccatgtctgagaataaagctaaccgtatcgcactctccagaaagctgcggaggtacgaaaattgcgccatttataagggtggcgagactaaaaacatctcagtcgctaaggaatttcttaaaccttgggccacattccccgcagacgtggagcgcgcgctgggggatattgttgtgagttttaagcaaaatctacgagtcataaacaaagccaccaatcactacgaacattataaggacggaaagaaagtgaaggttccacagaaaaagggcgatatgtgggtggtaagaaaacctctccacaaggacacagtctacgctctggtgaacttgcggaacgtgaaaactgtcggtctgaaggatgccatcttaatgcccgacaggattgcaaataaggatctcaaaaagaaagttaaggagctgcttgctcagggggacgatctgaaaaagatcaagaaatacttcgagaccgaaaaggacacgtggcaggatgtggacgtgaaaaagattgaggtatattactttagcgaagagaccgccaaccattattacgcaacacgcaaaccattcgatgccaatgtcaagatcgactcggtgactgacaccggcatacaaaagatcttgagaaggcacctcgaggaaaacggaaataaagctgatgttgcgttctccccggagggcattgcccggatgaacgaaaatatctttcgtctgaacgggaataagcaccatcagcctatttataaagtgcgcgtctacgagaaggcaaacaaatatcccgtgggacagacaggcaataaggcttctaagttcgttgaagccgccaaaggtactaacctatacctggctgtgtacgagagcgaggtcgtagacaagaaaaccgcagaaatctcaaagaaacgaagttatgtgatagttccacttagagatgccgtggcgaggcagaagcaaggggtccccgtggctcctgagcggaatgaagagggaggcaaactcctgtttgtattgtccccaaaggacttcgtgtacgtccccacggaagaggagcgctctaagggtgaagttctgttacctctcgataaaaacagaatttatatcatgatggacgccagcgatggcatcgtgaattttctgccgtactccgtggcaaaccttatttatgccctgccaaaggaccaggcttcagggttctgtacagatggaaggatgatacagaacgagtttggcttggggagccccaaaagtaagaatgaacgggcactcaccggagagatgatcaaagaaatttgcctgcctgtcaaggtggaccgactaggcagaatcactgagattaacggtaataaggtttga

SEQ ID NO: 3453 - RNA, 4644 nt, synthetic construct
  misc_feature 1..4644: note = Cas9 variant
  source 1..4644: mol_type = other RNA
atgaagaaaatcctgggcctcgaccttgggaccaacagcattggatgggccctgacaaataacgatttcgacaataagttgggttccatagagggcttagggtctagaatcattcccatgtcacaggatgtgctgggaaaatttgacagtggcgtcagcatctcccaaactgctgaaaggacgaagtaccggggtacccgccgactggttcagcgtttcctcctgagaagggagcggcttcaccgcattctgaacatcttggattttctccctagacattattctgaagcaatagacttcgataaaaagtttgggcagttcaagccagagagggaagagaaactgtcgttttacaagaatgagtcagggaaaaaccagttcctgtttctcgaaagccaccaagagatgttcagtgaatttaagttaacacatccggacctgaaacaggtgccctatgattggactatctactatcttcggaagaaggccttgacccagaaaatttccaaggaggagctggcgtggatcattctaaatttcaaccagaaacgcggctactatcaactccgaggcgaagaggaagaggtaaataagaacaaactggaagagtttcacacacttgtgatcgtcgacgtgatagagagagaaaaggggaaatctggagtttggtacaatgtgattctggagaacggttggatctacaagagggaaagcaagattgctttgttcgattggatcggcaaacagaagaatttcatcgtcaccactgagctcaacgacgatgggacaattaaactgaataaggacaacgaagagaaacggtcctttcgttcacctaaggaggacgattggggattacgcaagataagaaccgaacagacgatcaaccagagtgagaaaagcgtgggctctttcatttatgacgaactgctcaagaaaccaaatcaaaagatcaaaggtgagcttgtaaggactatagaacggaagttttacaaggatgagctgtccaaaattttgaaggcccagatcaccttccattatgagatcctaggggaccgaaacatttacaaaaagtgcatcgatgaactgtatcgccacaatgactcacacaaaaacaatattaaggataagggatttgactacctcttcctggatgacataatcttttatcagagaccccttaaaagcaagacaagtctgatttctgattgttccttggagttcgttcctatcaaagacaagaaaggcatcctcgtgaaggacagcaacggcaaacaagtcgtgaagccactgaagtgcattgcaaaatcgaatcccatatttcaggagttcaggttactgcagtttgtgaagaacctaaaaatctacaagaaagaaattatcaatgagattgatgtcactaacgactacctcaagaccgaagaggatctggttgaacttttcgactggttgaatgataaggccgagatctctcagaaacaatttctggcttatcctaagttcaaactcaaggaagacaaataccggtggaacttcgtggaggataagatatatccatgtaatgagacacgcaaccagtttctgaatgcaatcgccaagattgacgtaaacaaatccttctttgatgctaagaacacccaggacctttggcatatcctgtactcagtgacggataaaactgaattgttcagtattaatacagagaccgggatccagagcggagccctctccacttttgcgaagagacacaacctgtctaatgagttcgtcagcaacttttcaaaaataaagccgtataataaggactacggtagttattccgaaaaagcaattaagaaattactgcccctaatgaggttcggcagcaactggaataagaacaatatcgatgccaaaacactcgctcgtattgacaagctgcaaaccggggaatttgacgagacgatgcggacccgagtgagagagaaagccatccatctttctaagataacagatttccagggattgcctctgtggctcgcatcatacatcatttacgacaggcacagtgaagctagcaacatctccaagtggaaaactccagaggatattgcctggtttctgaatcccaagaacaaatctggcttcaagcagcactcgttacgcaatcctatcgttgaacaggtgataaccgagacactgcgggtcgtgaaagacatttggcaacattatggtgaagggaaggagaactttttcaatgagatccacatcgaacttggcagagagatgaagaacaacgcgaatgataggaaacgcattactgaaaccatcaaccagaatgagaacacaaatttgcgaattaaggccatactcaccgagctgaaaaacgacggaatcaatgatgtacggccatacagcccctcccagcaggaaattctaaagatctatgaggaaggcgtttacaactcagagattcgtaaagaaaagctggaggacatcgataagataaggaaaaatgcaaagccgactcctagtgagatcattaaatataagctctggctggaacaagggtacatctctccctatacgggaaaacttattccattgagcgacctgttcacaaccaagtaccagatcgagcatataattcctcagtccagattatttgatgactcactcagcaacaaggtgatctgcgaatctgaggtcaatgatctgaaaggtaacaatactgctcttgagttcatcctgaagaacgaaggccgcattgtgttgctcaccgggggaaaaacagtcaagatatttaccaaagaggcctacaatcaacacatcacttcctattacattaagaacaagagtaaacagaagcggctgctaacagaagagatccccgaaaaattcattgacagacagctgaacgacacgaagtatatcagcaaaatagtgaagaatctcctgtctaaaatcgttagggaggaagatgagcaggaggtgacctccaagcatattgtatcacttaacggcagtatcactagccgaatgaagcaagactggggtttgaatgatgtctggaacaaaattgtgtcgccacgctttgaacggctgaatgctatcacaaactccaatgacttcgggaagttagagctcaaaaaggatgaatttggcaacgccggaaaacaggttttccagaccacagtgcccgacgatatagcaaagggcttttctaagaaaagaattgaccacaggcaccatgccctggatgctcttgtcatcgcgtgtatcaatcgtactcacattaactacctgaataacctaaatgcaaaggacgagaacgataaaaccatcaagcatgagctccgcaataaactgtgcttcaagacgaagcctgacagcaacggaaattcaaaatgggaatttcacaagccatgggagaacttcaccaaaaaggtggaagacgagttgaaccagacaataattagtttcaaacaaaatactcgggtaatcaacaagaccgtgaataagtatcaggtttggaaagaagaggatggagccatgaagaaagtcacagtgaagcagactaaaggtgacaactgggctattagaaagccgatccacgccgagaccgtgtccggcaaagtctttctgaagaggataaagcagtctcatattacgatcgcaaatgccatcgaacaaattgagttaatcgttgataaagaagtgcgaaagcagctcaaagctaagattaaacagtaccccaacaataaggaggggttcaagaaacacctgaaggcctttcctataatgatcaacggaaaagcaattgacaaggtgcaaatctatgaaacaatcgaggcgaccgctactcgggagcgcaataaccttgatattacattcgacgagaaaaagatagaaaagatcaccgatactggcattcagaaaatcctgttgaatcatctcaagcaggaaatttaccagaacgccatcgacgagagcggtaaaaagatagcaccacacgaagtagccttttccgagatcgggattgatgagctgaataaaaacatcaaggtcctaaataacggcaagaaccatcaacccattaaaaaggtgagaatcttcgaagagtcaaaaaggtttagcctgggacagagtggctctaagaccgacaaatacgttgaaacagctaaggggacgaatcttttctatgccatatacgagggcaaaaagggaaaccggaattataagaccattcctctcaacgaggtgatcgaacgacagaaacagggtctaaattccgcattggtcactgatgagaacgaaaatagactgttatttacactcagcccaaacgacctggtgtacattcccaccaatgaggaaaagaaaaaccttacaactatcaatttcgataagctgtcgcgcgagcaaaccgagaggatatataaatttgtttcatgtacgtctggggaaggacacttcgtgagtaacaattactccaaggagatcattagcaacgaaaatggctctaacaacaagaatgagcgtatgttggaatttaacaatagcaacacaatctatgacgagaaagagaagccggtaatgattaaatccgtctgctggaagctcgaagtggaccggctgggtaaaatcaagagaataattaggtga

SEQ ID NO: 3454 - RNA, 4677 nt, synthetic construct
  misc_feature 1..4677: note = Cas9 variant
  source 1..4677: mol_type = other RNA
atgaagaaaatcctgggcctcgaccttgggaccaacagcattggatgggccctggtgaatgtcgataagaacggtaatcccttcggcatagaggggttgggatccagaatcattcctatggaccaggctacattatctgattttgaaaaaggcaactcaaagagtcaaactgcagagaggacgatgttccggggtgcccgccgactgcgtgaaagaaaacacctaaggcgggagcgcctccatagaatcctgaatgaacttaactttctgccaattcactacaggagctgcatcgacttcgttcatcggttggggaagtttaaggcgaatcacgagccgaaaatagcttggcgctccaacgatcaggacaagatggagttcatctttcaaaattctttcctcgaaatgatgtcggattttaccaaacgacagcccgagctggtgaaggaaggcaaaaagattccttatgactggacaatctacttcctgagaaagaaagccctcggacaaaggattgagaaggaggaattagcatggctgcttttgcattttaaccagaaacggggctattaccagctgcgtggggaggatgaaatcgacgccactcgctcagctaagaccagaaaatatttcgataggaagataattaaaagcatcattgacacaggagaggaatacaagggtctaaaggtactcatcgtggagctggataatggcaaccaggggaaaatctttaagcaagaggtcccagactgggtgggacaggagaaaaatattatagcaaccgttgaccttgataaggacggcaaagatcggttcgacaagggtgtgctgagtcagcgattctccatcccctctgatagcgaatgggaaactgagtggaagttgattaaactcaagacagaagaggacctggaggcctcccagaaaaccgtcgggacgtatatctacgattcattactgaagaaccctaatcagaaaataaagggaaagctcgtgcgcactattgaaagaaaatactatagggacgagcttcgggctatcctgaacaagcagcgcgaatttcacccagagttgaacgataaaaagctataccagcactgtatcttcagtctgtatccccaaaatgaagcctttagaaacagcattgcgaataaagacttcacctacctctttctggaggatatcattttctatcagaggcctcttaagtctaagaaatccacaataaacaattgcgcatacgaggtacgtcggtatatggacaaggaaactaaagagctgaaggaagttccattgaaatgtatcgccaagtcacatccgatttttcaggagttccgactctggcagtttatcagcaacctgagaatctacaaaaaggacattaccgatatagacgtgacaaatgatttcttacacagtcaagacgattacgctaacctgtttgagtggctaaataacaagaatgaaatcgaccagaaagccttcctcaagtatcccgcatttggcttcaaaaaggatgctgtcaactacaggtggaattatgtggaggacaaatcttacccttgcaacaagacccgctccgccattctgagcaaacttgataaacatgaacaggagttcttgacgaaggaactggagctcaaaatctggcagctgctttattcggttaattctaaggaggaaattgacaaagcgctgaacgtcaactccccaaagatcaataacaagatatcaatcgatcacactggcattttgcacgagctcaaaagtagctccctgtctgacatcagcattcaacggttaaaggccatcaattttgaagagaaagattacgggtcatatagttacaaggcaattaaaaagctgctagctctcatgagacagggaaagtacttcgacaacacagccataaccgacgctactaaagccaggatcaattccatttttgatcgcctggaaagcatctctttcgaccccgagcgaataaactcaatcagtgatgacgatattcctaagcagatccttaagagctttattaagttgaatcggacatatggtggcttcaacacctaccaggcatgttatgccgtttacgggcgtcattccgaggctaaagaaatcgcgaagtgggagaaaccagaagacatagatcaatatctggcaaagtttaagcagcactctctcagaaatcccattgtggagcagatcatcacggaaaccctgagggtagtgcgcgacatttggaaaaagcatgcctacaaaacaatcaacaaggataatcagggaaacaattgcgagtcggagagcgaattaactgagattcacatagaactgggccgggacatgaaaaacaataagtccgagagacttaggatctcacgaattaacagtgagaacgaaaataccaacttgcgcatccggaagctcctgattgagttcaatgatccggaatttggtgtcgagaacgtgagacctcattctcccagccaacaggaaatcctaaggatatatgaggacggggttctgaaatccggcgtggagatcccagaatacgtcgataatattatcaagaaattcaaggagacagacgtgaaaaagcagccttcaaagagcgaagtactccgttacaaactgtggcttgagcaaaagtatcgctctccctacactaacgaagttattccattgggaaaactgtttaccaatgactatcagatcgagcacataattccccagtcccggtacttcgatgacagttttagcaacaaggtgatctgtgaggctgaagtcaatcagttaaaagagaacgaactcggctgcgagttcatcatgaataacgggggaagaattgtggaactgtctttcggtaagacagtcaggatacttgattttgaggcctatgagcaattcgtgcagcagaattacgcaggcaaccgacctaagctgcggaatttgctcatgaccgaaatcccaaacgactttattgatcgccagctgaacgactccagatatatctcaaaagttgtgaaggggctactgagtaatattgtaagggaggatggagaagccgagagcacttcgaaaaacctcatctcctgtacgggcggtgtcacagctcggctgaagatggactgggggcttaatgatgtgtggaacaatttgatatacccgcgattcgagagactgaacgaattaaccaattctaaccaatttggctactgggacaaaaaggatggaaagaatgttttccagactcaggtgcccatggacatccagaaaggctttaacaagaaacgcattgaccacaggcatcacgccctcgatgcactggtcatcgcgtgcgctacccgtagccatattaattatcttaacaatgagtcagccaagagtaactccaaagaatctcggtacgacctgagaaggaagctacgccgactcgaggtgatccaaaaagaatatacaataaatgggagaaaggagattcggaacatcgaggtagcaaaggagttctacaaaccttggaatagctttacccaggatgcccagtccgctctggaaaacatcgtggtttcattcaagcaaaacttgagggtcattaataaaactacaaactattttctgcgcttcaataaggaaggtaaaaagatcttcgagacgcagaccagcggaagtaactgggccatacgtaagccattacacaaagacactgcatttggcctcgtgaatctgaagagaacaaaaaccgtgtctcttgctaacgccattctggattacgaccagatcgtcaatcggaagttgtggacaaaaattaaggaactcatctccatagggtatgataacaagaggattctgaaatacttcactgacgataaggagaattggaacgagatcatcagctcgggaattgaagtgttttactataccgacaatttcgagaaacaggtggcgacgcgcaagcccctagatacctcatttacagaatctaaaatcattaacagtataactgacctgggcatccacaagattcttctcgcccatctgcgagctaatgagggtaaccctaatatcgcattctccccagaagggatcgagaccatgaacagacacatttgtgagttgaacggcggaaagtttcatcaccccatatacaaagtgcgggtacatgaaccgctgggctataagttcaaagtcggggataagggaaataggagcacaaaatacgtggaggccgctaagggcactaacttatttttcggtatctatattaattctcaagggatccgcagctacgaaaccattcctctcaacgttgccatcgagagacagaaacagggactgtccccagtgcccgacaataacgagcttggcgaaaggctgttgttttggctctcacctaatgacctggtctatctacccacgagtgatgaggtggaaagcggtatatgctgcaacaagctgggcatcgaccggatttacaagatggtttcttgtacagggtacgtgggagatttcatcccagcacacattgcgaatcctatcatacagacccttgagctcggctccaacaataaagcccaacgtgcttggactggggaaatgattaaggagatctgcattcccgtaaaagtcgaccgcatgggaaacatcgtggagatatttaatcgaaacaagaattga

SEQ ID NO: 3455 - RNA, 4695 nt, synthetic construct
  misc_feature 1..4695: note = Cas9 variant
  source 1..4695: mol_type = other RNA
atggccaagatcctgggcctcgaccttgggaccaacagcattggatgggctatagtggatgacaaaaattccaagatcctggatacaggtgtcagaattttccccgagggcgttgtggcaaaaactatcgggtctggagacaaggaagagagtaaaaacgccaagaggcgggaatcacgccagacgcgacgtggcttttacagaaagaggttgcggaaaattaagttactgcgcaccctaatcaatttcaaaatgtgccctctcgagcactttgaactggatgtatggagcaagtgggacaaaataaagaagaaagagggtagaatggcgccagagcttttcctgccggaaaactccgcttataatttgtggctcaagcaaaacccctacatcctgagggataaagccctgtctaaggacctcacattaactgagtttgggcgggtgctgtatcatcttattcagcgccgaggattcttgtcgaatagaaaaggcaaggatgacggcaaaatctacgggggaaaggaaggtattgtcggcatcgataagaccaacgagcagattaaaaattcaacactggggaagtttctattcaaaatactccctaaggagggagaaccatttaaaatcattgaggacgaactgggcaacgagcttagggtgcggagccgttataccctgcgcgatatgtacatcgcagagttcgaagccatctggaatagacaggctaagcacttgggtctcgacaacatttattacagtaatgttaagaacgtgctgttaaaagggtccctgaagaataaaaagaacgagaggaaaataaaccatctcaagaagatcaaaggaaatggcaacattgaaatcataactcttaataacaatctgtctaagaacgagaaacccaagtacttgctaaaaattgcaacaaagctgcctctcaaggaatttctggccggccggatcgagaaagacgaagatgggaagatcaaattcaagagcaatgagtccgtcttgttttggcaacgaccactgcgctcacagaaaaagttgctcgctaaatgtagattcgagcccgacctgaaggatgacaacggaaagttcattcagaaaggtaagaccccttgccacttaagtcatccactgtatgaagagtacagggcctatcagtacgtgaataacatcgaatatggcaaaaagcaacggctagaggaaagccagcgcaaacaggtaattgatctcataaattctaaggacgggaactttaagttctccgagatcaaaaagaaactgaaactttcatacgagacgtttaattatagcgatgacagttctgttaacggaaattacatgattaaaaacttgaactccatcttcccgaaggaaatcctggagaaggaatttgtggtcaatgtgaacaaagaggatattatagagtacggctatgaaagaatctggcacctcttccacttttgtgaggacaatgatgtgctgattaagaaacttcaggacaacttcgacctgagcgaaaatgatatcgagaagatttcgaaaatcaacttgaaggaaggttactctaatgtctccctcaaggcgatcaaaaacatactgccctatttaaaggaggggaaactgctatcagacgcagttattctcggcggagtgaggaatgtatttggcaagaaatggcatgagttcatcgattttcacgaaaagattgagaaagacatcctgtacataaaccatcaaaagagtaataaggaaggggaggccattgagaaaatcaagaaatatcttattgattacaagttcggatttactgaaaacgacaatcgtttcaaaaagttgtatcaccacagccaggatgtggtcgaggtgaagctgcagaaaaagatcggtcctgttgaagacctccggaacccaatagtgcaacagggcgtcaatgaggtgcgaagactggtaaacgaattactggatgttcatgggaaattcgaccaggtgagggtcgagcttggacgcgatttgaagaacaataaatccaagcgggaagagatcggctacaagattagagagaacaccgctaaaaatgaaaaggccaaagagctcctgatcgaatacggtctaaggcagtctcgcgacaacgtgcaaaaggtcctgctctttcaggagatgctggatcgagggacagtggcagtttgcccctatactaataaaaccattaacatcagcgacgtgcttggcaatgagaacaagatgcagatagaacacattatccctaagtcaatcagtttggacgattccttcgctaataaaacactgtgtgacagcaagtttaacggattaaaaggcgagcggaccccatacgagttctatcagattaataacgatgccaatctctggggagggtctaagtcatgggaagaaatcgagcgtagaacgtttaggattctgccctacagtaaagcgaagcgcttcactagcaagacaaaatttgagaccaacgacttcatacaacggcagcttaatgatactagatatatctccaagaaaacaaaggaaattctgtctcagatctgcgaggacgtaagggtcatgccgggttcgttgaccgccgaactccgaaaactgtggggcctaaacaacattctgcatcctgcatttgtgctcgatctgcccgcccttcacatcgacgctaataagcatataccacactacgttgtgttggatgaggacaacgtccctatcctgagccagcgcatttataatgataaacccatcttaaaggctaaccaaacgtccattaccgggttcgtggacaatgaaatctttaagtcaaaagagaagtacgtaaaattcgaggtgaaggccccaaacctcagtaatggagaatactgggcaaaactgcttctgtctaaccccaagagcatagttcgggtctttaaggagaaacctaagtccacagaaaatgagattgtggtgagaggcaaaatcgaaaaggagaaattcaagcacgagggtctatcagggatcaacgccgaaggcaaggagaatggaacttattgggctaaactcagcattgtcgataagaaattcaagaaaccaaagaaggacgaccagccgaaaaagaacggcaaacagatactgttgtttggggcggttaaggaaggagtgttctcttcctacatgtatgagtgtgatgcagacctggaggatggcaaatactggttaatcctcgacattgattttgaaaatgtggagttcgaaaaggccctgaacgagaggcccgaagtacttgagaatcagatcctgattcaaggtatcaccaacgacgagaatgtctttgtgagtgatatggactgccagcatcagttcttgatgaacgaagggaaaggaaagtattacgttctctttgatataatcagcgaggtgaacgagttctatcctattaagacaaaatctccagaactggaaaatggccaatccctaactgagggtaccatctgggtcgacaagtacacaggcgagattaaatttgatcccaagaaaaaccgtgaagaccaccgccatcacgctatcgacgccctggtgatagcacttaccaaggagacttacttccagcagctctcacggagaaatgccagtagcgaaaacaagaaaagggggaatgagtatgaaaaggagcagctggattttgctgagccttggaaagagttccacgttgacgcccaaaagtcgattaactccatcttgatctctcataaacagaataagaacattctgacgaagatcacaaagaagataaccaaaaatggaaagacttacaaaagcgaaggcatgtcagtgcgagggcagttacacgataagacctattacggacataacaagaattgtaaagcagacgaatatgtataccgggtcgatattaacaatctcagtttctcccagctgacaaacatcattgaccttaatctgaaggcggtgatcgtggagggcgtcattaaaaagtttgaggaatctgagaaacttctcttcaagaaaatgaacagcaaggttcaaaacctggataagtccaaagtgaagaaaataaaggctaaagtagacaagatcctaaaggaaacctcatttttcatgccaaatgagggtaaacgctatatcagactgaacattatcgaacccgccaattttgagaggatgccggtgcctattaagaaagtccggatacgaaaggtgcttagaaacgcagagaaactcaataacgaaatcaagcagttcgttgatccacagaataaccaccatgtgctgatttacaaggacgagaatgggaacttgaaagaagaggtcgtgactttttggacagttgtggaacgcaagaggacgggagagcccgtctacaaattacctagcgatggcaagaaaatcgtaaccactctgcagatcaatgacatgttcctcctgggtcttaacgaggatgaaattaattgggagaaccccaattataaccacctgaaggaacacttgtaccgtgtgcaaaagtttacaagtggcgacttctattttcggatagccaaaacctcttccatccagaacggggaggaaaagcagcaaattaatagcttcggactaggcaaaaacgggtggctgacacataatccaatcaaggttaaaatttcggtgtcaggaaagatcctcaaggtctga

SEQ ID NO: 3456 - RNA, 4713 nt, synthetic construct
  misc_feature 1..4713: note = Cas9 variant
  source 1..4713: mol_type = other RNA
atggagaacagcaataactcctctaagaaatactatctgggcctcgacatggggaccgattcatgcggatggtgtgtgacagacgataagtacaatatcattagaagtcacaaaaagatatatggtcccgacggcaaacttgtcaagagggaagggtgccatctgtggggaagccggttgttccgccctgccaacactgctaagtcccgacgtttaaatagaacggcaaggcggcgcctggccagaaggcggcgccgaatcattctactcagagagctgtttcagccagaaatcgataaagttgacccgaacttctttaggcggcttgatcaatctaatctgtggaacgaggacaaggataaagaattgcagatggagcacaatttcctctttaacgacaaggatctgaccgacaaagagtactataaggatttccccacaatttaccatctgcgtaaggcgatggtgaatggcctcactatcaacggttattactacgaccctaaaaagcagtttgacatacgcgaagtatatttagtgctggctcacatgatcaaatacagagggaatttccttatggagggagatgtcaaggactcggtggttgatccaacctatttgaaacagtgttttgacaacattgatgtgatcctgatttcactaaataacggcgaagacgatgagaacgaggacgataagatcgaccccagcgaatgctgtttcaatgtcgatgagaaaaaggccaggaagctcgcaaacaattttcaagaaacaaacaaagtgagtgacctggaggacgatgaacgggaccttttcggcaagtttaattccaaagatatacgaaagaaaattctgaagttgatcaacgggggatctggtgtaaagctcaaagacttcctgcctaaggagattttagttgcccatgatggcgacgatgagtacggggacaaaaagatcgatctgagctccgaaaccctcgaggacgatatcaatggatattcacttccagaaagttacgtggagattatactggaagctaaaaagatctatgacttcaagactttggcatacctactgcacggcaaaagcctcctgtgcgatgccatggtcaacgtgtacgaggagcacaaggaacagcttgctgccctgaaacgcttgtataagaaatacgcgacaaaggagcagtattactttatgttcagagactctaggattctcgacggtgatgactccgatgacgaagaggataaggaagagtcaaataaagaggaaagcaaggacaaaaagaaaaaggcaagttatgtgtcttacatcgggtataccaaaacgaactccaaggccaagtacactggagctcatataaccagcgagaaaaatatttcggccctgatcaagcagatcaaagatgacttaaagtttgatgacctgaaatctaaggtcgatgacccctcccaacagaacgaactatcagatgaggacaagctcgacattcagtgtatcgaggaagcaattgagagtaatacattcctgcctcggcagaacagccgcaataacggcgcttttccataccaacttaacttgaatgaaatgagaactataatcgagaaccagtccaaatattacccgttcctgaaggataaagccccctcttttcctgacggcaagaccgaagagtataaaattgttagcctcctgaagttcaagatcccatactatatcgggcccctttcacagcctaatgattacgtgagggacgataaacgtgacaaccactgggtacaatttcggggagagaataaccagggtattataaatccatggaacttcagtcagatcgtggatctggaaggcacagcggacaagtttatttccaatttgaccaactattgcacgtacatcttcggggagaatactctccccaaagaaagcctgatttttcaggcctacaaggtcttaaacgatctgaataacctaaaagtgaatggatctctcatctcaaaggaggacaaggattatataatccaaaacgtttacctgaaaaagaaaaagattaaaggcaaggacatcgtgaacgcacttaaaaataagtataagttgagtgacgaagatccgacagtcaccactaaaggtagcgggaagtccattggcgaggacgaggtggatctgacaatgttcaactcttcgctcagctccttcatcgacatgtcagatcctaatgcttttggacccgagttctacaaagacagtaacaagtttgaactggccgaaaaagtaatagagttaattaccatcgttgaagataaggacctgcttaaggagcgattgaaaaagctcggcctgtctgataatcaggtgaactatctattcaaacagaagtacagcgggtgggctccactgtccagaaaactcctggacggaattacgatcgattgtgtcaatgagaacaccggtgaagcctatcctgtgacaataatcgacgtcatgagggatactccccttaattttatggagatttacgaaaccaaggagtcacagttcagcggctttaaggagaaagtggcagaattgaacgacgagaagaaactgtctcgcgacgatttaatcgaagagtcctacgccagtccagctatgaagcggagcgttagacaaacattcaaagtgattgacgaactcaagaatactctgaacatcgatcattttgacaggatattcgtagaggcgacccgcgcacccggggaggccggaaagatggtcaaatctcgaaagaaacagcttcaggaggcttatgatgccgcaaaggacctggtggatcaggaatcccgggacgatttgcaaaaactccgtgacgatctggaaaagcagacagacgatcagctaagaaggaagaaagtttacctgtattttatgcagctcggccgctcagtgtacagtggtgagaagattgacctgaatgaacttgacaaaaactatgatatcgaccacatcattcctcaagccaagttgaaagatgacagcttcaataacatggtcctggtggagcgggagttaaacaataagaaacaggatgaatacccaatcccgtcgaccattatatccgagcacgggagaaactggatccagaagctcgctaagattcaagacaaaaataagaggtcttattttatgcccaaagataaggccaaccgactgcttcgccctgaaagcaaacagctgacttcagacgagctaaatggcttcatcaaccggcagctcacgctgacaaatcagagtgtaaaggcagtgtgcgatattttgaagatgaccgaaaaaggatccgagatcgtttactctaaggcgaacttcgtcagcgactttagaaaactgtgtggcgagttaaggccatcctacgatgctttcgtgaaggtgcgtgacataaatgactttcatcacgccaacgatgcatatctcaatatcgtcgttgggaacgtgtactatgaaaaattcaagaatttttacattaacaatcgcatcgactatgataacaatggaaagaaagacctgtcagtgcttgccagcaagctgttcactaaaacccaagctgatgacaagacaggtaacatttactgggaggcccggtttcataacgaaaaagagaccgatagtaatggcaaggagagaactatcaaggtaagggacgaagggacagagtctacgttcgataaaatagaatattacatggagttgaacgaccccctcgtcacccagatgcagtacactctgtccggaaagcagggctttttcaaaaagattacactaaaaaccaaggcaaaagataatgaagacaacagcgataagctgtttcctcttaagcaatatctccgatcggactcaaataaagtgatggacgttaacaagtacggtgggtattctgatatgatcacaccatacttcatgctggtgcagagtgagggcaaaaagggaaaacacatctattccttggagagcattcccactatatacctgaagtctttcaagaaaaaggaagaggacatcattaattatttaagctgcaaaaacaagctcaaaaatccggtcgtgatctccgataagctgcttatgcggaccattgttaagatcccttactttaaaaacgactcaaatctgagtttggtgaagctcggcacgagcgggcgcaccggaaacaatataatctacattaacctgtctgaactaatcctgccaattgagtggaaaaattattacagaaagatctccaaccttctcggcacaaacgtatcaagtactaaacccaaggatctgagcaagttcaccgaacagatgaaaaatgaccctacatccactttggtcgatggttctaacaaggtggagcatgacaaaaataacaggtttttctcgtatttaataaataacgtgattaataagcccatctttgaggggctgccaaaaaccagctgctcattcatcaagctcgaatccaaatacgatgagttttgtagtctgaacacgcttgaacaggctaagattatcgccacaataattaagctgttgtcttgcaaaagcgtccaaggatgtaagctatccaatctgtcaggcctcccttctagcctgggtgcgcttatcagtaacaaagccttaaccgagggcactattatctccaaggaaagctcttgcgggctgaaagagaatataattttcgttgtgcccaacgactga

SEQ ID NO: 3457 - RNA, 5067 nt, synthetic construct
  misc_feature 1..5067: note = Cas9 variant
  source 1..5067: mol_type = other RNA
atggagttcaagaaagtgctgggcctcgacatcgggaccaacagcattggatgcgcccttctgtccttgcccaagtctatacaggattacggtaaaggcgggagattagaatggctgacatcaagggtcatccctctagacgctgattatatgaaggcatttattgacggaaaaaatggcctcccacaagttatcactccggccggtaagcggcgccagaagcgagggagtcgtagactgaaacacaggtacaagcttcggcgcagcagactgattagggtgttcaaaacgttgaactggctccccgaggattttcctctggacaatccaaagcggatcaaagaaaccatatccacagagggaaagttctcttttcgcatctcggattatgtacccatttcagacgaaagctaccgagagttctatagagagtttggctaccctgaaaacgagatcgaacaggtgattgaggagatcaatttcaggcggaagactaaaggcaagaacaaaaatccaatgataaagctgctccccgaagattgggtcgtgtattacttacgtaaaaaggcgctgattaaacctaccacaaaggaggaacttatccgcattatctacttgtttaaccagagaagggggttcaagagttcccggaaagacctgaccgagactgctatcctagattatgacgaatttgccaagcgactcgcagagaaagagaagtactctgccgaaaattatgagacaaaattcgttagcattaccaaggtgaaggaagtcgtggagctgaaaacggatggacgcaagggtaaaaagagatttaaagtaatacttgaagactccaggatcgagccatacgagattgaacggaaggagaagccggactgggaaggcaaagagtatactttcctggttacccaaaagttggaaaaagggaagttcaaacagaacaagcccgatctccctaaggaggaggactgggctctgtgtacaactgcattagataatcgcatgggatcaaaacatccaggcgaatttttctttgacgagctgctcaaggccttcaaagaaaagagaggttacaaaatcaggcagtatcccgtgaaccgttggcggtacaagaaagagcttgagtttatatggaccaagcagtgccaactgaatcctgaattgaacaatctaaacattaacaaggagatcctgcgaaaactcgctacagtcctgtacccaagtcagagcaagttctttgggcccaaaatcaaggaattcgagaattctgatgtgcttcacattatctccgaagacattatatattaccagagagatctgaaatcacagaagagcttgatcagtgagtgtaggtatgagaagcgcaaaggaattgacggcgaaatctacggcctcaagtgcatcccgaaatcttcccctctgtatcaagagtttcggatttggcaggatatacataacatcaaggtgattagaaaagaaagcgaggtcaatgggaagaagaaaatcaacattgacgaaacccagttatacatcaatgagaacataaaggagaaactgttcgaactatttaattcgaaggattctctctccgagaaagacatcctggaacttatttcattgaacatcattaatagtggaatcaagataagcaagaaagaggaagagacgactcacaggattaacctgttcgccaatcgcaaggagctcaaaggtaacgaaacaaagtcccgatatcggaaagtttttaagaaactgggcttcgacggggagtacatccttaatcatccctctaagctgaaccgtttgtggcacagcgattactcaaatgactatgcggataaggaaaaaaccgagaagagtattctctccagcctgggatggaaaaacagaaacggcaagtgggagaaatctaagaattacgacgtgttcaacttaccactggaagtagcaaaggccatcgctaatctacctcccctcaaaaaggagtatggttcatacagtgccctggcaataaggaaaatgcttgtggtcatgcgcgatgggaagtattggcaacacccagaccagatcgctaaagatcaggaaaacactagcttgatgctgtttgacaagaatctcattcagctgacaaacaatcaacggaaggtgttaaacaaatacctgcttaccttggccgaggttcagaagagatccacgctcatcaaacagaagctgaatgaaattgagcataacccctataaactagagctggtgtctgatcaggacctcgaaaagcaagtcctgaagtcgttccttgagaaaaagaatgaaagcgattacttgaaaggcctgaagacctaccaggcgggatatttaatctacggcaaacactccgagaaggacgtgcctatagtaaactcaccagatgaactcggggagtatattaggaagaaactgccgaataacagtcttcgaaatcccatcgttgagcaggtgatccgcgaaacaatttttatcgtccgggacgtgtggaagtctttcggaattatagacgagatccatattgaactgggtagagagttgaaaaacaacagcgaagagaggaagaaaacttccgagtcacaggaaaagaattttcaagagaaagaacgtgcccgcaagctcctgaaggagctactgaacagctctaatttcgagcactacgatgaaaacggcaataaaatcttttccagtttcaccgtcaaccctaatccagacagccccctcgatattgagaagtttcggatctggaaaaaccagtctgggctgacagacgaagagcttaataagaaattgaaggatgaaaagatacctactgagatcgaggtgaaaaagtatattctgtggttaacccagaaatgtagatccccatacacaggaaagatcattcccctctcaaaactgttcgacagtaacgtttatgaaatcgagcacataattccgaggagcaagatgaagaatgattcgaccaacaatcttgtgatctgcgaactgggcgtaaacaaagcaaagggtgaccgactagctgccaattttatctccgagtctaacgggaaatgtaagttcggcgaagtcgagtacactctcctgaaatacggagattatttgcagtactgcaaggacacgtttaagtatcaaaaagctaagtacaaaaacctgttagccacagagcctccagaagatttcattgagcggcagataaatgacacccgctatatcggcagaaagctcgcagaactgcttactcccgtggttaaagatagcaagaacattatcttcaccattgggtcaatcacaagtgagctgaaaataacctggggattgaatggtgtgtggaaggacatcctcaggcctcggtttaagcgactggaatccattatcaacaaaaagctaattttccaggacgaggatgaccccaataaataccattttgatctgtctatcaacccacaacttgacaaggagggcctcaaaagactggatcaccgccatcacgccttggacgctactataattgcggcaacaacgagggaacatgtccgttatctgaatagcttaaacgccgctgataatgacgaggaaaagcgggagtacttcctctccctgtgtaaccacaagatcagagattttaaacttccttgggagaatttcacctcagaagtgaagagcaaactgttgagttgcgtagtgtcttacaaggagtccaaacccatcctcagcgacccatttaacaagtatctgaagtgggaatacaaaaatgggaagtggcagaaagttttcgccattcagatcaagaacgataggtggaaagcagtccgccgatcgatgtttaaggagccgataggaactgtgtggattaagaaaatcaaggaagtgtcactaaaagaggccattaagatccaggctatatgggaggaagtcaaaaatgaccctgttagaaagaaaaaggagaagtatatttacgacgattatgcccaaaaagtgatcgcaaagatcgtgcaggaactgggcctttctagttccatgcggaaacaggacgatgagaagctcaacaaattcattaatgaagcgaaggtaagcgctggtgtcaacaagaacctgaatacaaccaacaaaacaatctacaatttggaggggaggttttatgagaagattaaagtggccgaatacgttttatacaaggcaaaacgcatgcccctgaacaagaaggagtatatagaaaaactctctctgcagaagatgttcaatgaccttccaaacttcatcctggagaaaagcattttggataattaccccgaaatcctaaaggagctggagtccgacaacaaatatatcattgaacctcacaagaagaataacccagtgaatcgtctcctgcttgagcatatattagaataccacaacaatcccaaagaggccttttcaactgagggcctggaaaagctcaacaaaaaggctatcaataaaattggaaagcctatcaagtatattaccagattggatggcgacatcaacgaggaagagatattccggggggccgtctttgaaacggataaaggaagtaacgtgtacttcgttatgtatgagaataaccaaaccaaggacagggagtttctgaaaccgaatccaagcatctctgtgctcaaggcaattgaacataaaaacaagatcgatttctttgctcccaatcgcctgggcttctcccgaattatcctttcacctggtgacctggtatacgtcccaacaaacgatcagtacgtgttgataaaagacaatagtagcaacgagactattatcaattgggacgataacgaatttatttccaatagaatctatcaggtgaagaagttcaccgggaactcttgttactttctaaaaaatgacatagcctcgctgatcctcagctattcagcgtccaacggagtcggcgagttcggtagtcagaatatttctgaatacagcgttgatgacccccctatccggattaaggatgtgtgcatcaaaataagggtagaccgcttaggcaacgtgagaccgctgtga

SEQ ID NO: 3458 - RNA, 3924 nt, synthetic construct
  misc_feature 1..3924: note = Cpf1 variant
  source 1..3924: mol_type = other RNA
atgacccagttcgagggctttacaaacctgtaccaagtgagcaagactctcagattcgaacttatcccccaggggaaaacgctgaagcacattcaggagcagggatttatagaagaggacaaagccaggaatgatcattataaggaattgaaacctatcattgaccggatctacaagacctatgctgatcaatgcttacagctggtccagctagactgggagaacctctccgcagccattgattcttaccgcaaggagaaaacagaagagactcgaaatgcgctgatcgaggaacaggctacctatcgtaacgccatacacgactacttcatcggtagaacagataatcttaccgacgcaattaacaagaggcatgccgagatctataaaggcctgtttaaggctgaattgttcaatgggaaagttctcaagcaactgggaactgtgacaaccacggagcacgaaaacgcactgctccggtcatttgataagttcactacctactttagtggcttctacgagaatcgcaaaaacgtatttagcgccgaagacatttccacagctatcccacatagaatagtgcaggataatttcccgaagtttaaagagaactgtcacattttcactaggttaatcaccgccgtcccctctctgcgggagcacttcgaaaatgtgaagaaagcgattggtatctttgtttcgacatcaatcgaggaagtgttcagctttcctttctataaccagcttttgacccagacgcaaattgacctgtacaatcagctactcgggggaataagtcgcgaggcaggcactgaaaagatcaaaggcctgaacgaggtccttaacctggccattcagaagaatgatgagacagctcatatcatagcctccttgccacaccgatttattcccctcttcaagcaaatcctgtctgacagaaacacccttagctttatcctggaagagttcaaatccgacgaagaggtgattcagtcattttgcaagtataaaactctccttaggaatgaaaacgtactggagacagcagaggctttgttcaatgaactaaacagtatcgatctgacccatatttttataagccacaagaaactcgagacgatctcttccgccctgtgtgaccactgggatacccttcggaatgcgctgtacgaacgtcgcatttcagagttgacagggaagatcactaagagcgccaaagagaaggttcagagaagtctcaaacatgaagacatcaacctgcaggagattatatctgcagctggaaaggaattatccgaggccttcaaacaaaagaccagcgaaatcctgtcgcacgctcatgccgcactagatcagcctctcccaacaactctgaagaaacaggaggagaaggaaattcttaaatctcagttggactccctgctcggtctgtatcaccttctggattggtttgccgtggacgagtcaaatgaagtcgatcccgagttcagtgctaggttgaccggcatcaagctcgaaatggagcctagcctgtccttctacaacaaagcgcggaattatgcaacaaagaagccatactctgtggagaaatttaagttaaacttccaaatgccgaccctggccagcgggtgggacgtgaataaagaaaagaacaatggagctattctatttgtcaaaaacggcctctactatctgggtatcatgcccaagcagaaagggcgatacaaggccctttcattcgagcctactgaaaagacgagtgagggatttgataaaatgtattacgactatttcccagacgcagccaagatgatacccaaatgctccacacagttgaaggctgttaccgcccattttcagactcacaccacacctatcctgctcagcaacaatttcattgaaccactggagatcaccaaagagatttacgatttaaacaatcccgaaaaggagccgaagaaatttcaaactgcatatgcgaagaaaacaggcgaccagaagggctaccgcgaagctctgtgtaaatggatcgatttcacgagagactttctttctaagtacaccaagactacatcaatagatttgagtagcctcaggccttcctctcagtataaagacctgggggagtactatgccgagctaaaccccctgctctaccacatttcgttccagcggatcgcagaaaaggagattatggatgccgtggaaaccggaaaactgtatctttttcaaatctacaataaggacttcgctaaaggtcatcacggcaagccaaacttgcatacactgtattggactgggttattcagccctgagaatctcgccaagacctccataaaactgaacggacaggcagaattattttaccgccccaagtcaagaatgaaaaggatggctcaccgtctgggcgagaagatgttgaataaaaagctcaaagatcagaagacgccaatccccgacaccctgtaccaagagctatatgattacgtaaaccaccggctgagtcatgacctctctgatgaagcccgagcgctgcttcctaatgtgattacaaaggaggtcagccacgaaatcattaaagacagaaggttcacttccgacaagtttttctttcatgtgccaatcaccttgaactatcaggccgctaattcaccgagcaaattcaaccagcgcgttaatgcatacctgaaggagcaccccgaaacacctataattggtatcgatagaggggagcggaacttaatctatattactgtgatcgactctaccggcaaaattctcgagcagaggtccctgaacacgatacaacagtttgattaccagaagaaacttgacaatcgcgaaaaggagcgagtcgccgctcggcaggcctggagtgtggtaggaacaatcaaggatctgaaacaaggctatctaagccaggttattcatgaaatcgtggacctcatgattcactaccaggcagtcgtggtcctggagaacttgaatttcgggtttaagtctaaacgtaccggaatcgcggaaaaggccgtgtaccagcaattcgagaagatgctgatagataaattaaactgcctcgttctgaaggactatccagctgagaaagtgggtggcgtacttaatccctaccagctgactgatcagtttacatccttcgccaagatggggacccaatcaggattcttgttttatgtccctgcaccatacaccagtaaaatcgaccccctcactggcttcgtggatccgtttgtttggaagacaattaagaaccacgaaagcagaaaacatttcctggagggttttgacttcctacactatgatgtgaagacgggggactttatcctgcatttcaaaatgaataggaacctttcgtttcagcgcggcctccctggattcatgccagcttgggacattgtctttgaaaagaatgagacccagttcgatgccaaaggcactccctttatcgcagggaagcggatagtgcctgtaattgagaaccacagattcacaggaaggtaccgagacctgtatcccgccaatgaattgatcgctctgttagaggaaaagggtatcgtgttccgcgatggctccaacattctcccaaaactgcttgagaatgacgattctcatgcgatagacaccatggttgccctgatccggagcgtcttgcagatgagaaactcaaatgcagctacaggggaagattacattaacagtcctgtgagggacctcaacggagtgtgttttgattcccgtttccaaaatcccgagtggccaatggacgccgatgccaacggcgcttaccacatcgcactgaagggtcagctactgcttaatcacctcaaagagtctaaggacctgaaattgcagaacgggattagcaatcaggactggttagcctatatccaagaactgcgcaactga

SEQ ID NO: 3459 - RNA, 3903 nt, synthetic construct
  misc_feature 1..3903: note = Cpf1 variant
  source 1..3903: mol_type = other RNA
atgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaaaagttttaagggctggaccacatatttcaaagggtttcatgaaaatcgcaagaacgtgtactcctcaaatgatatccctactagcattatataccgaatcgtagacgataacctgccaaagttccttgagaataaagcaaagtatgagagcttgaaagacaaggccccggaggctattaactacgaacagatcaaaaaggatctggcagaggagctaacctttgacatagattataagacatctgaagtgaatcagcgtgtcttctccctcgacgaggtgttcgaaattgccaactttaacaattacctgaaccagtcaggaatcaccaaattcaatactatcattggcggtaagtttgttaacggggagaatacaaaaagaaagggaatcaacgaatatattaatctttacagccaacagataaacgataaaaccctgaagaagtataaaatgagtgtgttgttcaagcagatcctctctgacacggagtccaagagctttgtcattgacaagctggaggatgactcggatgtggtaactaccatgcaatctttctacgaacagatcgctgcctttaaaacagttgaggaaaagtccatcaaagagactttatcactcctgttcgacgatcttaaggcgcagaagctggacttgagtaaaatttactttaagaatgataaaagcctaaccgacctgtcccagcaagtgttcgatgactattctgtcataggcacagcagtgctcgaatacatcacccagcagattgcccccaagaacctggataatcctagcaaaaaggagcaggagcttatcgctaagaaaacggaaaaggccaaatatctgtcattggagactattaagctcgcactggaagagtttaacaaacacagggacatcgataagcaatgtcggttcgaggaaatattagctaattttgccgcgatcccaatgattttcgacgagatcgcccagaacaaggacaatctggcacagattagtatcaaataccagaaccaaggcaagaaagatctactccaggcttccgccgaagacgatgtgaaggctataaaagacctgcttgatcagacaaacaatttgctgcataagctcaagattttccacatcagccagtctgaggacaaagccaacattctggataaggacgaacatttttatcttgtcttcgaggagtgctactttgaactggcaaatatcgttcccttgtataacaaaatacgcaattacatcacccaaaagccttactcagatgagaaattcaagctcaactttgaaaatagtactctggccaacgggtgggacaaaaataaggagccagataacacagctattttattcatcaaggacgataaatattacctgggagtgatgaataagaaaaacaataagatttttgacgacaaagcgatcaaggaaaacaagggtgagggctataaaaagatagtatacaaactactccccggggcaaataagatgctgcctaaagtgttctttagcgccaagtccattaagttctataacccatctgaggatatccttagaatcaggaaccactcgacccacacgaaaaatggaagcccgcagaagggctacgaaaaatttgagttcaacattgaagactgtcggaagtttatcgatttctataaacagtccatttcaaagcatcccgagtggaaggacttcggttttcgcttcagtgatacccaacgatacaattctatagacgaattttacagagaggtcgagaaccaggggtataaattgacattcgaaaatatcagcgagtcctacattgattcagtggttaaccagggaaagctgtatctctttcagatctacaataaagacttcagcgcttattctaagggcaggcctaacctgcacactttatactggaaagccctgtttgatgaacggaatcttcaagacgtggtctataagttgaacggcgaggcagaactcttctaccgtaagcagtccattcccaaaaagatcacccatccagccaaagaagctatagccaataagaacaaagataatcctaagaaagagagtgtgtttgaatacgacctgatcaaggacaagcgcttcacagaggataaatttttcttccactgcccaattactatcaactttaagagctctggggcaaataaattcaacgacgaaattaacctactgctcaaggagaaagcgaatgatgtacacatcctgtccatagacagaggagagaggcatcttgcttattacaccttggttgatggtaagggcaacattatcaagcaggacacatttaatatcattgggaacgatcggatgaaaaccaattatcacgacaagctggccgcaatagaaaaagatcgagactcagcccgcaaggattggaaaaagatcaacaatattaaggagatgaaagaaggatacttaagtcaggtggtccatgagatcgctaagctcgtgattgaatataacgccatcgtcgtgttcgaggacctgaattttggcttcaaaagaggtaggtttaaggttgagaaacaagtgtaccagaaacttgaaaagatgctgatagagaaattgaactatctcgtattcaaggataatgaatttgacaaaactgggggcgtcctgcgggcataccagctaacggctcccttcgagacatttaagaaaatgggaaagcagaccggcatcatttactatgtgccggccgggttcactagcaaaatctgtcctgttaccggatttgtgaaccaactgtaccccaagtatgaatcggtctccaagtctcaggagttcttcagcaaatttgacaagatttgctacaatctcgataaaggttatttcgagttttcattcgactacaagaactttggcgataaagcggccaaggggaagtggacaatcgctagtttcggatcccgcctgataaattttagaaactctgacaaaaatcacaactgggataccagggaagtgtatccaactaaggagcttgaaaaattgctgaaggactacagcattgagtacggccatggtgagtgtatcaaagcagccatctgcggggaatccgataagaagttctttgctaaattaacatcagtactcaacacgattctgcagatgcgtaatagcaagaccggcactgagcttgactatctgatcagtcctgtggccgatgttaacggaaatttctttgactctcggcaagcacccaaaaacatgccacaggatgcggacgccaatggcgcttaccacatagggctaaagggactcatgctgttgggtcgaattaaaaacaatcaggaaggcaagaagctgaacttagtcatcaaaaatgaggaatatttcgagtttgtgcagaacagaaataactga

SEQ ID NO: 3460 - RNA, 1341 nt, synthetic construct
  misc_feature 1..1341: note = Cpf1 variant
  source 1..1341: mol_type = other RNA
atgaagcccgacatcaaagatagagagtacatgtataggctgattataggccaactcttctacgacgggcaccagcagatcgccgtgaaccttgctaataccctgggatgcagcgcacctccaccgcccccttccgataagttgtttcggttagtcacaattgccaaacagttcgttgaagacccagattataaggcggaggaaaacactatgcccatgcagtttgagacgtcttcagctggtctggacctacaatacgatgccgacgtggcagccaccagtcctgaaccaagccagtatgagacaatctacctcactgtacataaagctccctgtcgcgcagccgctttcaattccgatggctctctgattgccaccgggtcggcggactgctcaatcaagataatggatgtggagcgaatccttgcacgtgaaaaggagcacagagaaatgaacgagaatggacctgacgcccatcacccagtcattaggacactgtatgatcatgtggacgttcggcgcgactttggcagattcagcgataaaatcttggactttcaggatgtgaacaccgtcattttccacccgagggacgctatcctcataagtggttccaatgataagactgtgaaactgtttgacttctctaagacagccgtaaaacgggcaatgaagaccctgagcgaggtttaccccgtgcgcgctctctcctgtcaccctgggggagaatttttactggtcgccacggatcatccaactgtgcgactttacaacattgagaccgcgcaggcctatgcatcagctaatcccgacgatcaacacagagaaagtgtgacagacgtccattacagcgagaacgccaggttgtatgttactgcttctaaggatggcgacgtgaaagtatgggacggcgtgtcctcacggtgcgtcgaaaccttcaagcgtgcccacgatgggagcagtatctgttctgcaaaatttacaaagaatggaaaatacattctgacctccggtatggacagcatcgtgaagctatgggagctctcgacgaaccgctgcctgatcgtttatactggcgccggggctacaggagcgcaggattaccctacctctgcatccttcaatcagaacgaggacttcgtgctttttccagatgaaaaatcaggcagtatgtgtagctgggaggccagaaatgctgacaggaagcggctgttggccctcggtcacacttccgcatgccgaacattcgtccattctcccagcatgccggcctttatgaccgggtcagatgaccaccgcgctagattctggtataggaagcctacgaccaacgataactga

SEQ ID NO: 3461 - RNA, 1293 nt, synthetic construct
  misc_feature 1..1293: note = Cpf1 variant
  source 1..1293: mol_type = other RNA
atgaagcccgacatcaaagatagagagtacatgtataggctgattataggccaactcttctacgacgggcaccagcagatcgccgtgacccttgctaacacactgggatgcagcgcccctgcaccaccgccctccgataagttgtatcggttagtcactattgcgaaacagtttgttgaagaccctgattacaaggctgaggaaaaatctctgccaatgcagttcgagacggtgtcaaccggtctagacctcgaatatgatgccgacgtacaacccgtgagtcctgagccaagccagtacgagacaatctatctgactgtccataaggcaccctgtcgcgccgctgcatttaattccgatggctctcttgtggccaccgggtcggctgactgctcaattaagatcatggatgttgaacgaatactggcccgtgagaaagaacacagagagatgaacgagaatggacctgacgcgcatcacccagtgatcaggacattgtacgatcatgtcgacgacgtgaacaccgtactcttccacccgcgggatgcaattctgatcagcggcagtaatgacaagactgttaaactgtttgatttctccaagacagccgtgaaacgcgctatgaagaccctctctgaagtctaccccgtgagagccttaagctgtcaccctggtggggagtttctgcttgtggcaacggaccatccaactgtcaggttgtataacattgaaaccgctcaggcctacgcgtccgccaatcccgatgaccagcaccgggagtcagttacagatgtgcattatagtgaaaacgcacgcctgtacgtaactgctagcaaggacggagatgtgaaaatctgggacggcgtctctaatcgatgcgtggagaccttcaagagagcccacgatggctccgctatatgttcagccaaatttacaaagaacgggaaatatctactcaccagcggaatggacagtattgttaagctgtgggagctttctacgaataggtgcctgatcgtgtacactggtgcaggcgccacaggggctcaagactatgcgacctccgcaagtttcaaccacaatgaagattacgtcttgtttcctgacgagaaatcgggatctatgtgttcctgggatgcccggaactcagaccgtaagcgcctcctggctttaggccatactagcgcctgcagaacattcgtgcacagcccatccatgcccgcatttatgaccggttctgatgaccatagggcccggttctggtaccgaaagccggctacgaccgataattga

SEQ ID NO: 3462 - RNA, 3690 nt, synthetic construct
  misc_feature 1..3690: note = Cpf1 variant
  source 1..3690: mol_type = other RNA
atggccgctagcaagctggagaaattcaccaactgctactccctctctaagacacttagatttaaagcaatccccgtgggcaagactcaggaaaatattgacaacaaaaggctgttggtcgaggatgaaaagcgggccgaggactataagggggttaaaaagttactggatcgctactatctatcattcataaatgacgtgctccacagtatcaaactgaagaaccttaataactacattagcctgtttaggaaaaagacgcgtaccgaaaaggagaataaagagttggaaaacctcgagatcaatctgagaaaggaaattgcgaaggctttcaagggagccgcaggttataaatccctgtttaagaaagatatcatagagacaatcctccctgaggccgctgacgataaggacgaaattgcattagtaaactctttcaatggctttactaccgccttcacagggtttttcgataacagggagaatatgttttcggaagaggctaagtcaaccagcatcgccttccggtgtattaacgaaaatctgactcgctacatcagtaacatggacatatttgagaaagtggatgcgattttcgacaagcatgaggtccaagaaatcaaagagaagattcttaactccgattatgacgtggaagacttctttgagggagagttctttaatttcgttttgacacaggaaggcatcgatgtgtacaacgcaatcattggtgggtttgtcaccgagtctggagaaaagataaagggcctgaatgagtacatcaacctatataatgccaagacgaaacaggctctcccaaagttcaaaccgctgtacaaacaggtgcttagcgacagagaatccctgtcattttatggcgaggggtacacttctgatgaagaggtattggaggttttcaggaacaccctcaataaaaacagcgaaatttttagttccatcaagaagctggagaaattattcaagaattttgacgaatattcaagcgccggaatattcgtgaaaaacggtcccgcaattagtacaatctctaaggatatctttggcgagtggaatctgattcgggacaaatggaacgctgagtacgatgacatccacctcaagaagaaagccgtcgtgactgaaaagtatgaggatgaccgccgaaaatccttcaagaaaattgggagcttctcgcttgaacaactgcaggagtacgcggatgccgacttgtctgtggtcgaaaagctaaaagagataatcattcagaaggttgacgagatctacaaggtgtatggatcctcagaaaaactgtttgatgcagacttcgtactcgagaagagtctgaaaaagaatgatgctgtggtcgccatcatgaaagaccttctggatagcgtgaagtcctttgaaaactacattaaggctttctttggcgagggtaaagaaaccaatagagacgagtctttctatggggattttgttttggcctacgacatactcctgaaggtggatcatatctatgacgcaattaggaactacgtcacacagaaaccttatagcaaggataaattcaagttatactttcaaaacccacagttcatgggaggctgggacaaggataaagagaccgactaccgggccacgatcctgcgttatggctcaaagtactatctagctattatggacaaaaagtacgcgaaatgcctccagaagatcgataaggacgatgtgaatgggaactatgaaaagataaattacaagctgcttcccggacctaacaaaatgttgccaaaggtatttttcagtaaaaagtggatggcatattacaatccctccgaggacatccagaaaatttacaagaacggtacttttaagaaaggcgatatgttcaatctgaacgactgtcacaagctcatcgatttctttaaagacagcatttctcgctatcctaagtggtcaaatgcctacgatttcaactttagtgaaacagagaaatataaggacatcgctgggttctacagagaagttgaggagcaaggatataaggtgagctttgaatccgcctctaaaaaggaggtcgataaactggtggaagagggcaaactttacatgttccagatatataataaagacttttcggataagagccatggtaccccaaacctgcacactatgtacttcaagttgctctttgacgagaataaccacgggcagattaggctgtccggcggagcagaattattcatgcggcgagcctcactgaaaaaggaggagctagtcgtgcatccggctaatagtcccatcgccaacaaaaaccctgacaatccaaagaaaacaaccacgctctcttacgatgtttataaggacaagcgctttagcgaagatcaatacgaactgcacattcccatcgcaataaacaaatgccctaagaatatcttcaaaattaacaccgaggtgagagtacttttgaagcatgacgataatccatatgtcatcggcattgaccgaggggagcggaacctgctctacatcgtggttgtggatggaaaaggtaatatagtcgaacagtattccctgaacgagattatcaataacttcaatggcatccgcattaagacagactaccactcattactggataagaaagaaaaggagagatttgaagcgaggcagaactggactagcatcgagaatattaaagagcttaaggctgggtatatatctcaggtggtacacaaaatctgtgaattggtggagaagtacgacgccgttattgcactcgaagatctgaactccggattcaaaaatagtcgtgtcaaggtggagaagcaagtgtaccagaaatttgaaaagatgctaatcgacaaactgaactatatggtcgacaagaaaagcaacccctgcgccaccggcggtgctctcaaggggtaccagattacaaataagttcgagtcttttaaatccatgtcaactcagaacggcttcatcttttatataccggcctggctgaccagtaagatcgatcctagcacaggattcgttaatcttttgaaaaccaagtacacttcgattgcagactccaaaaagtttatctctagcttcgatcggattatgtatgtgcccgaggaagacctgtttgagttcgctttagattacaagaacttttcacgaacggacgccgattatatcaaaaagtggaaactctacagttacggcaatagaataaggattttcgcggccgctaagaaaaacaatgtgttcgcatgggaagaggtatgtctgacatccgcctataaggagctttttaacaagtacgggatcaattatcaacagggagacatccgcgctctgttgtgcgaacagtctgataaagccttctacagctcctttatggcactcatgtcactgatgctacagatgcggaacagcattaccggtagaactgacgtcgatttcctgataagtccagtgaaaaattctgacggcatcttttatgattccaggaactacgaggcgcaagaaaatgccattctccctaaaaacgctgacgccaatggggcatataacatcgctcgcaaggttctgtgggccattggacagttcaaaaaggcagaggacgaaaaacttgataaggtgaagatcgccataagcaataaagagtggttggagtacgctcagacctcggtcaagtga

SEQ ID NO: 3463 - RNA, 3903 nt, synthetic construct
  misc_feature 1..3903: note = Cpf1 variant
  source 1..3903: mol_type = other RNA
atgagcatctaccaggagttcgtgaacaagtattccctgtctaaaaccctcagatttgaacttattccccaaggcaagacactggagaatataaaagccagggggttgatcttagacgatgaaaagcgggctaaagactacaagaaggcaaaacagattatcgataagtatcaccagttctttattgaggaaatcctgtcaagtgtctgcataagcgaggacctactccagaactactccgatgtttatttcaaactgaagaaatctgacgatgacaatcttcaaaaggattttaagtcggccaaagacactatcaagaaacagatttcagagtacatcaaggatagcgaaaaattcaagaacctgtttaatcagaacttgattgacgcgaaaaagggacaggagagtgatctcatcctgtggctgaagcaatccaaagacaatggtatagaactcttcaaggctaactctgacattacggatatcgacgaggccttagagattatcaaaagttttaagggctggaccacatatttcaaagggtttcatgaaaatcgcaagaacgtgtactcctcagatgacatccctactagcattatataccgaatcgtagatgacaatctgccaaagttccttgagaacaaagcaaagtatgaaagtttgaaagataaggccccggaggctattaattacgaacagatcaaaaaggacctggcagaggagctaacctttgatatagactataagacatctgaagtgaaccagcgtgtcttctccctcgatgaggtgttcgaaattgccaattttaacaactacctgaatcagtcaggaatcaccaaattcaacactatcattggcggtaagtttgttaatggggagaacacaaaaagaaagggaatcaatgaatatattaacctttacagccaacagataaatgacaaaaccctgaagaagtataaaatgagtgtgttgttcaagcagatcctctctgacacggagtccaaatcatttgtcattgataagctggaggacgattcggacgtggtaactaccatgcaatctttctacgaacagatcgctgcctttaaaacagttgaggaaaagtccatcaaagagactttatcactcctgttcgatgaccttaaggcgcagaagctggatttgagtaaaatttactttaagaacgacaaaagcctaaccgatctgtcccagcaagtgttcgacgattattctgtcataggcacagcagtgctcgaatacatcacccaacaggtggcccccaagaatctggacaaccctagcaaaaaggagcaggatcttattgctaagaaaacggagaaggccaaatatctgtcattggaaactatcaagctcgcactggaggaatttaataaacacagggacattgacaagcagtgtcggttcgaggagatcttagctaactttgccgcgataccaatgatcttcgatgaaattgcccagaataaggacaacctggcacagatcagtctaaaataccagaatcaaggcaagaaagatctcctgcaggcttccgccgaggaagacgtcaaggctattaaagatcttttggaccagacaaacaacctgctccatcgcctgaagatcttccacataagccagtctgaggataaggccaatattcttgacaaagatgaacatttttatctggttttcgaggagtgctactttgaattggcaaacatcgtgcccctctataataagattagaaactacatcacccaaaaaccttactcagacgagaagttcaaactgaattttgaaaacagtactttagccaatgggtgggataagaacaaagagccagacaatacagctatactgttcatcaaggatgacaagtattacctaggagtaatgaacaaaaagaataacaaaatttttgacgataaggcgatcaaagaaaataagggtgagggctataagaaaattgtgtacaagctcctgcccggggcaaacaaaatgcttcctaaggtcttctttagcgccaaatccatcaagttctataatccatctgaggacatattgaggattcggaaccactcgacccacacgaagaacggaaatccgcagaaaggctacgaaaagtttgagttcaacatcgaagattgtcgcaaatttatcgacttctataaggagagcatttccaaacatcccgaatggaaggatttcggttttcgattctcagacacccagagatacaatagtatcgatgagttttacagggaggtggaaaaccaagggtataagctgacattcgagaatatttctgaaagctacatagactccgttgtgaaccagggaaaactctatctgtttcagatctacaataaggatttctcagcttatagcaaaggccggcctaacttacacactctgtactggaaggccctttttgacgagcgtaatttgcaggatgtcgtgtataaactcaacggcgaggcagaactgttctaccgcaagcaatctattccaaagaaaatcacccatcccgccaaggaggctattgccaataaaaacaaggacaatcctaaaaaggaatccgtatttgagtacgacctaatcaaagataagagattcacagaagacaagtttttcttccactgcccaataactatcaactttaaaagtagcggggcaaataagttcaacgatgagattaacctgctcctgaaagagaaggcgaatgacgttcacatcctttctattgataggggagaacggcatttggcttattacaccctggtggacggtaaaggcaacatcataaagcaggatacatttaatattatcgggaacgaccgaatgaagaccaattatcacgataaattagccgcaatcgagaaggaccgcgattccgccagaaaagactggaagaaaattaacaatataaaggaaatgaaggagggatacctctcacaggtcgtgcatgaaatcgctaaactggtcattgagcacaacgccatcgtggttttcgaggatcttaattttggcttcaagaggggtcggtttaaagtggaaaagcaggtatatcaaaaactggagaagatgttgattgaaaagctcaactacctggtcttcaaagacaatgagtttgacaagactgggggcgtgctacgcgcatatcagctgacggctcccttcgaaacatttaaaaagatgggaaaacagaccggcatcatatactacgttccggccgggttcactagcaagatctgtcctgtgaccggatttgtcaaccagctctatcccaaatacgagagcgtgtcgaagtcccaagagttcttctctaagtttgataaaatttgctataatctggacaagggttacttcgaatttagcttcgattataaaaactttggcgacaaggcggccaaagggaagtggacaatcgcttcattcggaagtagacttattaattttaggaactccgataagaatcataactgggacacccgtgaggtatacccaactaaagaattggagaagctgttaaaagattattctatcgagtacggccacggtgaatgtataaaggcagccatttgcggggagagcgacaaaaagttctttgctaagctcacatccgtgctgaacacgatccttcagatgcggaatagcaaaaccggcactgaactggattacctaatcagccctgttgccgacgtcaacggaaatttctttgatagtcgacaggcacccaagaacatgccacaagacgcggatgccaatggcgcttatcacattgggctcaaaggactgatgttgctggacagaatcaagaacaatcaggagggtaaaaagttaaacctcgtgataaagaatgaagagtacttcgagtttgtgcagaacaggaataactga

SEQ ID NO: 3464 - RNA, 1071 nt, synthetic construct
  misc_feature 1..1071: note = Cpf1 variant
  source 1..1071: mol_type = other RNA
atgaagaccaactaccacgacaaactggccgctatcgagaaggatagagaaagcgcaaggaaagactggaagaaaattaataacataaaggagatgaaggaaggctatctctcccaggtggtccatgagatcgccaaacttgttattgggtacaatgcgatcgtggtattcgaagatctgaactttggattcaagcggggtcgctttaaagtggagaagcaagtctatcagaaattggagaagatgttaattgaaaagctgaattacctagtgttcaaagacaacgagtttgataaggctggcggggttctccgagcctatcagctgacagcacccttcgaaacttttaaaaagatgggaaaacagacgggcatcatatactatgtgcctgccgacttcacctctaagatctgcccagtcacaggttttgtgaatcaactttacccgaaatacgagtcagtaagtaagagccaggagttcttttccaagttcgataaaatttgttataacctggacaaggggtactttgagttctctttcgattataaaaattttggagacaaggctgcaaaaggcaagtggactatcgcctcgttcggctcacgtttgattaactttagaaatagcgataagaaccacaattgggacaccagggaagtttaccccacaaaagaactcgagaagctgctgaaagattatagtatcgaatacgggcatggagagtgcataaaggctgccatttatgcggagaacgacaaaaagttctttgcaaagctcacctccatcttaaattctattctgcagatgcggaacagcaaaactggtacagaacttgactacttgatctcccctgtggccgatgtcaacggcaatttctttgactcacgccacgctccaaagaacatgccccaggatgccgacgcaaatggggcttaccatatcggactgaaaggcctaatgctcctgtatagaattaagaacaatcaagatggtaaaaagctgaaccttgtgataaagaatgaggaatacttcgagtttgtgcagaacaggaataaaagtagcaagatctga

SEQ ID NO: 3465 - RNA, 3792 nt, synthetic construct
  misc_feature 1..3792: note = Cpf1 variant
  source 1..3792: mol_type = other RNA
atggaggactacagcggcttcgtgaacatctattccattcagaagaccctgagatttgaactcaaacccgtcgggaagacacttgagcacatagagaaaaagggattcctgaaaaaggataagatcagggccgaggactacaaagctgttaagaaaattatcgataagtatcatcgggcatacattgaagaggtgtttgactctgtattgcaccagaaaaagaagaaagataagactcgcttctcaacgcaatttatcaaagagataaaggagttcagtgagttatattacaaaaccgaaaagaatatccctgacaaagagcgactggaggccctaagcgaaaagctccgtaagatgctggtgggtgcgtttaaaggcgagttctccgaagaggtcgctgaaaagtataaaaacctgttttctaaggagcttattagaaatgagatcgaaaaattctgcgagacagatgaagagaggaaacaggtgtcgaactttaagtcattcactacctactttacagggttccatagcaatcggcagaacatttacagtgacgagaaaaagtccaccgccatcggatatcgcataattcaccaaaatttgccaaaattcctcgataacctgaagatcattgaatctatccagagaaggtttaaagacttcccgtggagcgatctgaagaagaatctcaaaaagatcgacaaaaacattaagttaactgagtacttttccatagatggcttcgttaatgtgctgaaccagaaaggtatcgacgcatataatacaattcttgggggaaagtcagaagagagtggcgaaaagatccagggcttgaacgagtacataaatctgtatcggcagaaaaacaacattgaccgcaagaatctacccaacgtcaaaatcctctttaagcaaatcctgggggatcgagaaaccaagagcttcattcctgaggcctttccagacgatcagtctgtgcttaattccatcacggagttcgctaagtacctgaaattggacaagaagaaaaagtcaattatagcagaactcaaaaagtttctgagcagtttcaacagatatgagttagatggaatctacctggccaatgacaactctctcgcttccattagcacttttcttttcgatgactggtcgtttatcaaaaagtctgtatccttcaagtacgatgaatcagttggtgaccccaaaaagaaaatcaagagtcctctgaaatatgagaaggagaaggaaaaatggttgaagcagaaatactataccattagcttcctaaatgatgccatagagtcctactctaagagccaagacgagaaaagggtgaagatccggctggaagcgtattttgcagagttcaagtcaaaagacgatgccaagaaacagtttgacctcctggaacgtattgaggaggcttacgccatcgtcgaaccacttctgggcgcagaatatccccgcgatagaaacttgaaggctgacaaaaaggaggtggggaaaattaaggatttcctcgacagtatcaagtccctgcagtttttcttaaaacctctgctaagcgccgaaatatttgatgagaaggacctcggattctacaatcaactggagggctactatgaagagatcgattctattggtcatctttacaacaaagtgaggaattatttgacagggaagatctactcaaaagaaaagtttaagctgaacttcgagaatagtactctcctgaaaggatgggacgaaaaccgggaggtcgcgaatctttgtgttatttttcgagaggatcagaagtattacctgggcgtgatggacaaagaaaacaacaccatcttgagcgatataccaaaggtaaaaccgaatgaactcttctatgaaaagatggtgtacaagctgattcccacacctcacatgcagttaccacgcatcatcttttcctctgacaacctgtcgatttacaatcccagcaaatccatactaaagatcagagaggccaaatcattcaaggagggcaaaaacttcaagctcaaggactgccacaaatttattgatttctataaggaaagtatctctaaaaatgaggactggagcaggtttgatttcaagttttccaaaacctcaagctacgaaaacatttctgagttctatcgggaagtcgagcgccaggggtacaatctggactttaagaaggtgtccaaattctatatcgatagtcttgttgaggacggaaagttgtacctgtttcaaatatataacaaagatttcagcatcttttctaagggtaaacctaatctccatacgatttacttcagatccctgttctcaaaggaaaacttaaaagacgtgtgtctgaaacttaatggcgaggcagaaatgtttttcaggaagaaaagtatcaactacgatgagaagaaaaagcgtgaagggcaccatccagagttgtttgagaaactcaagtatcccattctgaaggacaaacggtacagcgaagataagttccagtttcacctaccgatctcgctgaatttcaaatccaaggagcgactcaactttaatctgaaagtcaacgagttccttaagagaaacaaggacattaatataatcggaattgataggggcgaacgcaacttgctgtatttagtgatgatcaatcagaaaggtgaaattctcaagcagactctgcttgactctatgcaaagcgggaaaggccggcctgagatcaactacaaggagaaactgcaggaaaaggagatagaaagagacaaggctaggaaatcatggggaacagtagagaatatcaaggagttgaaagaaggctatctcagtattgttatccaccagatttccaagctgatggtggagaacaatgccatcgtcgtgctagaagatctgaacatagggtttaaacgcggacgacagaaggtcgagcggcaagtgtaccagaaattcgaaaagatgctcattgacaagctgaattttcttgttttcaaagagaacaagcccaccgagccaggtggcgtgttgaaggcttatcagctgactgatgaatttcagtctttcgagaagttaagcaaacaaacagggttcctcttttacgtaccttcctggaatacctcaaagatcgacccccgtacgggattcatcgattttctgcatccagcctacgaaaacattgagaaggcaaaacagtggataaataagttcgacagcatcagatttaacagtaaaatggattggttcgaatttaccgccgacacaaggaagttctctgagaatcttatgctgggcaaaaaccgcgtctgggtgatttgcactaccaacgttgagcggtattttacatccaagactgctaatagctcgatccagtacaactcaattcaaatcaccgaaaagctaaaagaactcttcgtggatatacccttttctaatggtcaggacctgaagcctgaaatcttgaggaaaaacgatgcggtcttctttaagagtctgttattctatattaaaacaaccctctccctgagacagaataacgggaagaagggcgaggaagagaaagacttcatccttagcccagtggtagactctaagggacgatttttcaatagcctggaggcatccgatgacgaaccgaaagatgccgacgctaacggcgcctaccacattgcattgaaggggctcatgaatctgctagtgctgaacgagactaaagaagagaatctttcacgccccaagtggaaaatcaagaacaaggattggctcgagtttgtttgggaacggaatagatga

SEQ ID NO: 3466 - RNA, 2820 nt, synthetic construct
  misc_feature 1..2820: note = Cpf1 variant
  source 1..2820: mol_type = other RNA
atgaacctgtacagcaatctcaccaacaagtattccctttctaaaacactgagattcgagttgatcccccagggcgaaactttagagaatattaaggccagggggctgatactagacgatgaaaaacgggctaaggactacaaaaaggcaaagcaaatcattgataaatatcaccagtttttcatcgaggaaattctctcaagtgtgtgcatcagcgaggacctgcttcagaactactccgatgtctattttaagctgaaaaagtctgacgatgacaatttgcagaaagatttcaagtcggccaaggacacgatcaaaaagcatatatcacgctacattaacgatagcgagaaatttaagaatctcttcaaccaaaatctgatcgacgcgaaaaagggacaggaaagtgatctgattctctggttaaaacagtccaaggacaacggtatcgagctgtttaaggctaattctgacataaccgatattgacgaagcccttgagatcattaagagcttcaagggctggacaacttattttaaagggttccacgagaaccgaaagaatgtttactcctcagatgacatccctaccagtatcatttaccgtatagtggatgacaacttgccaaaatttatcgaaaataaggcaaagtatgagaacctgaaagataaggccccggaagctattaactacgagcagatcaaaaaggacctagcagaggaactcacattcgatatagactataaaaccagcgaggtaaatcaaagagtgttttctctggatgaagtcttcgagattgccaacttcaataactaccttaatcagtccggaatcactaagtttaacacaatcattggcggtaagttcgtgaatggggaaaacaccaaaaggaagggaatcaatgagtatattaacctgtactcacagcagataaatgacaaaacgttgaagaaatataagatgagcgttctctttaagcaaatcctgagtgacactgaatctaaatccttcgtgattgataagttagaggacgatagcgacgtcgtgaccacaatgcagtcgttttacgagcagatcgctgccttcaaaactctggaagagaagtctatcaaagaaaccctctcccttctgtttgatgacttgaaggcgcaaaaactagatctgtcaaagatttacttcaagaacgacaaaagtctcacagatctgagccagcaggtatttgacgattattccgttataggcaccgcagtgcttgagtacatcacgcagcaagtcgcccccaagaatctggacaacccttctaaaaaggaacaggatttgattgctaaaaagactgagaaggccaaatatctcagcctggagacaatcaagttagcactggaagagttcaataaataccgggacattgacaagcagtgtcgctttgaagagatcttcgcttcatttgccgatataccagtgctattcgacgagatcgcgcagaacaaaaacaatctcgcccaaattagtatcaagtatcagaaccagggcaagaaagatctgcttcagacctccgcagaagtggacgtcaaggctattaaagatttgctggaccaaactaataacctcctgcataaacttaaaatcttccacataacacagagcgaggataaggccaatattctggacaaggatgaacatttttacttggttttcgacgagtgctattttgaactcgctaacatcgtggccctgtacaataaaattagaaactacatcacccagaagccctattctgatgagaaattcaagttaaattttgagaactcaacgctggcaaatgggtgggacaaaaacaaggaacctgataataccgccatactattcatcaaagacgacaagtactatctcggagtaatgaacaagaaaaataacaagatttttgatgacaaagctatcaaggagaacaaaggtgaaggctacaagaaggtggtctataaactgcttccaggggcgaataagatgttgcccaaagtgttctttagtgcaaagagcattaacttctacaatccttccgaggatatcctgaggatacggaaccactctacacacactaaaaatggatcgccacagaagggctatgaaaagctcgagtttaacattgaggactgtcgcaaattcatcgatttttacaagcatagcatctcccgacacccggaatggaaagacttcggtttcagattttcagataccaagaaatacaatagtattgacgagttctatagggaagttgagaaccaagggtacaagctgacatttgaaaatatctctgagagctatattgattccttagtggacgagggaaagctgtaccttttccagatatataacaaagatttttcagtctacagcaagggcaaacccaatttgcatactctctattggaaggccctgttcgacgaacggaacctacaggacgtggtatacaaactgaatggcgaggctgaactcttttaccgtaagcaatctatccctaagaaaattacccacccagccaaggaggcaatcgccaacaaaaataaggataaccccaaaaaggagtccattttcgaatatgacctgatcaaagataagcgctttacagaggacaagttctttttccactgccctataaccatcaacttcaaaagtagcggggctaataagtttaacgatgaaattaatcttttgctgaaagagaaggccaacgacgttcatatcttatctattgatagaggagaaaggcacctcgcatactatactctggtggacggtaaaggcaatatcatatgtaagaactga

SEQ ID NO: 3467 - RNA, 3795 nt, synthetic construct
  misc_feature 1..3795: note = Cpf1 variant
  source 1..3795: mol_type = other RNA
atgctgttccaggagtttacccacctctacccccttagcaagacagtgagattcgaactgaaacctatcggcaagactttggagcatattcacgccaaagactttttatcccaagatgaaacgatggctgacatgtatcagaaggtcaaagcaatactggatgactaccatagggatttcatcgccgacatgatgtctggggttgtgctaaccaagctcgcggagttttatgaagtatacctggcccttcggaagacaccaaaagatgactcactgcagaagcagttgactgagattcaaaccgctctccgcaaagagatcgtgaagccgattggaagtggtggcaaatataaggcagggtacgatcgactgttcggagccaagctgtttaaagacggcaaggaactcggtgatttagctaaattcgtcatcacacaggagggggaaagctcccccaagctggcacacatagcccattttgagaaattctctacctattttactggattccacgacaaccgtaagaatatgtactcggatgaggacaaacacacagctatcgcctacagacttattcatgaaaacttgcctaggtttatcgacaatctgcagattctagcgaccatcaagcagaagcactcagcactctatgatcaaatagtgaacgagctgaatgccaacggccttgacgttagcctggctagtcatttggatggctaccacaaactcctgacgcaggaagggattactgcctataataccttactgggaggtatctccggcgaggcagggtctcggaagattcagggaatcaacgaactcatcaatattcaccataaccagcactgccaaaagagcgagcgcatagctaaacttagaccactgcataaacagatcttgtccgacggcatgggtgtgtcattcctacccagtaagttcgccgatgacagcgaggtctgtcaggcggtgaatgaattttacaggcactatgcccatgtattcgcaaaggttcaatctctgtttgatcggttcgacgattaccgcaaagacgggatttatgtggagcacaagaacctcaatgaactgtccaaacaggcttttggagatttcgcccttctgggccgagtcttggacggctactacgtggacgtggtcaaccctgagtttaatgaaagattcgctaaggccaaaacagataacgcaaaggagaagctcactaaagagaaggacaaatttatcaagggggttcactcactggccagcttagaacaggctatagagcattatattgcgggacacgatgacgaaagtgtgcaggcaggtaaactgggccaatacttcaagcatgggctagccggagtagataacccaatccagaagatccacaattctcactccaccattaaaggctttctcgagagggaacggcccgctggtgagcgtgccctgcctaagatcaaaagcgacaagtcgccagagatgacacagcttcgccagttgaaagaactgctcgataacgcactgaatgtggtccatttcgccaaacttctgaccacgaagactacattggacaaccaagatgggaatttttatggcgagttcggagctctctacgacgaactggccaagattgcaaccttatataacaaggtgagagattacctgtctcagaaaccgttctccactgagaagtataaactaaattttggcaaccccacactcctgaatgggtgggaccttaacaaggagaaagataatttcggagttatattgcagaaggacggttgctactacctggcgctcctggacaaggctcacaaaaaggtgtttgataacgcccctaatgcaggcaaatcagtctatcagaagatggtgtacaaattactgccagggcccaacaagatgcttcctaaggtattctttgccaaaagtaatttggactattacaacccaagcgctgaactcctggataagtatgcccaaggaacccataaaaagggcaacaatttcaacctaaaagactgtcacgcactgatcgatttcttcaaggcttccattaataagcatcccgagtggcagcactttggtttcgaattttctccgacgagctcataccaggacctcagtgatttctatagggaggttgaacctcaggggtaccaagtgaaatttgtcgacatcaacgccgagtacatcgatgagctggtggaacagggccagctttatttgttccaaatttacaataaggacttctcccccaaagcgcacggaaagccaaacctgcataccttatattttaaagccctcttcagcgagaataacctggctaatcctatatacaaacttaacggcgaagcagagatcttttatcggaaggcctctctggatatgaatgaaacaactattcaccgagctggggaggtcttggagaacaagaatcccgacaacccaaagaaacgccagttcgtgtacgatatcattaaggacaaaagatatacccaggacaagtttatgctccatgttcccatcacaatgaatttcggagtgcagggtatgactataaaagaatttaacaagaaggtaaaccaatcaatccagcagtacaatgatgtcaacgtgattggcatcgacaggggagagcggcatctgctatacctgaccgttattaatagtaaaggggaaatcctcgagcagcgcagcctgaacgatataattacaacctccgccaatggcactcaaatgacgacaccttatcacaagatccttgacaaaagagaaattgagaggttgaacgcacgtgtgggttggggcgagatcgaaaccataaaggagctgaaatctgggtacttatcgcacgtcgtgcaccagatcagccagctcatgctgaagtataatgcgattgtagtgcttgaagatctgaacttcggatttaagcggggccgattcaaagttgagaagcagatctaccaaaattttgagaacgccctaattaaaaagctcaatcatctggctttgaaagacaaggccgatgacgaaatcgggtcctataagaacgcactgcagttaactaataacttcaccgatctcaaatcaataggaaagcagacaggcttcctgttttacgtcccagcttggaataccagtaaaattgacccggccactggtttcgtggatcttctgaagcccagatatgagaacatcgcacaatctcaggcctttttcgggaaatttgacaagatcttctacaacgctgacaagggatactttgaattttatgtggattacgcgaaatttacagacaaggccaaaaatagcaggcagacgtgggtcatttgctcccacggcgataagcgctatgtttacgacaaaaccgcaaaccagaataagggtgctactatcggcattaacgtgaatgatgagttgaaatcactcttcgcccggtatcatataaacgacaagcaacctaatctggtgatggatatctgtcagaacaatgacaaggaatttcacaaaagcctaatgtacctgcttaaggccctcctggctttgagatattctaacgcatccagtgatgaggacttcattctgagcccagtagccgatgacaaaggggtctttttcaattctgcgttagctgatgacacacagccccagaacgccgacgcaaatggagcctaccacatcgctctcaagggcctgtggcttctgaacgagttgaaaaattccaacgatctcgacaagattaagctggcaatcgataatcaaacctggctaaacttcgcccagaacaggtga

SEQ ID NO: 3468 - RNA, 3903 nt, synthetic construct; identical to SEQ ID NO: 3463
  misc_feature 1..3903: note = Cpf1 variant
  source 1..3903: mol_type = other RNA

SEQ ID NO: 3469 - RNA, 3756 nt, synthetic construct
  misc_feature 1..3756: note = Cpf1 variant
  source 1..3756: mol_type = other RNA
atgaaccacatgaagcagttcaccaatcaatttagcctgtccaaaacactcagattcgagcttatcccccagggcaagactaaagaatttattgagataaacgggctgatcgaaaaggacaatgagagggccgtgtcttacaaaaaggtcaagaaaattatcgatgaatatcataagtacttcattgagatggttttgtgcgactttaaattacacggactggagacgtatgaaaccatcttcaacaagaaagagaaggatgacacagataagaaagaatttgacaatatacggaactcactacgcaagcagatcgctgatgcattcgccaaaaatcctaacgacgagattaaggagcgatttaaaaatctcttcgcgaaggaactgatcaaacaggatcttctgaactttgtggacgatgagcaaaaggaattggtaaatgagttcaaggactttactacctacttcacaggtttccatcagaaccgtagaaatatgtatgtggctgatgaaaaagccaccgcaattgcctacaggctcgtcaacgagaatctgccaaagtttatcgacaacctgaaaatatatgagaagattaaaaaggacgctccggaactcatcagtgatttaaacaagactctggtggagatggaagagattgttcagggcaaaacacttgacgaaatcttcagcttgtcctttttcaatcagaccctgacgcaaactgggatcgagctatacaacattgtgataggaggccggaccgcagatgagggtaagacaaaaatcaaggggctcaatgaatacattaacactgactataatcagaaacagaccgataagaagaaaaagcaggccaaatttaagcaactgtacaaacagatcctttctgaccgccactcggtctcattcgtggctgagacatttgaaaccgatgcccagctgttggagaacatagaacaattctatagcagtgtactctgtaattacgaggacgatggacatacgactaacatttttgaggcgatcaagaatctgatcattggcttaaagacattcgacctgtccaaaatctatctcagaaacgatacctctcttactgacattagccagaagctgtttggcgactggtccataatctcaagtgcattgaatgattactatgaaaaacagaaccccattagctctaaggagaaacaggaaaagtacgacgagaggaaagccaagtggctaaagcaagatttcaatatcgagacaatccagaccgctctgaacgaatgcgactccgagattataaaagaaaagaataacaaaaacatcgtttcagagtactttgccaagctcgggctggataaagacaataagattgatcttctgcagaagatccaccacaactatgtggtcattaaagacttgctcaatgaaccttacccagagaacatcaagctgggaaatcagaaagagcaagtgagccagataaaggatttcttagacagtatcctgaacctaattcatttcctcaaacccctgtctcttaaggataaggacaaagaaaaggatgagttgttttattccctgttcacggcactctttgaacacctgagccagaccatctcgatttacaataaagtgcggaactatcttacacagaaggcttactctactgagaaaatcaagctgaatttcgaaaactccaccttgctcaatggttgggacgtcaacaaggagcctgttaatacatcagtgatatttcgcaaaaacggcctgttctatttagggattatgagtaagagcaataaccgaatctttgagagaaacgtaccagtgtgtaaaaatgaagagactgccttcgaaaagatgaactacaaactgctacccggagcgaataagatgctccctaaagtctttctgtccgccaagggcattgagtctttccaaccaagcgcagaaatccagtcaaagtaccagaaagagacccataagaaaggtgacgcttttgtgaggaaggatatggagaaccttatagacttctttaaacagagtatcgccaagcacacagattggaagcacttcaatcatcaattctccaaaaccgaaacttataacgacttgagcgagttttacaaggaagttgagaaacaggggtataagctgacgttcacaaaactcgatgagacctacattaatcagctggtggacgaaggaaagttatatctgtttcaaatctacaacaaggatttctctccgttttcaaaaggcaagcccaatatgcacactctttattggaaaatgttgttcgacgagcagaacctccagaatgtcgtgtacaagctgaacggcgaagctgaggtatttttccggcagagtagcattaaacaaaccgatcgtatcatacataaggccaatcaggcaattgacaacaagaatcctctaaacaacaaaaagcagtcctcttttaattacgatctgatcaaagacaagcgcttcacactcgataaatttcagttccacgttccaatcaccctgaacttcaaggccgaagggaatgagtatcttaacactaaggtgaatgagtacttgaaatcgaacagcgacgtcaagattatcggactggacagaggtgaaaggcatttaatttatctcacactgataaatcaaaaaggcgagcttctgaagcagcagtccttgaacgtgatcgctacgtcacaggaacacgagaccgattacaaaaatctcctggtcaacaaggaaaatgagcgggcgaacgcacgacaagactggaaaactattgagacaatcaaggaactaaaggaggggtatctgagtcaggtggttcaccagattgccaccatgatggtggatgaaaatgctatcgtagtcatggaggacctcaacgccggatttatgcgcggcagacaaaaagtggaaaggcaggtttaccagaagctggagaaaatgcttatagagaagttgaattatctggtgttcaaaaacaatgatgtcaacgaaacagccggtgtgttaaacgcactccagctgactaataagtttgagtctttcgaaaagatggggaaacaaagcggctttcttttctacgtacccgcttggaacacctccaagatcgaccctgccacgggatttgtggatttcctgaaaccaaagtacgagtcagttgagaaagcaaagctatttttcgaaaagtttgagagcattaaattcaatgcggacaagaactattttgaatttgagttcgattacaaaaagttcaccgaaaaagctgagggctctcagacaaagtggactgtctgcacccattccgacgtgcggtatcgctacaatccccagacaaaggccagtgatgaggtgaacgtcactaatgaactcaaactgatcttcgacaagtttaaaattgagtataagaacgggaaaaatttgaagaccgaactgttactccaggacgataaacaactgttcagcaaacttctgcactacttggcactcacgctgatgctaagacagtctaagtccggaacagacatcgattttatactgtcaccggttgccaagaacggtgtgttctatgacagtaggaatgctatgcctaaccttcccaaggatgccgacgcaaatggcgcttttcatattgccctcaaagggctgtggtgtgtgcagcagatcaagaaagcggatgacttgaagaagatcaaactggccattagcaacaaggagtggttatcgttcgtacaaaatctcaaatga

SEQ ID NO: 3470 - RNA, 4173 nt, synthetic construct
  misc_feature 1..4173: note = Cpf1 variant
  source 1..4173: mol_type = other RNA
atgatcgacaacaccaaggagaaaaaggaaggcagcgtgttcgatgggtttacaagaaaataccagctgtccaagactctcaggttcgagcttcggcccattctgaatacgcctaaaatgttggacgatgaacaagtcataaagaacgacgagacccgccgaaagaaatatgaagccgttaagccatggtttgatcagttacaccgtgagttcatcgaggacgctctgaaatcttttaagttcaaaaatctagcaatttaccaggatacatttcagacttggcaaaaggacagaaagtcaaaacagaagaaagataccctcgtgaagatcgaagtaggactgagggaggaaattgtgcggcgcttcgaggaggtcgccaacatctgggtgagaagtgaacagtataaacttctgggtataaagaaagagggcttggggatgctctttgaagcgggagttttcaggctgctgaaggagcggtttaagaatgaaaaagacacaaccgtggatggcaacaatatcttcgacgagtggactcgctggacaggttactttaagaaattcttcgagacccgaaagaacttttataaaagcgatgacacgtccactgctattgcctacagagtcatcaatcagaacctcaggcggttctgcgaaaatattcaaatctttgagaagatatctgaaaagattgagttctcggaagtggagaaatcatttgacatcagctgtgcagggattttcagtttagcctattacaacgcttgcctgcttcagggaggcatcgatacctacaataagatcattggcggggaggtagacgaaaaagataagaaaataccgggaatcaacgagttgattaataagtatcgtcaggacaactccggtgaaaagatcccctttctgaaacagctagataagcaaatacattctgcaaaagaggccttcattgaaagcatcgagacaaacaaggagctcgttggcaaactgaagactttttacgaaaatgctgaggtgaagatccagtccttccgcaaccttattgccgacatcgtcaccgattattcagggtacgacattgataaaatatatctgacaaaggaagcggtgagtcacaatgcaagcagatggtttgcctctttcgagtcctttgagagggacttgttcgctgtggtcgccgaaaaacagaacaagctcgtttacgagctgttacggacccataaaaatgattcaaagatcagcgacaaagacggaaagttcagttttcctgatttcattaagtgttctcacatcaaacgagcactggaaaagcaagagggccgcatctggaaaggtgaatattacgaggacattgtggattttgagaagataaaagacgtattcacgcagtttctctgcgtgttcaagtttgaacttgagcagcagttctttagaaagactacatccgctcaaaccggggaacagactaaaatcggatacgagattttcgtcacaaagatcaacgaactgattaccagggagaatccagtgatcgatttggaggagaaaatagccatcaagaactttgcggacgccacgctactgatttatcagatcgcaaaatacttcgctgttgaaaagcggcgcggctggctcgataattatgacctggatgacagattttacaagagctcggatattggctatcttaacttctacagggacgccttcgaacagatcgtgcgtccctataatctgtttcggaactacttgaccaaaaagccttacaatacaaacaaatgggtcctctctttcgagaatccaactctggctgatgggtgggacaagaacaaagaaaagaccaacgccgcagtgatattacgaaaggacggaagatattacctgggtattatcaaagaggattgtaagtccctatttgccgacaggtattcaaaagagatgagtgaaggcattgagagcgggtccttccaaaagatggcttacaaatttttccccgaagcgtctaagatgatccctaaatgcagcacacagactaagaatgtaaaggagcattttcgcaaatcaagttccgattataacctcttccacgagaaggactacaaaataagcgttgcaatcaccaagaatatttatgaactgaacaatgtgttttaccggaaagataacatcgaggaatctttcgtcccaaagaatgactttgagaagaaacttggagtgaagaaattccagagacagtacttggaaatttcaagggataacaatggctataagcaagccctggctcagtggatcgagttctgtatacgctttctcaaagcctacaagagtacaaccattttcgactatagccgactgcgggaggcaaaggaatacgagtcccttgatgccttttatcaggacatcaacgctctgacttacaatatctctttcgtcccgatttcggaacagtatatcaaagagaagaacgataatggtgaattgtttctcttcgagatttacaacaaagactggagcctggggcccatggataagaatcgtaaaagaacgaagaacttacacacactgtactttgagcaactattctccaaggaaaacgagcaggaaaattttctcttccagctgaacggcgaggccgaactgtttttcaggcctaaaaccgaggagaagcgcttgggatataaagtgtgggacgcaggcgaaaagaaatgggttaaggcgaaggagaaagaagacggggctgtgatagatcggaagagatacgccaaagacatcattctgtttcattgcccaatcactctcaatagggtatcagagagtaagaccaaacgagagatggatgtcgaaattcgcgaggtgctgtctagcacacccggagttcacatcataggtgtggaccggggcgaaaagcatttagcatattactccgtcatcgatcaaaacgggaaaattatcgagaccgacactcttaattcaattggaaaggatggcagaggtaagcctgtggaatatgccagcaaacttgagaagagggctcaggagcgtgaagcctctcgccgggactgggaggaagtagaggcaatcaaagatttgaagaaagggtacatatcccaggtgattagaaacctcgctgacctgatcatcaagcacaatgccattatagttttcgaagatctaaacatgaggttcaagcagatccgaggcggaattgagaaaagtgcgtatcaacagctggagcgggccctcatcgacaagctgagctttcttgtcaaaaagggcgaagaggacccaaaacagacagggcacattttgcgcgcttaccagctggcagcccccgtgatcgctttcaaggatatgggaaagcaaacgggtttaatattttacacccaggccggctatacttctaaaacatgtccggaatgcgggtacagaaggaatatcaagtgtctcttcgagaacattgaacaggcaaaaaccctgatcgagaatcttgagtccattaactataataagaaagaagacgtgtttcagatctcatacagtctggagaagttgagctcgaaggatcagaaaaaggagaaaaaggtctccaacgaactctatgcgaaaacactgaagaaagacatattcattctaactaccaagaatgccctgcggtacaagtggtatgatcgatactctgagaaagctaaggttgccaaaagaggaatcgacgaatacaagggcgaggtgaacgaaagcgagacgaaaaagggtgtggtaaaggaatttaacctcaccgagtatctgaaagggcttttgaagacatacgagatcgattatgaacatggcggcattcgcgagcaaatcctgtcagtcgcaaggggacgtgagttctacaaagactttttatatgctctcttcctgcttactgaaacccggcacagtatatccgggagaaatacagattacattcagtgccctgaatgcgagtttgactctaggaagggattcaaagatatcaaggagtttaacggcgacgccaatggtgcatataacattgcccgcaaggggatcatgatactggaaaagattaaacaattcaaaaaggataatgacggaaacctagagaaaatgggctggggtgacctcagcatctccatcgaagagtgggataagttcactcagaaggaatga

SEQ ID NO: 3471 - RNA, 4026 nt, synthetic construct
  misc_feature 1..4026: note = Cpf1 variant
  source 1..4026: mol_type = other RNA
atgaacgccgagaagaaatgcgctttcaatgaatttaccaacctgtacgagctcagcaagacacttaaattcgaactgaagcccgtgggcaaaactaaggagatcattaagaattttagagaagagttggagaaaaacaatcctatacagttagacaaggaaatctccattgcaaaacaagagatcaagaaagatctggacattctacacagggagttcgtccggcagtcttttgaactcgccttcaaggagaacaagatcaattatgaaatatttttcgagatctaccgcaactttaaaaagttctcaaagaataagaaaagtgatgaatatattgcggctatcaagaacctgaaagaggaaaagattaaacttgttaaaaagatcgccgactactttgtgaaaatggatcaggagtggcgaaagtattacccaagcgagaaaaagtccttcctgttgatgtctaatggggtaataaacctcctgattgacatcaataaggatcgtatggactattcgtttattccgaaagaagtgtgtgagaagatcaaaggaaagggtaaaatcgaactgtacgagaagttcaacaagcatttcggctacctctcaaaatataatacggcaagagaaaacttttacagcgatgacgtcaagaacagtgcctccgtggcttatagggcaatttgcgagaatttagagaaattctgtgataacaagataaaagttgaagccgacaattttcccaaggagatcaaggaaaaattcctggagtactttaacaagattaccgatctttctttctataatcggtgcttgagccagaacgggatcgaagagtaccacaaatttaaggacgagataaatcgctccattaacgaactgtatcctaataacagtaaaaataagccacaaaacatcccctacctaagtaaactcgacaagcagatcctgagcgagaaggataaacagtcttggattgaagagggattcatcgacgagaataactttattttcgaatttgagaagttcataaaaatgaatgataagtacatcccttccgaaaagaaactttttaacgagttcttcatttttcagaacaatgacgaagtgctgcaaaagttgttcctcctgaaaaagacaatcaacaattttgctaacatctatttagatgacccaaagaatctgatggatctcatgccctcaaagggcactaaaaagagagactaccttagcctgttggagattaaggaggccctaaacagttatgcggaaaatcagaacataggtgagacccagatcttcaaaattaagtacgatgacgtcatcgataaaacaaagaccccttttgaatgtttcatgaaaatttggaagtatgagtacgacctgctctataatgaaggggacggaaagaaaaacatcgaggagggctgggaaaagatatgcgagaaactgcagaataagaaagatgaatttactggcgactacgggaagtacaaaaaggagatcaaggattattgtgaaatggcactttctctgtcccaaaggattaaacatttggacatccggattaagaaacgcgatggaagcgaggacgccgataacaatctcttcgagggtgtggaaaagctggacgagttttacgatcgattattcgaaatcgtagacgagcacaacgcttatcagtaccatcacgagtttcaggccttcctgaccaaaaagccatataagacagataaatttaagctatcgttcgacaatccgcaactcctgaaaggctgggatcttaacaaggaacccgactacttcggggcattgctggttaaaaacgagaagtattttctcgctgtgttccacaagcagtacgccaatgaaatatttagacagaaaaacaaaaattctacggtcaaaattaaggaggcgtacgacgtgttcaacggaaattattacaaaaaggtggaactgaagcagatccctaaactttttatgaacctgccaaggatttgcttcgccaagtccaatcaagaggagtttggcttgactatcgaactcgagaaaataaagtcagagttcgataaatttcagaagctgaagaaagaacggcaggacaacaatttaaagttcgatcaggaaaaatttatcaagctgctagcatattaccgtcattgtctcgagattcgcgaggactggaaagtcttcaagtataacttcaaacccctgtacaagtatagtaatcttggtgaattttacagagatttggagaaggacacctacaacctggatctcgttagggtgaatagcgaatatgtagagaaaaagcggaacgaagggaaactgtacttattcgaggtgtataataaggacttttccgataaatctatcggacgaaagaacattcacagcgactacttcaagtcactgtttcttcctgataacttgacaaataaaaagatcgctctcgccgctgacgccgagatattctttcgcgaaaaatcactgaagaacaaagatgagattatcactcaaaagaataagatcaaaattgacaagaacaatcataaaggcgaaaaggcatattccaaaaacagatacaccgacgataagatcattctacatctgccaataaatctcaacttcggcgagaataagaaccacaaagactttaattatgagatcaacgatagcctgcttaagaataacagggacattaaaatcattgggatcgatcggggagaaaagtacttgctgtactattctgtcatagaccagaaaggtgatatcaaggagatgggcgacttcaatgtggttaacggggtggattactattcaaaattagtcgcctacgaagagaagcgcaagcaggctagactcgactggggagatattcagagtatcaaagaactgaaggagggctatattagccacgtgatccacgagatatgcgaccttattaaaaagtacaatgcgatcgtagttctggaagacttgtccatgggttttaaaagggggcgtttctttcgggagcgacaagtgtatcagaagttcgaactcgcactgttcagaaagctaaactactgggtcgataaaaacaaggaggaaggcgagaaaggatctgccctgtcggcttggcagctcacacccaatgagaaggactttaaagtgagccagctggaaaaggccaggcaacttggcatcttgttctacaccgcagccgggtatacgtccaagacttgtccggattgcggatttcgcaaaaacattacactgaagtacgtcaatgacaaacagttaaaggaggatctcggtaaactgaagataaacttcgtggaagaccattttaagatcaaatataatcttctggatttcgagaagaacaaaaagtcagaaaaagctaaggacaccgttctacctaaagaggagcggaagattagttttgtggccaattctaaggtaatcagaattaggtggcacgatatcaaaactaagctcgcaaaacgcgaactggacggcgagaagataatcaaaaagttccccaagggggtcattaaagaatacgatatcaacatttgcttgaagcgaatcataggagacaaaattgattttagcaaggactccatcacagagcagctgatcaatggccggttcggtaaagacttttattgggagttaatgtacttcctcaacctgattcttgaaatccgtaatgtggtttcagagaccgaaatagattatattcaatgtccagtgtgcgggtttcatagcgacgatggcttcagaggaaacaagttcaatggcgacgcgaacggggcttacaatatcgccaggaagggacgcctgattttggagaaaatcaaccagcacaagaacctcaaagaactgaagacgggtgatctatctgtcaatatagtggagtgggacaaagcagtaaacaattgggataagtttgtgcagggcgacaacaccgagtccaagaatattgaaatccctgccaaagaggaaatgatcagtgttgaggtccgggaaagctga

SEQ ID NO: 3472 - RNA, 4107 nt, synthetic construct
  misc_feature 1..4107: note = Cpf1 variant
  source 1..4107: mol_type = other RNA
atgaagaaagagaaggagttcaagagctttggcgacttcaccaacctgtacgaaatctccaaaacactcagatttgaacttaaacccgtggagaatactcagacgatgctggatgaagccgacgtcttcgggaaggataaggttattaaagacaagtataccaaaacaaagccttttatagataaattgcacagggagttcgtggacgagtctttaaaggatgtatcactgagtggactaaagaaatacagcgaagtgctcgagaactggaagaaaaataagaaagacaaggatatcgtcaaagaactgaagaaggaggaggaacggcttcgcaaagaggtggttgaatttttcgacaacactgctaagaaatgggcaaatgagaagtataaagaactgggtttgaagaagaaagatattggcatcctctttgaggagtccgtgttcgacctgctgaaggaaaaatacggggaggaacaagattcttttctcaaggaggaaaaaggagacttcttaaagaacgagaagggcgagaaagtctcgatttttgacgaatggaagggtttcgtggggtatttcaccaaatttcaggagacacgaaagaatttctacaaaaacgatggaaccgaaactgccctggcgacacgtatcatagaccagaatcttaagagattttgcgataacatcgacgatttcaagaaaattaagaataaaatcgacttttcagaggtagaaaagaacttcaataaaaccgctgatgtttttagcttggacttctataaccagtgtctgctacaaaagggcattgatagttacaatgagtttatcggcgggaaaacgctcgagaacggaaagaagctgaaaggtgtgaacgaacttgtcaatgagtacaggcagaagaacaaaaatgaaaaggtgtccttcctgaaattgctcgacaagcagatactgtctgagaaggagaaactgagctttggcattgaaaacgatgagcagttactcgtggtccttaattccttctatgaaactgccgaggaaaagaccaaaatcctgcggacattgtttggggacttcgttgagcataacgagaattacgacctagataagacttatatttcaaaagtggcattcaacaccatcagtcacaagtggacaaatgaaacccataagtttgaggaactgctctacggagccatgaaagaggacaagccaatcggcctgaactatgataaaaaggaagacagctacaaattcccggattttattgctcttggttatctgaagaagtgcttgaataacctcgactgtgatacgaaattctggaaggagaaatactacgagaataacgcagacaagaaagataaggacaaagggtttctgactggaggccaaaatgcctgggatcagttcttacagatatttatcttcgaatttaaccagctgttcaactctgaggcttttgacaataagggcaaggaaattaaaatcgggtatgataacttccgcaaggactttgaggaaataattaatcaaaaagacttcaagaacgatgagaatctaaaaatcgccatcaagaacttcgcggactccgtactctggatttaccagatggcaaagtattttgccatcgagaaaaagagaggatgggatgacgatttcgaactgtcagagttttacacaaatcccagcaacggttatagtcttttctacgacagggcttatgaagagattgtgcagaaatacaatgatttgcggaactacctgaccaagaaaccttataaggaggacaagtggaaactcaattttgaaaacccaactctggccaatggcttcgataagaacaaagagtctgacaattccacagtcatacttcgcaagaaacgaaagtactatctggggttgatgaagaaaggaaacaacaagatctttgaagatagaaataaagcagagttcattaggaacatcgaaagcggcgcttacgagaagatggcctataaatacctccccgacgtggcgaagatgatccctaagtgctcgacccaactgaatgaggccaaaaaccactttcgtaattctgcagatgacttagaaattaagaaatccttctcaaacccactgaagataacgaaacggatctttgacctaaataacattcagtatgataagaccaatgttagtaaaaagatcagcggtgacaacaaggggattaaaatcttccagaaggagtactacaaaatatccggcgatttcgacgtgtataagtctgctctcaatgattggatcgacttttgtaaagatttcctgagcaagtacgactcaacaaaggattttgacttcagtattcttcgcaaaactaaggattataaatccttggacgaattttacgtcgacgtggccaagatcacctataaaattagcttcacacccgtatctgagtcatacatcgatcagaagaacaagaatggagaactgtatctctttgagatatacaaccaagacttcgctaaaggcaagatgggggccaaaaatctgcatactttatactttgagaacgttttcagtcctgaaaacattagcaagaattttccaatcaaactgaacggaaatgcagagcttttctttagaccgaagtccattgaatctaagaaagagaagaggaacttcgtgcgggaaatcgtcaataaaaagcgatattcggaggataaaatattctttcactgccccatcaccttgaaccgcgagacaggtagcatttacagattcaataactatgtgaataactttctctccgaaaataacatcaatattatcggcgtcgacaggggagagaagcacctggcctactattcagtgatagataaaaacggggttaagattggcggtgggagtttcaatgaaatcaacaaggtggactacgctaaaaagctagaggagcgggcgggcgaacgcgagcagtctagaaaagattggcaggtagtcgaaggaatcaaggacctgaaaaagggctatattagccaggtggttagggagctcgcagatctggccatcaagcataatgctattatagtgcttgaagacttgaacatgcgttttaaacaaatccgagggggaattgagaagtccatctaccagcagctggagaaagccttaattgataagctctcattcctggtcgaaaaaggtgagaaggaccctaaccaggcaggccacatccttaaggcctaccaactggctgccccatttaccagcttcaaagatatggggaagcagactggaatagtgttttatacgcaggcatcttacacatccaaaacctgtcccaattgcggcttccggaagaacaataacaaattttatttcgaaaataacatcggtaaggcgcaggacgctttgaagaaactcaagacttttgagtacgacagtgaaaataaatgtttcgggctgagctattgcctatctgatttcgccaacaaggaggaggtagagaaaaataagaacaaaaagagaaataacgcaccttactccgacattgaaaagaaagattgttttgaactgtcaaccaaggacgccgtgaggtatcgctggcatgataaaaatacagagcggggcaagaccttctttgaaggagagagtgtttacgaggaaaaagaggaaaaggagatcggccaaactaagagagggctcgtcaaagagtacgacattagcaagtgcctgatcggacttttcgagaaaacaggcttggattataagcagaacctgttagacaaaataaattcgggtaagtttgatgggacgttctacaagaacctctttaactatctgaatcttctgttcgaaattaggaactccatctctggaaccgaaatcgactacattagctgcccagagtgtcagtttcacactgataaatcaaagacaatcaaaaatggcgacgataacggtagttataatatagctcgcaagggcatgattatcctagacaaaattaagcaattcaagaaagaaaacgggtccctcgacaagatgggatggggcgagctgtttatcgatttggaggaatgggacaaattcgcccagaagaaaaataacaatataatcgataagtga

SEQ ID NO: 3473 - RNA, 4149 nt, synthetic construct
  misc_feature 1..4149: note = Cpf1 variant
  source 1..4149: mol_type = other RNA
atgagcaagaacaatgtgtgggacaaattcaccaaccagtactccctgtctaagacactcagatttgagcttaaacccgtcggcaagactagggaaaagatgaatgagcaactgaagtatgataagcagttgcagacgttcttaaaagaccaggaaatcgaggatgcctaccaatatctgaagccatttttcgacaaactacacaaggaatttattaccgattcactcgacagtgatacaactaaaaagatagacttcagcgattacctgatcgactatcgggataagaaagaccttaccaagaaagaggattccctgcgcaagaacattggggaggtttttgtgaaagctggagaccgatggaagaaagaaaagtaccctaagtatgagtggaaaaagggttctaatgtagcaaacggctcggggatcttgctcacacaggacgtgctgatgctgattaaagatctcaatccgaacgaccagaagatcaaaaagatgatagaagagaccttcaagggatttttcacttacttttcaggcttcaatttaaaccgtgagaattactatacaaccaaagtcgaaaaggccacggcggtggctactagaatcgttcatgataacctgcccaaattttgcgacaatcttgtgcagttcgagtgtattatcaagaaaaagaagaacggtgaagtcgataggattgagcggaaaagcgaatacttgaatgcctatcaatacctgaagagtaaagggcgcaccacacagatcaaggacgcagagtccggaaaaatgatagaggccgaagtgattaacgagaacatgttctctatcagctatttttccgcttgcctatcacagagtggcattgaagagtacaatagaactatcggccactataacctcctgatcaatctttacaaccaggcaaaggaaggggaggagaaggatctgaaaaagagcgaaaagaagttcaaaaggttgcctatttttaagaccctctacaaacaaataggatgtggtgagaaggaaccactgttcttttctttaacacatgacaccaagctgcaggtacaggagaataaagaaaactataagaaaccctactccgttgagcaaatcctcgagcaggccaaacttgctggcgataaatatttcaaggggaagtcaaatgacggcattctgaacacgatccctgaatttagcgattacatattgcagaaagagagttatggaggtgtgtactggtctaaggtcgccattaatactatctccaaccggtatttcgaaaattggcacacactaaaagacgcgctgatcgacgcaaaggtgtttgagaaagggaagaagggagatgaggaagacgtgaaaattccagagagcatcgaactccagggcttctttgatgtcctggacacccaagagggctggaagtcggaagggattttctttaaaaagtctcttactgaggagctgaaaaacaaggaagccgatacaaagaataaaaagcgccgagagatagttaaagaagctaagagaccctcccaggccttgctcgcactgttattcgacgatatccaggagcatgctaacctgttcctaaatcagtcagacgaaattctcaaactggagaagtacagtgagaaagaaagcaaggagaagatcaaacaatggatggattccgcccttgcggtgaacaggatcttgaagtactttttcgtaaaagaatctaaggccaaaggagagcagattgaccctataatcagcgaagcactgaaggtgctctttaactcagaggatgctacctggttcaagtggtatgacgccctgcggaattaccttacgaaaaagccacaggatgacgtcaaagagaacaagctgaaattgaattttgaaaacagtaccctcgctggtggctgggacattaataaggagtccgataactattgcgtgatcctgcaggaccaaaaggggaaacagcacttaggaattatcgccaagaaagaaaagcagcgtggctacaataaaatattcgagcgcacaccggagaaccccctgtataagatcgatagcggtgaagtttggcagaagatggagtacaaacaaattgcagtgcctactgggatcggcggatttgtcagaaagtgtttcaataccgcccagcagtatggctggaaatgcccagacaactgtctaaattctgaagggaagattatcataaagaacgatgaggctaaggaaaatctcgaggcgattatcgactgctacaaggactttttcacaaaatacgagaaggatggatttaaatataagaacttcaattttaacttcaaagaatcagaggaatacgaggaactgaacagtttctttagcgatgtggagaggcaaggttataaacttggcttcattactgtaaataaaaccatcatagacaagtgggttgaggatgggacaatctacttgtttgaaattaagaaccaggacaccaatgatggcaaaaaggacggacacaaaaacaatctgcatactatctattggaaggcactcttcgaggacgtgggtaacaaacccaagctgaatgggggcgccgaattattttaccggaaggctctgcttaaagataagcaggagaaaattgaagacaactatggaaaggagatcattaaaaatttccgattttccaaggagaagttcttgtttcactgtcctataaaactcaactacaaggccaaatcttactcgcatccaaagtatgcactgcccgaaatcaataaacagacgaacgagttctttatcacaattagcgatatctgcttcctaggcattgaccgcggggaaaagcacctggcctactattccctcgtcaatcaaaaggaggagataatcgatcagggaaccctgaacatgccgttcgtggacaaagatggtaagcctagatcaattaaaaaggaaaaatttaggttcgacgctaaggtcgataaatgggtgagtgaggaaatggactgttggaattacaacgatcttttggacgccatggcatctaaccgggacatggcgcgcaagaattggcagactatcggcaccattaaggagctgaaaaacgggtatatcagccaggttgtgagaaagatagtagatttagctatcgacaaaaataggggcattccctcctttatcgtcctcgaaaacctgaatgccggattcatgcgtggtcggcaaaagattgagaaatcagtgtaccagaaacttgagctggcattggccaagaaactcaactttgttgtggataagacagtccagaatggggaaatcggcagcgtgaccaacgctctgcagctaactccacctgtaacaaatttccaaaacatagagaatcgaaaacaggtgggaattatgctgtatacgagagccgactacacctctcagactgatcccgttacaggctggaggaagtccatctacctcaaaaaggggagtgaagagtatatcaagagccaaattatggactcttttgatgacttcggatttgatggcaaaaactactatttcaagtacaccgtcgacctgatagatccaatcaaaaagacatccgagaaaaagtttaagaaacagtggactctttattcaggtattaatgggaagagtttggaccgcttccggggagaaagaagctcggataaaaacgtgtggatcaagaccctgcaggacattaaaacgaccttagacgcagtgtttatcggcttcgatctccagcactccctgaggtctcaaataatcaatgacggtattatgcccaagaaaatcgagaacagccagttcacaggctgggaatcacttcgctttgctattgagatgatccagcagatacgaaatattggggtcgaaaagggagatgaggacttcatcctgagtcctgttcgggataagaacgaaaaccattttgactcccgtaaagccaaggagaatgagccaaactctggcgatgcgaatggggcctacaacatcgctagaaaaggaattatcatgaatgaacacataaagaaagacctaattccgttcatccaagataaggagtgggacgcatggctcgccggcagggaagtgtgggataagtggctgattgagaacaaagacagcttgatctataagaaatga

SEQ ID NO: 3474 - RNA, 4203 nt, synthetic construct
  misc_feature 1..4203: note = Cas9 variant mRNA product
  source 1..4203: mol_type = other RNA
atggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaatga

SEQ ID NO: 3475 - RNA, 4986 nt, synthetic construct
  misc_feature 1..4986: note = Cas9 variant mRNA product
  source 1..4986: mol_type = other RNA
atggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtga

SEQ ID NO: 3476 - RNA, 3258 nt, synthetic construct
  misc_feature 1..3258: note = Cas9 variant mRNA product
  source 1..3258: mol_type = other RNA
atggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaatga

SEQ ID NO: 3477 - RNA, 4326 nt, synthetic construct
  misc_feature 1..4326: note = Cas9 variant mRNA product
  source 1..4326: mol_type = other RNA
atggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaatga

SEQ ID NO: 3478 - RNA, 3402 nt, synthetic construct
  misc_feature 1..3402: note = Cas9 variant mRNA product
  source 1..3402: mol_type = other RNA
atggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaatga

SEQ ID NO: 3479 - RNA, 4263 nt, synthetic construct
  misc_feature 1..4263: note = Cas9 variant mRNA product
  source 1..4263: mol_type = other RNA
atggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaatga

SEQ ID NO: 3480 - RNA, 3345 nt, synthetic construct
  misc_feature 1..3345: note = Cas9 variant mRNA product
  source 1..3345: mol_type = other RNA
atggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtga

SEQ ID NO: 3481 - RNA, 4101 nt, synthetic construct
  misc_feature 1..4101: note = Cas9 variant mRNA product
  source 1..4101: mol_type = other RNA
atggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaatga

SEQ ID NO: 3482 - RNA, 4134 nt, synthetic construct
  misc_feature 1..4134: note = Cas9 variant mRNA product
  source 1..4134: mol_type = other RNA
atggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtga

SEQ ID NO: 3483 - RNA, 3267 nt, synthetic construct
  misc_feature 1..3267: note = Cas9 variant mRNA product
  source 1..3267: mol_type = other RNA
atggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaatga

SEQ ID NO: 3484 - RNA, 3345 nt, synthetic construct
  misc_feature 1..3345: note = Cas9 variant mRNA product
  source 1..3345: mol_type = other RNA
atggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtga

SEQ ID NO: 3485 - RNA, 3351 nt, synthetic construct
  misc_feature 1..3351: note = Cas9 variant mRNA product
  source 1..3351: mol_type = other RNA
atggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaatga

SEQ ID NO: 3486 - RNA, 3051 nt, synthetic construct
  misc_feature 1..3051: note = Cas9 variant mRNA product
  source 1..3051: mol_type = other RNA
atggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaatga

SEQ ID NO: 3487 - RNA, 3462 nt, synthetic construct
  misc_feature 1..3462: note = Cas9 variant mRNA product
  source 1..3462: mol_type = other RNA
atggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaatga

SEQ ID NO: 3488 - RNA, 4020 nt, synthetic construct
  misc_feature 1..4020: note = Cpf1 variant mRNA product
  source 1..4020: mol_type = other RNA
atggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtga

SEQ ID NO: 3489 - RNA, 3999 nt, synthetic construct
  misc_feature 1..3999: note = Cpf1 variant mRNA product
  source 1..3999: mol_type = other RNA
atggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaatga

SEQ ID NO: 3490 - RNA, 4716 nt, synthetic construct
  misc_feature 1..4716: note = Cas9 variant mRNA product
  source 1..4716: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3491 - RNA, 5499 nt, synthetic construct
  misc_feature 1..5499: note = Cas9 variant mRNA product
  source 1..5499: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3492 - RNA, 3771 nt, synthetic construct
  misc_feature 1..3771: note = Cas9 variant mRNA product
  source 1..3771: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3493 - RNA, 4839 nt, synthetic construct
  misc_feature 1..4839: note = Cas9 variant mRNA product
  source 1..4839: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3494 - RNA, 3915 nt, synthetic construct
  misc_feature 1..3915: note = Cas9 variant mRNA product
  source 1..3915: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3495 - RNA, 4776 nt, synthetic construct
  misc_feature 1..4776: note = Cas9 variant mRNA product
  source 1..4776: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3496 - RNA, 3858 nt, synthetic construct
  misc_feature 1..3858: note = Cas9 variant mRNA product
  source 1..3858: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3497 - RNA, 4614 nt, synthetic construct
  misc_feature 1..4614: note = Cas9 variant mRNA product
  source 1..4614: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3498 - RNA, 4647 nt, synthetic construct
  misc_feature 1..4647: note = Cas9 variant mRNA product
  source 1..4647: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3499 - RNA, 3780 nt, synthetic construct
  misc_feature 1..3780: note = Cas9 variant mRNA product
  source 1..3780: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3500 - RNA, 3858 nt, synthetic construct
  misc_feature 1..3858: note = Cas9 variant mRNA product
  source 1..3858: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3501 - RNA, 3864 nt, synthetic construct
  misc_feature 1..3864: note = Cas9 variant mRNA product
  source 1..3864: mol_type = other RNA
gggagagtcccgcagtcggcgtccagcggctctgcttgttcgtgtgtgtgtcgttgcaggccttattcaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3502 - RNA, 3564 nt, synthetic construct
  misc_feature 1..3564: note = Cas9 variant mRNA product
  source 1..3564: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3503 - RNA, 3975 nt, synthetic construct
  misc_feature 1..3975: note = Cas9 variant mRNA product
  source 1..3975: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3504 - RNA, 4533 nt, synthetic construct
  misc_feature 1..4533: note = Cpf1 variant mRNA product
  source 1..4533: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3505 - RNA, 4512 nt, synthetic construct
  misc_feature 1..4512: note = Cpf1 variant mRNA product
  source 1..4512: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3506 - RNA, 4813 nt, synthetic construct
  misc_feature 1..4813: note = Cas9 variant mRNA product
  source 1..4813: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3507 - RNA, 5596 nt, synthetic construct
  misc_feature 1..5596: note = Cas9 variant mRNA product
  source 1..5596: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3508 - RNA, 3868 nt, synthetic construct
  misc_feature 1..3868: note = Cas9 variant mRNA product
  source 1..3868: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3509 - RNA, 4936 nt, synthetic construct
  misc_feature 1..4936: note = Cas9 variant mRNA product
  source 1..4936: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3510 - RNA, 4012 nt, synthetic construct
  misc_feature 1..4012: note = Cas9 variant mRNA product
  source 1..4012: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3511 - RNA, 4873 nt, synthetic construct
  misc_feature 1..4873: note = Cas9 variant mRNA product
  source 1..4873: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3512 - RNA, 3955 nt, synthetic construct
  misc_feature 1..3955: note = Cas9 variant mRNA product
  source 1..3955: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3513 - RNA, 4711 nt, synthetic construct
  misc_feature 1..4711: note = Cas9 variant mRNA product
  source 1..4711: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3514 - RNA, 4744 nt, synthetic construct
  misc_feature 1..4744: note = Cas9 variant mRNA product
  source 1..4744: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3515 - RNA, 3877 nt, synthetic construct
  misc_feature 1..3877: note = Cas9 variant mRNA product
  source 1..3877: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3516 - RNA, 3955 nt, synthetic construct
  misc_feature 1..3955: note = Cas9 variant mRNA product
  source 1..3955: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3517 - RNA, 3961 nt, synthetic construct
  misc_feature 1..3961: note = Cas9 variant mRNA product
  source 1..3961: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3518 - RNA, 3661 nt, synthetic construct
  misc_feature 1..3661: note = Cas9 variant mRNA product
  source 1..3661: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3519 - RNA, 4072 nt, synthetic construct
  misc_feature 1..4072: note = Cas9 variant mRNA product
  source 1..4072: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3520 - RNA, 4630 nt, synthetic construct
  misc_feature 1..4630: note = Cpf1 variant mRNA product
  source 1..4630: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3521 - RNA, 4609 nt, synthetic construct
  misc_feature 1..4609: note = Cpf1 variant mRNA product
  source 1..4609: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 3522 - RNA, 4497 nt, synthetic construct
  misc_feature 1..4497: note = Cas9 variant mRNA product
  source 1..4497: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3523 - RNA, 5280 nt, synthetic construct
  misc_feature 1..5280: note = Cas9 variant mRNA product
  source 1..5280: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3524 - RNA, 3552 nt, synthetic construct
  misc_feature 1..3552: note = Cas9 variant mRNA product
  source 1..3552: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3525 - RNA, 4620 nt, synthetic construct
  misc_feature 1..4620: note = Cas9 variant mRNA product
  source 1..4620: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3526 - RNA, 3696 nt, synthetic construct
  misc_feature 1..3696: note = Cas9 variant mRNA product
  source 1..3696: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3527 - RNA, 4557 nt, synthetic construct
  misc_feature 1..4557: note = Cas9 variant mRNA product
  source 1..4557: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3528 - RNA, 3639 nt, synthetic construct
  misc_feature 1..3639: note = Cas9 variant mRNA product
  source 1..3639: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3529 - RNA, 4395 nt, synthetic construct
  misc_feature 1..4395: note = Cas9 variant mRNA product
  source 1..4395: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3530 - RNA, 4428 nt, synthetic construct
  misc_feature 1..4428: note = Cas9 variant mRNA product
  source 1..4428: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3531 - RNA, 3561 nt, synthetic construct
  misc_feature 1..3561: note = Cas9 variant mRNA product
  source 1..3561: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3532 - RNA, 3639 nt, synthetic construct
  misc_feature 1..3639: note = Cas9 variant mRNA product
  source 1..3639: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3533 - RNA, 3645 nt, synthetic construct
  misc_feature 1..3645: note = Cas9 variant mRNA product
  source 1..3645: mol_type = other RNA
gggagagcggctcggccattttgtcccagtcagtccggaggctgcggctgcagaagtaccgcctgcggagtaactgcaaagaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3534 - RNA, 3345 nt, synthetic construct
  misc_feature 1..3345: note = Cas9 variant mRNA product
  source 1..3345: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3535 - RNA, 3756 nt, synthetic construct
  misc_feature 1..3756: note = Cas9 variant mRNA product
  source 1..3756: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3536 - RNA, 4314 nt, synthetic construct
  misc_feature 1..4314: note = Cpf1 variant mRNA product
  source 1..4314: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3537 - RNA, 4293 nt, synthetic construct
  misc_feature 1..4293: note = Cpf1 variant mRNA product
  source 1..4293: mol_type = other RNA
gggagagcggctcggccattttgtcccagtcagtccggaggctgcggctgcagaagtaccgcctgcggagtaactgcaaagaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3538 - RNA, 4439 nt, synthetic construct
  misc_feature 1..4439: note = Cas9 variant mRNA product
  source 1..4439: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3539 - RNA, 5222 nt, synthetic construct
  misc_feature 1..5222: note = Cas9 variant mRNA product
  source 1..5222: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3540 - RNA, 3494 nt, synthetic construct
  misc_feature 1..3494: note = Cas9 variant mRNA product
  source 1..3494: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3541 - RNA, 4562 nt, synthetic construct
  misc_feature 1..4562: note = Cas9 variant mRNA product
  source 1..4562: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3542 - RNA, 3638 nt, synthetic construct
  misc_feature 1..3638: note = Cas9 variant mRNA product
  source 1..3638: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3543 - RNA, 4499 nt, synthetic construct
  misc_feature 1..4499: note = Cas9 variant mRNA product
  source 1..4499: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3544 - RNA, 3581 nt, synthetic construct
  misc_feature 1..3581: note = Cas9 variant mRNA product
  source 1..3581: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3545 - RNA, 4337 nt, synthetic construct
  misc_feature 1..4337: note = Cas9 variant mRNA product
  source 1..4337: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3546 - RNA, 4370 nt, synthetic construct
  misc_feature 1..4370: note = Cas9 variant mRNA product
  source 1..4370: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3547 - RNA, 3503 nt, synthetic construct
  misc_feature 1..3503: note = Cas9 variant mRNA product
  source 1..3503: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3548 - RNA, 3581 nt, synthetic construct
  misc_feature 1..3581: note = Cas9 variant mRNA product
  source 1..3581: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3549 - RNA, 3587 nt, synthetic construct
  misc_feature 1..3587: note = Cas9 variant mRNA product
  source 1..3587: mol_type = other RNA
gggagagtccgctcagccaggttgcagaagcggcttagcgtgtgtcctaatcttctctctgcgtgtaggtaggcctgtgccgcaaacaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3550 - RNA, 3287 nt, synthetic construct
  misc_feature 1..3287: note = Cas9 variant mRNA product
  source 1..3287: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3551 - RNA, 3698 nt, synthetic construct
  misc_feature 1..3698: note = Cas9 variant mRNA product
  source 1..3698: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3552 - RNA, 4256 nt, synthetic construct
  misc_feature 1..4256: note = Cpf1 variant mRNA product
  source 1..4256: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3553 - RNA, 4235 nt, synthetic construct
  misc_feature 1..4235: note = Cpf1 variant mRNA product
  source 1..4235: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3554 - RNA, 4420 nt, synthetic construct
  misc_feature 1..4420: note = Cas9 variant mRNA product
  source 1..4420: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3555 - RNA, 5203 nt, synthetic construct
  misc_feature 1..5203: note = Cas9 variant mRNA product
  source 1..5203: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3556 - RNA, 3475 nt, synthetic construct
  misc_feature 1..3475: note = Cas9 variant mRNA product
  source 1..3475: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3557 - RNA, 4543 nt, synthetic construct
  misc_feature 1..4543: note = Cas9 variant mRNA product
  source 1..4543: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3558 - RNA, 3619 nt, synthetic construct
  misc_feature 1..3619: note = Cas9 variant mRNA product
  source 1..3619: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3559 - RNA, 4480 nt, synthetic construct
  misc_feature 1..4480: note = Cas9 variant mRNA product
  source 1..4480: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3560 - RNA, 3562 nt, synthetic construct
  misc_feature 1..3562: note = Cas9 variant mRNA product
  source 1..3562: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3561 - RNA, 4318 nt, synthetic construct
  misc_feature 1..4318: note = Cas9 variant mRNA product
  source 1..4318: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3562 - RNA, 4351 nt, synthetic construct
  misc_feature 1..4351: note = Cas9 variant mRNA product
  source 1..4351: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3563 - RNA, 3484 nt, synthetic construct
  misc_feature 1..3484: note = Cas9 variant mRNA product
  source 1..3484: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3564 - RNA, 3562 nt, synthetic construct
  misc_feature 1..3562: note = Cas9 variant mRNA product
  source 1..3562: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3565 - RNA, 3568 nt, synthetic construct
  misc_feature 1..3568: note = Cas9 variant mRNA product
  source 1..3568: mol_type = other RNA
gggagagtcccgcagtcggcgtccagcggctctgcttgttcgtgtgtgtgtcgttgcaggccttattcaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3566 - RNA, 3268 nt, synthetic construct
  misc_feature 1..3268: note = Cas9 variant mRNA product
  source 1..3268: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3567 - RNA, 3679 nt, synthetic construct
  misc_feature 1..3679: note = Cas9 variant mRNA product
  source 1..3679: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3568 - RNA, 4237 nt, synthetic construct
  misc_feature 1..4237: note = Cpf1 variant mRNA product
  source 1..4237: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3569 - RNA, 4216 nt, synthetic construct
  misc_feature 1..4216: note = Cpf1 variant mRNA product
  source 1..4216: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3570 - RNA, 4530 nt, synthetic construct
  misc_feature 1..4530: note = Cas9 variant mRNA product
  source 1..4530: mol_type = other RNA
gggagaggcgctgcctacggaggtggcagccatctccttctcggcatcaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 3571 - RNA, 5313 nt, synthetic construct
  misc_feature 1..5313: note = Cas9 variant mRNA product
  source 1..5313: mol_type = other RNA
gggagaggcgctgcctacggaggtggcagccatctccttctcggcatcaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 3572 - RNA, 3585 nt, synthetic construct
  misc_feature 1..3585: note = Cas9 variant mRNA product
  source 1..3585: mol_type = other RNA
gggagaggcgctgcctacggaggtggcagccatctccttctcggcatcaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 3573 - RNA, 4653 nt, synthetic construct
  misc_feature 1..4653: note = Cas9 variant mRNA product
  source 1..4653: mol_type = other RNA
gggagaggcgctgcctacggaggtggcagccatctccttctcggcatcaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 3574 - RNA, 3729 nt, synthetic construct
  misc_feature 1..3729: note = Cas9 variant mRNA product
  source 1..3729: mol_type = other RNA
gggagaggcgctgcctacggaggtggcagccatctccttctcggcatcaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 3575 - RNA, 4590 nt, synthetic construct
  misc_feature 1..4590: note = Cas9 variant mRNA product
  source 1..4590: mol_type = other RNA
gggagaggcgctgcctacggaggtggcagccatctccttctcggcatcaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 3576 - RNA, 3672 nt, synthetic construct
  misc_feature 1..3672: note = Cas9 variant mRNA product
  source 1..3672: mol_type = other RNA
gggagaggcgctgcctacggaggtggcagccatctccttctcggcatcaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 3577 - RNA, 4428 nt, synthetic construct
  misc_feature 1..4428: note = Cas9 variant mRNA product
  source 1..4428: mol_type = other RNA
gggagaggcgctgcctacggaggtggcagccatctccttctcggcatcaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 3578 - RNA, 4461 nt, synthetic construct
  misc_feature 1..4461: note = Cas9 variant mRNA product
  source 1..4461: mol_type = other RNA
gggagaggcgctgcctacggaggtggcagccatctccttctcggcatcaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 3579 - RNA, 3594 nt, synthetic construct
  misc_feature 1..3594: note = Cas9 variant mRNA product
  source 1..3594: mol_type = other RNA
gggagaggcgctgcctacggaggtggcagccatctccttctcggcatcaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 3580 - RNA, 3672 nt, synthetic construct
  misc_feature 1..3672: note = Cas9 variant mRNA product
  source 1..3672: mol_type = other RNA
gggagaggcgctgcctacggaggtggcagccatctccttctcggcatcaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 3581 - RNA, 3678 nt, synthetic construct
  misc_feature 1..3678: note = Cas9 variant mRNA product
  source 1..3678: mol_type = other RNA
gggagaggcgctgcctacggaggtggcagccatctccttctcggcatcaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 3582 - RNA, 3378 nt, synthetic construct
  misc_feature 1..3378: note = Cas9 variant mRNA product
  source 1..3378: mol_type = other RNA
gggagaggcgctgcctacggaggtggcagccatctccttctcggcatcaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 3583 - RNA, 3789 nt, synthetic construct
  misc_feature 1..3789: note = Cas9 variant mRNA product
  source 1..3789: mol_type = other RNA
gggagaggcgctgcctacggaggtggcagccatctccttctcggcatcaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 3584 - RNA, 4347 nt, synthetic construct
  misc_feature 1..4347: note = Cpf1 variant mRNA product
  source 1..4347: mol_type = other RNA
gggagaggcgctgcctacggaggtggcagccatctccttctcggcatcaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 3585 - RNA, 4326 nt, synthetic construct
  misc_feature 1..4326: note = Cpf1 variant mRNA product
  source 1..4326: mol_type = other RNA
gggagaggcgctgcctacggaggtggcagccatctccttctcggcatcaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 3586 - RNA, 4582 nt, synthetic construct
  misc_feature 1..4582: note = Cas9 variant mRNA product
  source 1..4582: mol_type = other RNA
ggggcgctgcctacggaggtggcagccatctccttctcggcatcaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3587 - RNA, 5365 nt, synthetic construct
  misc_feature 1..5365: note = Cas9 variant mRNA product
  source 1..5365: mol_type = other RNA
ggggcgctgcctacggaggtggcagccatctccttctcggcatcaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3588 - RNA, 3637 nt, synthetic construct
  misc_feature 1..3637: note = Cas9 variant mRNA product
  source 1..3637: mol_type = other RNA
ggggcgctgcctacggaggtggcagccatctccttctcggcatcaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3589 - RNA, 4705 nt, synthetic construct
  misc_feature 1..4705: note = Cas9 variant mRNA product
  source 1..4705: mol_type = other RNA
ggggcgctgcctacggaggtggcagccatctccttctcggcatcaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3590 - RNA, 3781 nt, synthetic construct
  misc_feature 1..3781: note = Cas9 variant mRNA product
  source 1..3781: mol_type = other RNA
ggggcgctgcctacggaggtggcagccatctccttctcggcatcaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3591 - RNA, 4642 nt, synthetic construct
  misc_feature 1..4642: note = Cas9 variant mRNA product
  source 1..4642: mol_type = other RNA
ggggcgctgcctacggaggtggcagccatctccttctcggcatcaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3592 - RNA, 3724 nt, synthetic construct
  misc_feature 1..3724: note = Cas9 variant mRNA product
  source 1..3724: mol_type = other RNA
ggggcgctgcctacggaggtggcagccatctccttctcggcatcaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3593 - RNA, 4480 nt, synthetic construct
  misc_feature 1..4480: note = Cas9 variant mRNA product
  source 1..4480: mol_type = other RNA
ggggcgctgcctacggaggtggcagccatctccttctcggcatcaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3594 - RNA, 4513 nt, synthetic construct
  misc_feature 1..4513: note = Cas9 variant mRNA product
  source 1..4513: mol_type = other RNA
ggggcgctgcctacggaggtggcagccatctccttctcggcatcaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3595 - RNA, 3646 nt, synthetic construct
  misc_feature 1..3646: note = Cas9 variant mRNA product
  source 1..3646: mol_type = other RNA
ggggcgctgcctacggaggtggcagccatctccttctcggcatcaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3596 - RNA, 3724 nt, synthetic construct
  misc_feature 1..3724: note = Cas9 variant mRNA product
  source 1..3724: mol_type = other RNA
ggggcgctgcctacggaggtggcagccatctccttctcggcatcaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3597 - RNA, 3730 nt, synthetic construct
  misc_feature 1..3730: note = Cas9 variant mRNA product
  source 1..3730: mol_type = other RNA
ggggcgctgcctacggaggtggcagccatctccttctcggcatcaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3598 - RNA, 3430 nt, synthetic construct
  misc_feature 1..3430: note = Cas9 variant mRNA product
  source 1..3430: mol_type = other RNA
ggggcgctgcctacggaggtggcagccatctccttctcggcatcaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3599 - RNA, 3841 nt, synthetic construct
  misc_feature 1..3841: note = Cas9 variant mRNA product
  source 1..3841: mol_type = other RNA
ggggcgctgcctacggaggtggcagccatctccttctcggcatcaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3600 - RNA, 4399 nt, synthetic construct
  misc_feature 1..4399: note = Cpf1 variant mRNA product
  source 1..4399: mol_type = other RNA
ggggcgctgcctacggaggtggcagccatctccttctcggcatcaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3601 - RNA, 4378 nt, synthetic construct
  misc_feature 1..4378: note = Cpf1 variant mRNA product
  source 1..4378: mol_type = other RNA
ggggcgctgcctacggaggtggcagccatctccttctcggcatcaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3602 - RNA, 4484 nt, synthetic construct
  misc_feature 1..4484: note = Cas9 variant mRNA product
  source 1..4484: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3603 - RNA, 5267 nt, synthetic construct
  misc_feature 1..5267: note = Cas9 variant mRNA product
  source 1..5267: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3604 - RNA, 3539 nt, synthetic construct
  misc_feature 1..3539: note = Cas9 variant mRNA product
  source 1..3539: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3605 - RNA, 4607 nt, synthetic construct
  misc_feature 1..4607: note = Cas9 variant mRNA product
  source 1..4607: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3606 - RNA, 3683 nt, synthetic construct
  misc_feature 1..3683: note = Cas9 variant mRNA product
  source 1..3683: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3607 - RNA, 4544 nt, synthetic construct
  misc_feature 1..4544: note = Cas9 variant mRNA product
  source 1..4544: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3608 - RNA, 3626 nt, synthetic construct
  misc_feature 1..3626: note = Cas9 variant mRNA product
  source 1..3626: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3609 - RNA, 4382 nt, synthetic construct
  misc_feature 1..4382: note = Cas9 variant mRNA product
  source 1..4382: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3610 - RNA, 4415 nt, synthetic construct
  misc_feature 1..4415: note = Cas9 variant mRNA product
  source 1..4415: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3611 - RNA, 3548 nt, synthetic construct
  misc_feature 1..3548: note = Cas9 variant mRNA product
  source 1..3548: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3612 - RNA, 3626 nt, synthetic construct
  misc_feature 1..3626: note = Cas9 variant mRNA product
  source 1..3626: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3613 - RNA, 3632 nt, synthetic construct
  misc_feature 1..3632: note = Cas9 variant mRNA product
  source 1..3632: mol_type = other RNA
gggagagtcccgcagtcggcgtccagcggctctgcttgttcgtgtgtgtgtcgttgcaggccttattcaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3614 - RNA, 3332 nt, synthetic construct
  misc_feature 1..3332: note = Cas9 variant mRNA product
  source 1..3332: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3615 - RNA, 3743 nt, synthetic construct
  misc_feature 1..3743: note = Cas9 variant mRNA product
  source 1..3743: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3616 - RNA, 4301 nt, synthetic construct
  misc_feature 1..4301: note = Cpf1 variant mRNA product
  source 1..4301: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3617 - RNA, 4280 nt, synthetic construct
  misc_feature 1..4280: note = Cpf1 variant mRNA product
  source 1..4280: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3618 - RNA, 4581 nt, synthetic construct
  misc_feature 1..4581: note = Cas9 variant mRNA product
  source 1..4581: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3619 - RNA, 5364 nt, synthetic construct
  misc_feature 1..5364: note = Cas9 variant mRNA product
  source 1..5364: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3620 - RNA, 3636 nt, synthetic construct
  misc_feature 1..3636: note = Cas9 variant mRNA product
  source 1..3636: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3621 - RNA, 4704 nt, synthetic construct
  misc_feature 1..4704: note = Cas9 variant mRNA product
  source 1..4704: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3622 - RNA, 3780 nt, synthetic construct
  misc_feature 1..3780: note = Cas9 variant mRNA product
  source 1..3780: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3623 - RNA, 4641 nt, synthetic construct
  misc_feature 1..4641: note = Cas9 variant mRNA product
  source 1..4641: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3624 - RNA, 3723 nt, synthetic construct
  misc_feature 1..3723: note = Cas9 variant mRNA product
  source 1..3723: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3625 - RNA, 4479 nt, synthetic construct
  misc_feature 1..4479: note = Cas9 variant mRNA product
  source 1..4479: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3626 - RNA, 4512 nt, synthetic construct
  misc_feature 1..4512: note = Cas9 variant mRNA product
  source 1..4512: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3627 - RNA, 3645 nt, synthetic construct
  misc_feature 1..3645: note = Cas9 variant mRNA product
  source 1..3645: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3628 - RNA, 3723 nt, synthetic construct
  misc_feature 1..3723: note = Cas9 variant mRNA product
  source 1..3723: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3629 - RNA, 3729 nt, synthetic construct
  misc_feature 1..3729: note = Cas9 variant mRNA product
  source 1..3729: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3630 - RNA, 3429 nt, synthetic construct
  misc_feature 1..3429: note = Cas9 variant mRNA product
  source 1..3429: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3631 - RNA, 3840 nt, synthetic construct
  misc_feature 1..3840: note = Cas9 variant mRNA product
  source 1..3840: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3632 - RNA, 4398 nt, synthetic construct
  misc_feature 1..4398: note = Cpf1 variant mRNA product
  source 1..4398: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3633 - RNA, 4377 nt, synthetic construct
  misc_feature 1..4377: note = Cpf1 variant mRNA product
  source 1..4377: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 3634 - RNA, 4517 nt, synthetic construct
  misc_feature 1..4517: note = Cas9 variant mRNA product
  source 1..4517: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3635 - RNA, 5300 nt, synthetic construct
  misc_feature 1..5300: note = Cas9 variant mRNA product
  source 1..5300: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3636 - RNA, 3572 nt, synthetic construct
  misc_feature 1..3572: note = Cas9 variant mRNA product
  source 1..3572: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3637 - RNA, 4640 nt, synthetic construct
  misc_feature 1..4640: note = Cas9 variant mRNA product
  source 1..4640: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3638 - RNA, 3716 nt, synthetic construct
  misc_feature 1..3716: note = Cas9 variant mRNA product
  source 1..3716: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt
